United States Patent 10,233,495 (METHODS AND COMPOSITIONS FOR SCREENING AND TREATING DEVELOPMENTAL DISORDERS) - sequence listing, part 35

SEQ ID NO: 319 - DNA, 41341 bp, Homo sapiens
gtcagtcaggaaaaaaaaaagcattctctccgacaggtcaaatcaccgaagcctcgggatcgtcgctgggggctgtgacggggctggcatgaaacgtccctctgtctggctgggcgatgggtcagtgctcaggagtttcaggcctttaaggcccggccagaccgcagggggactctgcagccgggtcggggtttcgatcctgcgctgcggccttgcaactgcgaggacttgggggtcgtgcttcgttcgcctggtatcctcgttcgtgcgtgtaggaggcgcctggcttgccgggcggtgccaggcggcaagagggagggcgcacggagcgtgtccgcccagggcggcccctgtaagcgctgcagaagcgctgctcccggcgcccggccccgccccagcctccgccccactaccgcgcagcgcaggctccgcccccagttttccccgccccgtggcggggacgccccgcccggtccggcccgctcggcctcggcagcagcggctgcggcgaaggcgcgcgaaggtaggtggccgggggcgcgcgcgtgcgcgggggcgggacggacgcgctcccggcggaggaggccgcgcgcctgggggcgggctggagccacgtaccggggctgggggcgctgtgtgttccgcgactgccgcggcccggcaccggaggccaggagagcgttcccaacaggctccgcggatgccccgccgcgtcctgccgcccatcctgcccggattgtcgcgggccgggggcacgacaggagactggggcctgcagggcgcagccgtccctccgccggccggggtcccctcgctccgcgggcggccgtgggaggccctcgcgacggcctctgccccccgcagatgccctctgcagctcctgcgtgcgggccccgccctgcactgccctcctcgtgtgggatccggtttcgtcttcattgcagccctgccgagtcggaagcatctccattgtgcggatggggaaactgaggcccagagcgcatagttgggctggccacggaggcagggccgccggatgctgtgcggggatggggccctgcaccccttgcgcctctcaccatgcggcctcaggcctctgtgcccggcagcgtctctggagtgggcattttgaacgagctccctcctgattttcacacagacttaagcctgacgaccatgctggggcggatgtctgcccctctggtgaccaggtcacagctcccttgggaagacgattgactggggaatggggaccctggggaggaggacttcagggtgccatctgtctgtttacgccagaaaacagagatttctgttttctttcgctgggctcacagcaggtgcttaataaacagatcttgtggcgggagcagacgacagcgaggttcaggcaagactccaggagtcaacccctggatctcggaggctccccacccgcgcacatttccctgacttaaccctcccctccccaagtctttcagccctttccacccaagtggcccctgtgggggtcactgcctggttttcaccctgatcttctgggatgcggcagatgctggctggatatgtgttcgctggtgtccttccgtgatccccgtctgtggctgacaccatctgtggcccaacatgaccccagccagagccaaggggaatcatttctttttccatttaacatcctatgttattacttggctcttagcattcattaattcattcagcagctcttcatggagctttggccttagcccatgcactgtggaagtgacagtgagctaagccaacctggcactttgggaggctgaggtgggaggaccgcttgagcccaggagttggagactagcctgggcaacatctcatctctacaacaagtaaaaaattagccagacgtggtggcacgcacctgtggtcccagctactcaggaggctgaggtgggaggatcccttaagcccaggaggtcaacgctgcagtgagccatgattttgccactgcactccagcctggaaaacagagcaagaccttgtctcaaagaaaaaaaaaaaaaaggaggagacagacaacatacatgttggagaaaatggaacagccactggagggacctctttagctgagagtcggggtagctccctcagaaagtgatatttttgagccaaaatctggccgacaagcgggagtcagctgtgcaaaagaagggggaagtgcgtcccaggcagagaaagtggcagtgcaaaggcccagaggtgggtgcctgcctggtgtttgaggaatcaagaaggccatgagcagccaggtgtggtggctcatgcctgtaattccagcactttgggaggctaaggtgggtggatcacttgaggtcaggagtttaagaccagcctggccaatacagtgaaacctcatctctactaatacaaaaattagctgggcgtggtggtgcatgcctgtaatcccagctactcgggaggctgaggtaggagaattgcttgaacccaggaggtggaggttgcagtgagctgagattgtgcaccactgcactccagctcaggcctgggcaacagatcaagactctgcctcaaaaaaaaaggccatgagagaaggggagagaggagatgaggtgggaaaagtggagtggggccagatctggtgggccctgtgggccatggaaggactttgaacttcattttaggtgtggtaagggctagtagagggccttgggtaggggaggggtatgacctttactgtgtgaaacttgagtgggtgaggggatgagcagggaagcatagagaccctcggggagccatctcagcagtccaggcagtggcttatataatacacatcggcgtcctggggtggtgccaggtacacagcaggcgctgcaggatggaagtcattgctgttactgtttttgtttatttgagacagggtcttgctctgtcacccaggctagagtgcagtgacacaaccacggctcattgcagcctcaaccttccaggctcaagcaatcctcctgcctcagcctctcaaggaactgggactacaggaggtgcatgccaccatgccaggccaattttttttatttttttggcagagatggagtctcactgtgttgccagggctggtctcaaacgcctgggctcaggcagtcctcctaccttggcctcccaaagtgttgggatcacaggtgtgagtcagtgcacccggcttgctgttattatttaaaactctgggctgggcgcagtggctcatgcctataatcccagcactttgagaggccgaggcgggtagatcacttgaggtcaggagtttgagaccagcctggccaacatggtgaaaccctgtctctactaaaaatacaaaaataagctgggcgcggtggcgcatacctgtaatcccagctactcaggaggctgaggcaggagaattgcttgagcccaggaggcggaggttgcagtcagccgagatcgtgccattgcactccagactgggtgacagagccagactccatctcaaaaacaaaacaaaacaaaaaacaaaaaccctttggaatcaggcacacctaggtcgcggctgtgacttgagctctttgtggctgggtgcattggagccaattatttaacttcgctgagacttcacgctgtcatctgtaaagtgagtagggtggtgccaggagtgttaaagcaggtaagggacagatgtaacgttttgggcacagggcctggctcgtggttggttcaatatttttgtcataatttctagtcagcagcaggaggataacgaaggggtaagcggataagagcagctgctatgtttgaaacgagtaatctttgaggggctttttggctagttcctgccgctagccctggcaaaaggcaagtttggagggtggtagtggggagggaagggtacaaagggtgtctcctctgtatttggtcaccaaataatgtctcagcatctagaacaaggcacagggttctagcttggggactagaaagagccaataatactcatgatagtaatgataacagtagtaatagccaacacttacccgctgttgaactgcaggtagtaattaaggtaacactagctaatgtgatagtgaaaccctgaattctcagaggcttagcgcaatagaagtttatttctcattcatgaaaagccctgttgggtgtttggcaggtggctttctatgtggcgacccagggaccgagatcccttctgtcttgtggttgcggcatcccctaggaccttggagttatttccttctagctgatggaccaggaaggagagaaataattttatggaccaagcctaaagtggcacgctgtctttctgtcttaattctatggaccagaacttgaccacatggccgtatctgactgcaagggagtctgggaaatggcttttagccatattcctaagaggaatcggaaatgctttgtggtgagcacattgcagtttctgccacaccatatccaggcatatagcttagcacggagtattttatttaatgctcatgctagaaacaggcaccattattatcccattttgcagatgaggaaactgaagctcagagaagtgaagacactggtgcagggtcacacagctggtgaggggctggtgagccaagattggagtccaggtggccagatgctgaagctgttagcatccagatttctaagaggaattcagtctttttttttttttttttttttttggagaattgggtggaagcagtggacacatacacgaggttcagatatgacttcctgggacccacagaacccagcaggactctgggggagaactttggggatggagccaagggtgaatgtcacctggtgccaggggctgacatcctgtccccttcctccaacccttagggccgtggtcaggagaaggcacagaataatccagttcagtccctcaaggacatctggggccccctctgctgagctgggcatgcagggctggacatgctggtccaggggtatttttggcttcccccctgttctggtgggcaggtgtgcagcctgtagaggggattttttggaggctgcctagaggtagaagagtgggcgtccctggggtttgtagtggcagctctatctgctggccggtttagttttttgtttttgttttttttttgagacagagtctctctctgtcacccaggctggagtacagtggtgcgatctcagctcactgcaacctctgcctcccagtttcaagtgattcttgtgcctcagcctcccgagtagctgggactacaggcacccaccaccatgcccagctaatttctgtatttttagtagagacggggtttcaccacgttggccaggctggtctagaattcctgacctcaagtgatcgacctgcctcggcatcccagtgttgggattacaggcatgagccactgcacctggccagtagctggtttagttttgcccaaatctggcttgcttgccattgcaacttggcaacatttatcttttcagacctgtttcttggttttccatttgcagggcagtttccttagttgggcgtgagcggtccagcctggactgatgagcatttatacagcaccgtggcattctgggtctgacctggatacagaagtagagcctcaaagcgcaaatgcctcggccttgcccttcagtcactcattgggaggctgctggtctaagtggaatgagctttgggctcaccacttccctgaagcatgtcgccttgaataggtgagagcccaatgtctctgagcctcagttttctcatctggaaataggttgaagtaaggatttaatgagataatgtgaatatgccccctttggggcacagcatggagcagagggcacccagggacggagggctgaggcatagcagtgtagcaggacaagccgcaggcaaaactcttcagtcaccaggttaaagaaggaaggaactttattcggctgggaacttcaggagacttgtgtcttaaaagccgagctcctcgagtgagcaattcctgtccttttttagggcttacaactctaagggcaggagcccagacacgtgatgctaatgacaataggaacagtggcccccattggctaatagctcaccacctgccaggtgtggtaggtactatcagtcgcatttttttgttgtttttggtaggacagagtctcgctatgttgcccaggctggtctcaaactcctgggctcaagcgattctcccattttggcctcccaaagtgctgggattatagacctgaatcaccacactcggtctagtctcattttattttattttatttttttgagacagactcttgccctgtcacccaggctggagtgctgtggcacaatctcggctcactgcaacctcctcctcctgggttcaagtgattcccctgcctcagcctcctgagtagctaggattatatgcacatgccaccacgccccagctaattttttttatatttatttatttatttatttatatttttgagacggagtcttactgtgtcgccaggctggagtgcagtggcatgatctcgcctcactgcaacctctgcctcccaggttcaagcgattctcctgactcagcctcccaggtagctgggactacaggtgtgcaccaccatgcctagctaatttttgtatttttaatagagacggggtttcaccatgtaggccaggatggtcttaatctcttgacctcctgatccgcctgcctcagcatcccaaagtgctgggattacaggccaattcttgtatttttagtagagatggggtttcactatgttggccaggctggtctcaaactcctgacctcaagtgatctgcccgcctcagcctcccaaagtgctggaattagaggcttgagccactgcacctggcctggtttagtctccttttagagatgagaaaactgaggctcagggaggtaacctgttcaaggtcttactgtcttgaacaccatagttgcaagtgacagagctgagtctcacatgcaacctcagacctgatactgactccagagctgtgcgcctaagcactagagcacatagcctccttgccccagggaaagaacaatgggaggtggtgggtgacctctgggtctcagggccctgggatatagggactgtgccttttttttttttttttttgagacaaagttccactcttgttgcccaggctggagtgcaatggcgcgatcttggctcactgcaacctctgcctcctgagttcaatcgattctcctgcctcagcctcccaagtagctgggattacaggtgtgcaccaccacacccggctaatttttgtatttttggtagagacggggtttcaccatattggtcaggctgatcttgaactcctgacctcaggtgatccacccgctttgtcctcccaaaatgccgagattacaggcatgagtgcctgcgcctggctgggactgtaccttctggattttcaaatgaatgaaatgagtatttcttgagtgttggccacgtgaccccccagcaccatgtcatgtgctgggtatgcacacacgatactgtttcatccccggacggctccgagagatgagtaccaatattatcacatcttacgtaagaggacactgagtctcagagaggcaaagtcagtgtccctggtgcacccagctagtgggggctggggtgggtgtgaaggggccagaagcttcccaataagtgcctgaagggcaaggctagggcatttgtagttcgaggctctaccactgtgtctaggtcagacctaggaatgccgcaggtgttgcataaatgctcatcagtccaggctggaccgctcatgcccaactaagtgccaagcctggcctgggtgatctcacagcctgcattctttgccctacacctgttgtgggaaaacatactcccagcatgctgtaaatcctctcattcttagctaaccatgtgactcccgttctgggccagaaagatggtcacaaatacttaggactctggcctttcccgccgcatggctactgaccccaccccctgggcttggagggctctaggacccagcaacctgcgcagggtgaagagtgtgtgaggtcctgacctccaggtgtctcccctgtttcctcctcccattccctcttctctctcctccctccttttctctcccttctcctcccctctcttcatccttcctcttcctttggctccctgcctctgcttccctcctctcctgtcctttcccatcccctccctcctcagcccacatcctgctcctcccaccgcggtggtcacatgggggcgccgccggatttaagcttaatctgcctggtgctcagcacagcatcctggctgtggcgcgtgctgactgagctagtcttggggtcctggagaagggggctggaggcatgcccacagcctcccccccatgagcttggggctggcgagggcacaggaggtggagctgacactagagacggttatccaggtgggtcctgggggctgtgcccaccctgtctggggcggggcagcgtggacttaacaggagtggtgagaggtgtgtgcgtcttggggatcaaggggtgggagaggtgtggtggtggtggggtatacaggggccccccgcttgcagttcctggcaagatggggggcagaggtacacacagggtgcacctgctgtggctccctcatcccagtgccctgggttgggagaagggggtctctactgccagattttagggcttgggggacctctggcatagccagatcctcatccatctagggtcggaaccggattggggcccccaacactggactgcctccagtggggtttgggagttacccgtagggtttggttctcatctctggccctgggccttcttcctggggcagtgagcacacaagaggctctttgcatggggattttttggattctaactcccaggcttcactccatcttgagggggctcctggggacctgtatcttgggcagtaggattctgtggctctccccacgaggccagggagccccgggtcccatgtcccctgaagaccctctcgcttttcccacagacactggagagcagcgtcctgtgccaggagaaaggcttgggcgcgcgggacctggcccaggacgctcagatcaccagcctgcctgcccttatcagggagattgtcacccgcaacctctcccagcctgagagcccaggtgccacccccatccgctcccctccacaaacaccacccacattttacctcttctcatgtccctttcctgagcagtcaccatgatgatcatgactgtaactcactgtggggcaggcacagctttatgacagaagaacccattttacagatgaggaaacagaggctcagggatgtaatttgtccagacttattccgcatgtggtgcaactagaaggaagggccgagcatctcctgcgtgcttgcctgtagcctgctgcagagatgtgaaccccaaatcccgtattcccacccggggaaggtgtgagctggctgaacccaagatacaggaagagggcagctcagctcagaccagggttttgcggaagtctgagtggatggcgccgtccatccgtttcccacgtgggcaggaaggcggatggtccctgctcctctcagtgggtggcgcacacggtgtagttatgtggcttgaggatctgggaaaggcacactcagttgcagctggtgtgctggcgtgtggcgttttggtgctctaaccattgtctgtgttcaactcccaagctacagacgggccccctccttgggagcgccagggatgttggcgccctggagccccagacagggagagactcagagggccctcaccctgacacctggggtgtatgtccagttctcccagggtagaaggggaacccacaggaggtggacaaccccgcttctcccgctggcctttctttccctcttctctctttctccttctcctcacaacctgacctatgctatgctctcctgagccctagcctttaaagttccatgaagcccttctcttgagcgaggctttgatgcttttctgggaggatctggttactactattctaccttttttttttttttttttttttttgagacagagtctcgctgtgttgcccaggctggagtgcagtggcgcaatctcagctcactgcaacctccacctccccggttcaagtgattctgctgtctcagcctcccaagtagctgggactacaggcatacaccaccatgcccagctaatttttgtatttttagtagagacagggcttcgccgtgttggccaggctagtctcaaactcctgacctcaggtgatcctcctatctcgactcccaaagtgctgggattacaggcgtgagtccgtgcccgccccacccatattacagataagtaaatctgaggccccggagaagaagactaattggaaaaggagggagcaagaactcaggggtctcctggctcctagactgagtgtctctcctgcacctcccaaacctgctgggccacactttagctggagttgtgttcactttacgtccagctttgtatcccctccttgccttcctccctgttctcagctctgtttgcaggcctggtgctgcagccattcccatctggactcctcccaggggcctggatggttttcttgccctccctgttggggggaggatgtcccactggacccagaagccaaccatgtgcccactgtcccttgccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagagggtgggtgccgcccaggtggtggactaggccagggttcccctcgttcaagggcagggaggcatctagaccaggcccacacacggggcaaaagatgggccctggagtcaggttggcctgggcttggattgaggctctgccaccttgagtggcgttgagcaaatcactatgctctttaagcctgttttctgtagtggggattgtaatgggacgtggaattgtaggaatcaaggagataatagaataaagtgcctggcaccaggggtattttgttcccatctgtcccaggcctgttaggggtgtgggacacggagaatgagatccctaaagattcctgccccttgagtttctgggcatctcccattgccacgggccttggggttgaggcggtggctggatgctggctcgaggctggtgtgggcacccgcggtgttctgcagcccatctggggcagccacaagacctgccgccactgcctattggaatgagttccaggcagggaaggaaggagaagcaggcctgtcttcatgtccaggcaggattcacatcacccgtgctgcaggcttgtgggggtcccagggtgtggggcgggagctgggtgtgagccggtgcgaggggtgcgggatgctcttgatgcactgtctgctttgggcctccgggtggccgggaggtggccctgggaagttggtggtggctgaagattggtaagggacactcgcagctgggacagagtgtatgtgtgcagatgagaggcatgcaggtggcaataacgtattaacagtagctactgtttattgagtgcctactatgtgccaggcgcgtgctgagtgtttcacatttaatacaccaaggtcgggaccattatgatgcccatgtaacagaggagaaaacagaggctcagggaggggaagcaccatgctgggggcacacagccagttaaagttagacaccaggtcttccaactcccagcccagggctctgtttggtttctaaactaacccagtctagaaacaaagttctgaagtttcatttcctgtgtatgggaagagacactgggctagggatttcagggcacagctggcccccacaaagttggaagggacccagagaggcaggggctggcccagggtcccctgtgtggtagtggcagagctagggttggcatgggacccctgagctggacttgtccaggctggagcccgcattggcaggagggtgtgtgttcctgtgtatgactgtggggtgtgcccgtgtcctgggatttgcctggctggacaaacccacgactagttgggacttgtagaggagcagagtaggcggcccgcagtggcccctggcatgaggacagtggagagctcgtttccccagggtctgcagcgggtgtgtagggcacgctggccccagtcatgaattgtgggtggtgatggggccctgagccaggcacccctttcttttggtccatgcatggcacagtgccacacccccagggccgcctcttaaatgccaccttctgaagctagccctgcccccaggttggcagggaagggaagaggtgggaggtagcaggttcctcctctgctgggacacagctgctggggctgggactgcagcacagggggtctgggttagtctagaaagctccctcctgtggttagtgggggcccaaatggcacgcagagggcgcccgctgcttcagttgtcctctatccaccatggtttgaatgaggccccacctggaggcaggggtggaacaggaatgacctcaaaggcctttcctggagggtgggtccccagagaacttcagagcctagagatcacctcatcacagatagggaaagtaagtccgggagaggggcatgataggcccaaggtcagtggtggtcctgggatgagacccttggtccagggctctgcagttgggcaacattctctttccctgccacccccttgtccccatggccacaggtggcagtgcctgcccctgtggccctcactggcatgttgggctgggttggtgggcagtcagcgagattgttctgatctttccaaccctgcagcacccctggcatggggagcggagggagggtcaggtctgtgtcctgttaactgcatgtcctgcagggaaactgaggcactcccagaggccacctcccagccgagagagaggacctcagggcccccatgggggtccccccttcttgctgtccctgagaagcagatgtaggcgcagctgggaatggaaaggagggagtggtcacgcctcccttggctccagaggacagaccccctgggctccctcgtgtccatagcaacctggaaagagtaaattgaatggcggtctgagggcagcagttgctaggggagacagtcaacttctttcatctctggcttagtggcagcctccttcccttttgaattgcaagtaaaattgaaaggctgttttgctcacggtgaagtttgtggaaaggggtgaggtgtggccgagagggccctggctctggttctgagcactggagaagggggaggagaacccagcaacggcctgaacccctctgtgtcccagaggcaaacagcacctgcttcacacagatatgcagtgtgtacacgacatgggctacactgggccccacacagacacacagatgcacaaaacattccacaaacaacatagtgagaccctaaaaccaggccacacagaaacactccaattcacagaatatgcacagtgttagccgcacacacagccagatgccacacaaccccacacaggcacagaacagtccccccaccaccggggacctataacaaccatatgcagatgacacagcacgctatctcccacctcatgggtgcacacggacaggaaaagcatacagttcaacacagccaccaatcggcccacaaaggtatgcccagatgcacaaagtgtgtatcacacataccagggagcccaggcacaccccccagacccacccacatgcggttgtacacttgcctcaccgacacacagacatataccctgatacacacagccaggcccaacacccgcgccacaacatagaccttcagccacagatgccgccttagccgttcacgggaaggctcagatgcaccaaacagtcgacgtgaactcagcacccacacactacacacacagtgtcctgcgtggagacaaatgacaaaatacaccccactcgcacctagtgagagccaccaacatcagtgcacagcctgtgtggctgcctcaggccaccgccaccacacacagatgtggacaccgctcaccattgacctcagtgggcttggcacagacgcttgacaggcctgcagccgccatccaggcagaaaccccctacttccacctcccctgcacagccttggactgtgttcctccagactcagggggaagcccccaagtagtcacagttagctcctccctattggtggggctgccatgcacgtgtcccgggggtggggtgggtagagatgtccttgctttgtctgtggctcatagaacatctctcagcatatggggtcaatgcaggcctggagggcaccttccctaccgctaacctggcctggacccaagacccgagatgagcgtgggtgagagcagctgccctcctgttggcttcctgtggctggcgtggccctgcacgggtgggcttttgaatgccctgcctgggctgtagcaggccaggtcctgaggatgcagatggtgagtgcagggctagcatcagagtaagctgggctggggtgttgtcgctgccaggtgcccttgacccactgtgtgctctcccactgccctgctcctccctcacctcccttcccccaacagctggggaagatgaggggccacctggggccagcaggtgccttaagggagttgagagggttctatggctggtagggacagccagagcccacaggggtctgaggatgtgcgggatggaagcttcctgggggtggaggaagggcagcagcaacagaggctttcctgcagtgaggatggaggggacctttttttttttaagatggagtcttgggccggatgctgtggctcacacctgtaatcccagcactttgggaggccgaggcgggtggattacgaggtcaggagttcgagaccagcctggccaacatagtgaaaccccatctctactaaaaatacaaaaaattagccaggtgtggtggcgtgcacctgtagtcccagctacttgggagactgaggcaggagaatcatttgaacccgggaggtgtaggttgcagtgatccgagatcgagccattgcactccagcccaggagacagtgcaagactctgtctcaaaaaaataaataaataaaataaaataaaaaataaataaataaagatggagtcttgctctgtcgcccaggctggagtgcagtggcacgatctcggctcactgcaacctccgcctcccaggttcaagtgattctcctgcgtcagcctcttgagtaactgggattacaggtgcatgacaccacgcccagctaatttttgtatttttagtagagacggggtttcatcacgttagccaggctggtcttgaacccctgacttcaagtgatctacccgccttgacctccaaaagtgctgggatcacaggcatgagccactgcacccagccagaagggggcattaatatgcaggcgccgtatagggcaacacctgtgtgcacctcttacaaatcttaatgctgtgtatatgagggggttccttcgtgtcctccgggaatgtttgaggttgcctgtatgtgttatgtgtgtgcatatctttaaggtcagatatgcatagacagattgacacctctgttttgaatgtattcccatgagctcatcccattaattcactatcgcaacaaatatttactgagcgtgagccatgccattccacagccaccattctagtactaagatacaatgaggaacaaaaaatccaggctttcctgagctcacattggggtcggggcatggtgggaagacacaggcatcaatgtaataaacagaaaccacgacagggctaagtgttctggaggagaggcacatggtgtactgaggcccctgaggttgacccaggtgcacctttgagctttgcctgcgtggtttgggtttgtgggctcacctgcatgtgtccatgcatgccccgtctgcgtgcccgtgcatggctgcatcaccccatacacacgtgcactgcccctgggcttgcccacatgtgctgctccccagggcgccaggctatcagcctacaaggcattgtgggtctgggcccagcctgccacgccctacagaagcctgagcctgccttcccaggaggcccaggactctcacccagggcccttccctgcagctggagcaggctctgcggctggagcctggggagctggagacgcaggagcccagggggctggtacggcagagcgtggagttgcggaggcagctgcaggaggagcaggcctcctaccggcgcaagctgcaggcctaccaggagggccagcagcggcaggcccagcttgtgcagcggctgcagggcaaggtcaggaccacccactcctgctcctgtcctcccacctgttcactttgccccgccccaacccctggggctcaccatcagctccccatccccagattctccagtacaagaagaggtgctcggagctggagcagcagctgctggagagatccggagagctggagcagcagcggctgagggtgggtgccagtgtggggcaggggcaggccctgccctccacctgcccaacctgatgctttaacctctctcccacccaggacacagagcacagccaagacctggaaagcgccctcatccggctggaggaggagcagcagaggtgagggcgcagcagggagggccagggctggcaggatggccccctgcgcgagcgcctactgatcccctgtgccccattcaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggaggtgggcatgggggtgcagggaggccagcctgacccaagaggaaggggcactgcagaggagggaggactcagaagcctggagagggagagggagcactgtccaagggagcctgttagcagaagtaaatagccgtcatcacaatagctggtctttatcagtgtgtagcatgtaccacgtgcacggtgtgcgttgacctttattcctcatgataactgcatgtggtaggtgctatcattctcctcattttaaagagaggttaaggccggtcgcagtggctcacgcctgtaatcccagcactttgggaggctgagagatcgtgccactgcactccatcctgggcaacaaagcaagactctgtctccaaataagtaaataaataaagagagtttaagtaacctgcccacagtcatgcaactggcagctgggatgcaaagctaggtcccttgcatttttgcccttcgttgctgcctcttgcagccaaaagaggacttgaaacccaggtccctgtgcaggagggagccatgaggcttgggaggctgagcatggccgctgcaacacagctctgtgcacagacccacaggaagacccaatccctgaacgacggtgcctcccaggatggtcggagatgagggaagcagtgggagggagtaaacccgctctcacaccaacccttccctcggcatgtcttccctccagtccttcaacgcctacttcagcaacgagcacagtcgcctgctcctcctctggaggcaggtggtggggttccggcggctggtcagcgaggtgaagatgttcactgagaggtgaggcctggccggggacggggcagcagctgagagccagccctgctctttatgtccaactgaactcagttgaatttcagttcaactcaacgcacttactgtgcacaagggccggtgaggacacagaggcaacttgtaataaccattaccacagtcgtggcagtcagcatttattagatgtttactctgggctaggctcattgtatatttcatttcaactaatattcatagcttccctgtgaggtaggaactgtgttcattcacatattacagatgaggacattgtggcgcagagaggttgagtgatcttcctgaggtcacacagtagtacataagtggctgagtcagagtttgaagttcctgattttttttttttctcagacggagtcttgctctgtcaccaggctggagtgaggtggcacgatcttggatcactgcaaccttcacctcctgggttcaagcaattctcctgcctcagcctcctgagttgctgggataacaggcacatgccgccacacccagctaattttttttttttttttgtattttagtagagacggggtttcaccatgttgcccaggatggtctcgaactcctgagctcaagcaatcagccagcctcagcctcccaaagtgctgggattataggcatgagccacagcgccaggccgaagttcctgattttaatccactagaatattcagctttgctaccaaggacctcacagcctcttgtgatgaaaagatgtagatccccaaaattctaggctgggcacggtggctcacgcctgtaatcccagcacttgaggaggccgaggcgggtggatcacctgaggttaggagttcaagaccagcctcaacatggagaaaccctgtctctactaaaaatacaaaattagccgggcatagtggtgcatgcctgtaatcccagctactcgggaggctgaggcaggagaattgcttgaacctgggaggcagaggttgcggtgagccgagatctcgccattgtactccggcctgggcaacaagagcagaactccatccaaaaaaagtaaaataaaattctagactgaggaagcgagtggtcagtgatatgtacgtggaacagagggaatgtcctcgaggctcagaaggatgggaggggtggggaggtcagaaaaaccactttgtggagatggaatttgcacagagcctcaagggatgggtagggttgaagcagagcagcaggcgctccaagcaggagcaaggcatgagcaaaggcatggaggtgggagcccatggcagccaggggggttgcaatgaagagctggtacagggaaaggagagcctgcctcagcgggggagcttgggcctgcctgatccgtgtgagcagtcagctcaacagtagtgtcagggaggctgcggagagagccccaaggcaggaggccaaggtatttcatttagtgcgttaaaaacattttagttagtaatcttttcttttctttatggctcactacagcctcagcctcctcgtctcaagcaatcctcctacctcagatcctgtgcagctgggactacaggtgcatgccaccaggcttgctgatttttttatttcttgtagagtcgaggtctcactttgttgcccaggctggtcttgaactcctgagcccaagtgatcctcctgccttgacctcccaaaatgctgggattacaggcatgagcaaccacacctggtttaataatcttttgttaatatcatcaaatagccagtgtctaaattttccatatgtctcataaatgtcacagatagaccaggtgcagtggctcacgcctataatcccagtacttcaggaggccgaggcgggcggaccacctgaggtcaggagttcgagaccagcctggccaacatggtgagacccctatctctactaaaaatacaaaacttatctaggtgtggtgacacatgcctgtaatcccagctactggggaggctgaggccccagactcgcctgaacccaggaggcggaggtttcagtgagccgagataacaccattgcactccagcctgggtgacagagtgaaactctgtctcgaaaaaaaaagtcacagatagtcttgctttagttttttctttacaatttgtttgaatctcgatccatagacatttacaaaacgtaaatgtttgctttgtcttttttttctttttttttgagatggagtcttgctttgttgcccaggctggagtgaagtggcacgatcttggctcaccacaacctctccctcctgggttcagcaatcctatggcttcagccccctgcgtagctgggattacaggagtgcgccaccacgcccagctaacttttgtatttttagtagagatgggggcttcaccatgttggccaggctggtcttgacctcaggtgatccacctaccttggtctcccaaagtgctgggattacaggcccaagccactgtgcccggcccctgctttgtcttttaagtcccttttaacttatttgttcaggaaactgggctagttgtccttggagattctcatggtctggattttgctggttgcatccttatggtgtcaattaacatgtttctttatcccatgtatttcctgtaaattggatgttggatctaaagctaggtcagattcaggttcttctgcttgcttttttgtttgatcaagactccataagtagaatgtgttcttccagcaggatgcccctatgccagctgtctctcttttcaagatccaacccactcatcaaaggctgcaaaactgtgagcttctcatttagtcactcctgtgtatattaattagaattctggaatgaggcactttctctccttactattagataaccagtggtactgttcattcaggaaaggaaaggatttaacctgtattatggactgaaaatacatttttttttttgagacagtctctctctgttgcccaggctggagtgcagtggcacaatcacaactcacattaggcttgacctcccaggctcaagtgatcctcccacctcagccacccaagtagctgggactacaagtgtgcaccactatatctagctaatttttgtttgtttgtttttagagacagggtcttgccatgttgcccaggctggtcttgaactcctgggctaaagcagtgcacctgccttggcctccgaaagtgctggaattacagaaatggcccaccatgcctggccttaaaatacaaaacaaaaccaaaaattttaagtagcctttaaaatttttatattttacttttgattaagtcacatgttcacaaggttcacatttcaaaagggtacacagtaaaatggctccctctcacctctgaccccagatattcctcttccctccttggaggcaagcagcattatcagcttctttttctttttatatatacagattttttcttttttcttttttgcttcttcttcttctttttttttttggccaccaagttaccatgagaagcattatcagcagtttcttttttttttttttttttcttttttgagatagagtcttgctctgtctcccatgctggagtgcagtggcacgatcttggctcactgcaacctccacctcccaggttcaagcgattctcccacctccgcctcccaagtagctgggattacaggcatgagccaccacaccccgctaagttttgtatttttagtagaggtggggttttgccatgttggccaggctggtcttgaactcctgacctcaggtgatcctcctgcctcagcttcgcaaagtgctgggattacaggcatgagccaccacgcctggcctatcagtttcttaagtgaccttccagggttatcttacataatcaaataaagcagatcacacacacacacagagacacacagacacatgcacacttttttgcatatacgcctggtaaaatttcatcttcacagttcttgaagatgcttccctaacctactagttataactgggaggtggctctgtgtcaggccaggaagaacttctccactggtttttttgttttgttttgttttgttttgagacatagtctcactctgtcgcccaggctggagtgcagtggcccaatctcggctctctgcaagctccgcctcctgggttcacgccattctcctgcctcagcctcccgagtagctgggactacaggcgcctgccacctcacccggctaattttgtttttgtattcttaatagagacggggtttcaccgtgatagccaggatggtctcgatctcccgacctcgtgatccgccctcctcggcctcccaaagtgctgggattacaggcgtgagccaccaagcctggccttccactgctttttcttggccacagagtgttccacagaatggatgtaccatcatgtacttagtagcagtccccttttgatagacatttaggttgtcaccaggatttcttacatgagcaatgctgcagtgaacctccttgtccacaagccatctcctctgtgctggggtatatcgttggatacgttcttagaggaggagccggtggggaaggtcctatgcatgcatagttttcagagctctccctcagtgccctccgttgtggttgtatcaccctcccaccagctgagtaggggagggcctgttacccccagagcccctccttgtgtattatgtatccctttttttttccccaatctgagagtggacaaatggcatcccagtgtagggttttttttttcttcctctttagtttttgagatggagtctcactatgtttcccatgctggcctcaaactcctgggctcaagcaatcctgcctcagcttcccgcatagctgggactgcaggtgtatgccaccgcacccagcctagtatagttttatttttattttattatttattttgagacacagtcttgctgtgtcacccaggctggagtgcagtgtcatgatctcggcttactgcagtctccacttcctgggttcaagcaattctcctacctcagcctcccaagcggctgggactacagaagtgcgccaccatgcctggctaattttttgtatttgtagtagagatagggtttcaccatgttggccaggctggtctcgaactcctgacctcacgtgatctgcccgccttggcctcctgaagtgctgggattataggtgtgagccaccacgccctgcccaagcatagttttaatttgtagttgggagcaagccccatccatccccagcctgtgctctctcccgaagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccaggtgggtacctggtggatgccgcacgaggcaggcgtccctgcagaaggtaaaactggagagttggggagaagggagcatctgttcactaggggaagggccttcctctgtgagctcagccagtcttcccatgcactgaggttccgaaggcacttgcccagtgtttatcataaacagcttagcctcctatggcagaacttgtggccgggtgtggtggctcacacctgtaatcccagcactttgggagaccaaggtgggggattacctgaggtcaggagctcaagaccagcctgtccgacaggcaaaaccctgtctctactaaaaatacaaaaattagctgggcgtggtggcgcgtgcctgtaatcccagctacgagggaggctgagacaggagaatcgcttgaacccaggatgtggaggttgcagtgagccaagatcacatctctgtattccggcctggatgacagagcgaaactccgtctcaaaaaaaaaaaaacaaaaaaaaagaactcgtgccccttactcctgccacctggacaagtcctcaactgctttcccatgagataaagctggtgggaacctcattcccatttcacagatgagaaatgtgagatctggagaggagccgggacttgtctgaggtcacacagccagggaggtggatgttagggtccctgcctcgggtttggagaagcatggtggacacagagctagtggatttgagaagctggggtggtcccgtattcacctctgttgctcccccaactccagagtgacagagctgggcctggcagtgaagcgtcttgagaagcagaatctggagaaggatcaggtcaacaaggacctcactgagaagcttgaggccctggtgagctgcaggtgcccctgagatggggcagggtgagatggggtaccggccagatccatggacgcaggcttagggctgggctgcctgggtcacccccagcgtcccactcacactcaggttcagccctcacaggtgtgcaggctttgtgggaagcacactcacctccatcccatttcttcctcccagcagccctgtagcataatcctcataacacagatggggaaactgaggcccaagaggggtaatgcttgtccagtctcagagccactaagcgggagagtcgggacttgaactcccatccacgctctccaggtccagatgcggcctctggcaacctagctgccccccacccccaccagtgggacactcactcccccagggtacagcctggtttggtcacccctctgtgtggggcctggcctgggttctaggtccggctctcctgcaatcgactgtgtgacctggggcaggacatagctcttctctgggcctggtctgttcagtgagggcctcgggcctgctgtggggtctaccaggtggctggcctatggacatggcttcagaggccacctggtcagtggtgggccaggtagggagggaaaggggaggtttcagataagacagaaccccaaccaccctttgtctccctaaccgcactccaggaatccctgcggctacaggagcaggcggccctggagacagaggatggagaggggctacagcagaccctaagggacctggcacaggtgtgagcccagagaggcgggaagacagcgccctgccaggcagtcccaggctcccccgccacgtctttcggtgacctgggactgaactgcaaatgggtgggggcctgggacccaggctgtagctgctcagcacccctgctagctcacccagcctctgccttggggagcccccagtctcagaggggaggcacgaccctttgggagcccacctgtgagcaaggccaaatgatgtcttcccaataaatgggaggcctcagcggcgagccgaggactgagctagtggaggaggtgaaatcaggaaggcttcttgtaagaggcagcatttggaatgaggcagcccccagcctcacctgggcgtctttgcccagctaaccccgcggttcctaactcagcagcctccttctgcctccctcccccaccctcaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggtaggaaggggcttgagcgttctgggcgcagccagaggcctgggggaggggctcgcgccctccgggtgggggcgggggcgggggcaggtccggggccagggtccgagggaggagtctgagcgccctggggtgcagccagagccctgagaaatagtttctgagggtgtcaggacccccaaggaggtggccgagagctctgcggtgaagccgagcccagaagtgggggtgcttgggcagctgggggtgggtgcttgggcagctggtggagggaggaggctgcggcagtgttagggtcctggtagagagggagacaggtccctggtcatacagagccaggaccctgggaaaaggtctagcaaggggaatcagagcttgggaactaggggcagagccagggtagggaggagtctgagagtggaaccaggatgcaagggggaggagcctaggagccctgggggtgggatcagaacccaggagacgagtgtgcctgggggtttgtctggcatccggggggctttgataggagttgtccgggaccccagggaggtgagggctcagagggtggcgagggcacataggaggggagcggaagcctggctctcaggcctaggcccctatcctgccccaggccaggtccaggccctggaccccgcctagcgtaggctagtgtgtatccctggaaccagaagagagtaggtggctctggaggcctctcaggcccccccagactctgtgaccccccacaccccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcaggtgccggggaggtctgagctggggggtactgaagaataagtcaccgtctgggcataacaccagtcaagccttatgcgtatggctctgcactaatatggtcgccactagctgcatgtgcctattaacgtttatttatttatttatttttaaaatggagtctcgccctgtcgcccaggctggagtgcagtggcgcgatctcggctcactgcaagcgccgcctcctgggttcacgccattctcctgcctcagcctcccgagtatctgggactacaggcccctgccaccatgccgggctaattttttttttttttttgagacggagtttcactgtgtggcccaggctggagtgcagtggcgcgatcttggctcattgcatcctcctcctcccgggtttaagcaattctcacctcagcctctgaagtagctgggattataggtgcccaccaccacgcccggctaattttttttgtatttttagtagagacggggtttcaccatcttggccaggctgatcttgaactcctgacctcatgttctacccgcgtccatctcccaaagtgctgggattacaggcatgagccaccgcgcccggccaacatttattttttagtattcagttttgttttgttttgttttgttttgctttgttttgagtcacactcttgctctgtttcccaggctggggcacaattggtccatcacagctcactgtaacctggaactcccagactcaagcgatcctcccacctctacctcccaactgcccctagttgggggcctgggcctggcctggggaaggatatgggaccgaagcctgagagttaggtttccactcccttcctctgtgccctcaccaccctctgagccctcacctccctgggttcctgggcaactctgatctcagcctcgaggatagtagacaagccgccaacatttctaaattttttgtagagatgggggtctcactatgttgcccatgctggtcttgaactcctagcttcaatcactcctcccacctcagcctcccaaattgctgggattacaggcataagccactgtgcctggctctattaaaatttaattaaaatttttaaaaagtgaaaattcaggctgggtgtggtggctcacacccagcttgctggccaacatggtgaaaccctgtttctactaaaaatacaaaaattaaccaggcatggtggcatgctcctgtaatcccagctattcaggaggctgaggtgggagaatcacttgaaccccggaggcagaggttgcaatgagccaggatcgtgccactgcactccaggctgggagatagagcgagactccatctcaaaaaaaaaataataataataatgctgggcccggtggctcacacctgtaatctcagcactttggaaggccaaggcgggcggatcatgaggtcaggagattgagaccatcctggctaacacagtgaaaccccgtctctactaaaaatacaaaaagtaaattagctgggcgtggtggcaggcacctatagtcccagctacttggaagactgaggcaggagaatggcctgaacccgggaggcggagctggcagcgagccgagatggcgccactgcactccagcctgagcgacagagcaagactccgtctcaaaaaaaaaaaaaaaagaaaaaattcagttctttagttgccctagccacatttcaagcactcatcaaccatacatggccatagaacatttctgtcatctcagcgagttctattgccagcactattttggactgtatttcttggagttttttttagagatggggtcttgctgtgttgcccaggatggtctcaaactcctggcctcaagtgattcccctgcctcggcctccaaaaatgctgggattagaggcataagccaccatgcctagccttgaagattttttttttctcttaatttgagacagggtcttgttatgtcacccagtctggagtgcagtggtgcgatctcatttcactgcaacctccacctcctaggcttaagtgatccttccatctcagcctcctgagtagctggaactacaggcacacaccaccacgcctgcctaatttttctgttttttgtagagatagggtttcgccatgttgcccaggctgatctctaactcctgagcccgtctcggcctcccaaagtactgggattataggtgtgagccatcacgccaggcaccctgaagatttttaagacaagaaattatccacttcttagctgccaggttgtttttgatattttgttgtttggtttttctcttcataaatgtaaccatctaatgaaaagtttgaaaaataggaataaaaagacagcgccttctcacagcctcatctgcccatcctaattcatttagggcactggttttccttcccattgtgttgcctggcagtgagatagcaaacgtttcctgcacacctactgtgtgccaggctcttggccgagtgttttgtatgtactctgtgatttagtcttcctgtcaaactcatgcaattcggaactctgttgttgtaagcttgagagactggctcagactcatacagcgtgtgtggctgggggtggcagggtgggaactggaattcaggtccatgtgagagtaaacccaagctttccatgcctggaaaggagaaggtctttttaagcagttgtgttcacagcaaacatcccattttgcattctgctatttttacttaacagcacattgtcgactgagcgaggtggctcacacctgtaatcccagtattttgggaggccaaggcgggtggatcacttgaggtcaggagtttgagaccagcctggccaacatggcgaaaccccatctctactaaaaataaaaaaaaattggccgggcacagtggctcactcctgtaatcccagcactttgggaggccgaggcaggaggaccacctgaggtcgggagttcgagaccagcctgaccaacatggagaaaccctgtctctactaaaaatacaaaattagccatccgtggtggcacatggctgtaatcccagctacttgggaggctgaggcaggagaatcgcttgaactctggaggtggaggttgcagcaagccgagatcgtgcactgcactccagcctgggcgacagagtgagatgccgtctaaaaaaaaaaaaaaattactgggcgcattggctcatgcctgtaatcccagcactttgggaggccgaggcgggcaggtcatgaggtcagaagattgagaccatcctggctaacacagtgaaacccccatctctactaaaaatacaacaaattacccggacatggtggcgggcgcctgtattcccagctacttgggaggctgaggcaggagaatggcgtgaacccgggaggcggagcttgcagtgagtggagattgcgctactgcactccagcctgggggacagagcgagactccgtctcaaaaaaaaaaaataaaacaaaatcacgctgtgaagttttttcgcacctatggccagtggggaacgtggcagctcatggcaagtctttggggtcccagttgttcccttctcctccctcccctgccgtggccaccatgtgcctgtgtagcaggaagctgtgggatctgcagactcagctctatcaggcttcccagaattgaggggcatggggtgttataggggacatttcctggtcacatggcctagcagagctggtggcacaattgccgtgtgtcccaggagcctagctcggcctcttctacctggtagggtgcttggagatcacaccagcacctccatccactccaagtgggcggactggagagaaggaaagccaggttcttctgctggagtgtgtgagtgaaatgagtcagccatggacagggtggtcagggaaggcttcctggaggcaggtgccttggaagactggaggatgtagctcatggctagaggagcagccagccaccttccctgcagagagcagccccagcatcccctctgctccccctccccttgtcctgaagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcaggtgagcagcatctcgccaccctgccaggacccttcagatgtgcctcgggtcccctgacagtgcccccctggggttaggtgacacccactgggtcctgggcctcctaccgtctggacccctccgatgtcgggttttctaaccagacccatttcaggaaactggggctcagggaggtatagtcacttacctggagtcagagaactagttaaaaggtagaacttggatgataataacaagaataattaaaataacagtagtaatattagcagtagtattttaaaaatttagttagaagaataataatatccttactaatttcactaagtgccagataccattttaagcaattcagttctctcatttaactccatgataactctgtgacatagaagcggttatctccattttgtggatggtaaactgaggcacagagaagccatgtcacttgccccaggtcacacagttagcagaagagccaggatttgaacccagacattctgccttcagagttaacctcttcaccactgcgctgcttacctctcagggacgtgatcgatgatgatgtttagtagactgtggtggagcatgttattcttgtttctgaaggtccttggggagatgtgtcaggcactattttaagcacatgtgaagtttgtatccttaaaacaggccgggcgcagtggctcacgcctgtaatcccagcactttgagaggccaaggcaggcagatcgcctgaggtcaggagttccagaccagcctgaccaacgtggagaaatcccgtctctactaaaactacaaaaattagtcaggcgtggtggtgagcacctgtaatcccagctactcgggaggctgaggcaggagaattgcttgaacctgggaggcagaggttgcagtcagccaggatcgcaccactgtactccagcctgtgtgacagagcaagactgtgtctcaaaaaaacaaacaatgtcacgaggtaagtgttacctcattttgcagatgtgaaaacggaggcccagggtcatggagctaagcggtagtgggcttggttgccctgtggctcaggctgtttctctccaaactcctgcctcaggcctggtccccagcccagcatctcgctggctacaggaggttcggggcaggaaagtgacatgggccacccacccaccctttgtcccacagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggtgggtccctgtctgctgcacaaccacaaacctacctctgacccccagccccaagccttgtcactctggcacagactggtcccagtgtcaggcagacctctgagcctggtcacagactgaccccttccttctggatacaggctgatctttgtcacaggccacagacctctggacctctggtcccagccataagtggactgacctctctttatggccgtatccctgctcttctggatgctcctgggggcaatgcctatagctcagggtcatccagtgcctgagactcagctcctggggtctgagagttgtggccacagcgcagagggtccttggcaggggggcctgcgctgtccgctgcagcctgggctctgagcagtgctatccctagaccctactcaggggatcctctgaactctggccctgccctgcagcttgagctatttttgcacagctctgtggtgtgtggcttttaaatggctcataagcagcaggctttctgcggtgatttttttttttccatctcacactgtgtcccctccttgtctcccctaccctgtctctgagggtccatctctctgggtctcttcttgggcctcctcacctcctcccgacctttctgcctttcctcatttctcggggcctgaccctgcaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccaggtacgctgtgcacctgcgggcccacctgccttgcccacccatcctccccactcagtgaggcaccccgggcccagccctgtacctgtcttggcccctgcctccctttctgtccctggttctctgtctgtctctggttctctgtctgtctgtctatcccctctaggcgtcaaagcacagaagttccatgggccctcctcatctccccctccccagtgtcccatacacccaagggcactgtccctcattccctgggagcctcccctgggctattgttgctggtgggtgggtggaggaggcgtcctggtcctgggagggacgccctgctcacgaggccccactcctacctggcctccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcaggtgggcaaagctgtgtgtgggggtggtgtggagagcatgtggggcaggccgggctcccagccccctgcatccagtcctgggttaagtcacaggcactggagcctgcttctgggttaaatccagccccacttctgctagctggggaccttggacaagctgcccaatctcccatacctcagttgccccatctataacatggggccagccaggcgcagtggctcacgcctataatcccagcactttgggaggccgaggcgggtggatcacctgaggtccggagatcaagaccatcctggctaacacggtgaaaccctatctctacaaaaaattagctgggcgtggtggcacgcgcctgtagtcccagctacttgggaggctgaggcaggagaatcgcttgaacccaggaggcagaggttgcagtgagccaagatcatgccactgcactccagcctgggcaacagagcaagactccgtctcaataataataataataataataataataataatgatacagattaataataggtggagactttttagaattggaatcttagacttttgggaacatcacatctggaagagaccttaatgtttcagggatccagggaccttcatgcaaggtctatcctggagcgcctaggtttctgggaggggcctctagaggatggggtagggggtgcaggaagcagggtgcaggtctccaccttgaggcctgccgagcagctgcacttgggtctggtttatatattcagcttctctgcaagtttagagtaatacaagggttctgttactcccagagctgagtgagggccctcattttttttgtttcattttgttttgtttttgttgttgtttttttttccagacagagtcttgctctgttgcccaggctggaatgcagtggcacgatctgggctcactgcaacctccgcctccagggtttaagctgttcgcctgcctcagcgtcccaagtagcagggactacaggcgtgcaccaccacgcccggctaatttttgtatttttagtagagacagggtttcaccccgttggccaggctggtcttgaactcctgacctcaagtgatccacctgccaaagtgctgggattataggcacgcaccaccgtacctggctgggccctggtttttgtacacacgtgcattgcagatctagagaaggtcatgacttgcccaagtacatgtagcacatcagggcagaccctgggctcaaacccaggccttctgccaggactgggttaggcccagagttggggtgctgcacgatgaacaagctgggggacgctgggagtgctactcagtctctgggtgggggccagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcggtaaggccttgggctctgcccaacccgccctggggggtcctcctggggccacaccatgaccagccacacgcaggcacgggcccccaggggcagttactaaggagtctggcttgccgactcgtcctagctgtggctcaggcttccccagggagtgtgggcctggccaggcaggtagattggcacttggcccatgcctggccactccctgagatccacagtttcctggggccagggaggctgagtcccagggcctcagggactgtatgtgctgcagcttggagaaggaagccctggagggcagcctgtttgaggtgcaacggcagctggcccagcttgaggcccgccgggagcagctggaagccgaggggcaggccctgctgctggccaaggagaccctgactggtacgaggggctggggacttggggggaacaccaggttccagcccagactgcagcctcccaaggtctggggtctcacagaagttgggagcactggagtaggagtctggctggcctgggttccagtcctgtgccaccacttagatctcaccttcccttgagcaagcccctttcctctctgggctgcagattcctcagctgatgattggaggtggcaatgcccaccttctaagcctgttgccaggatgacgtgggaaaagcgtgtaaggccgtggcacggtgcctggctgagtcaacagtaactgccgttcatcggtcatcaggcctgttagtctgagttctctgtgcttttcagatgactctcttggccccagaatcccagccccacttccctgcaccgttcccatccagtctctgaactcagggcttctttctgctcacctaacattaactaagcacctacttgggtcatggaaattaattttcctgtccatgtacacctgagccagacagaaccaggaagggaaatgctggtgggtttccaacccgggagatggtttttagatggtagctataccatttccattccctgtagtcatttccattaatataaatagttaacgtttgacgggtatgttcatgtcagtcattaaaggagatgctttatgtgtagctgtgcagctgtgggaagttgctgctgatctctgagcctccatttcatcatctgttaaatggggatgaggataaactacataggcatgttatgaagacaaaatgaggttatgtctaaaatacttagctgggcgcttgacccatagtaagtgctcagtcaggaatagggttgttttttgtttgtttgttttgagacagagtttcactcttgttgcccaggcgggagtgcaatggcactatctcggctcacctcaacctctgccttctgggttcaagcgattctcctgcctcagcctcccaagtagctgggattacaggcatgcatcaccatgcctggctaattttatatttttagtagagacggggtttcgccatgttggtcaagctggtctcgaactcttgacctcaggtgatccacccgctttggcctcccaaactgctgggattacaggcatgagccatcacgcccagcctgtttgttttttgagacagagtctcactcttgttgcccaggctggagtgcaatggtgcgatctcggctcactgcaacttctgcctcctgcattcaagcgattctcctgcctcagcctcccaagtagctgggactacatatgcccgccaccatgcctggctaatttttgtatttttggtatagacagggtttcgctgtgttggccaggctggtctcaaactcctgacctaaggtgacctacctgacccagcctcccagagtgctggattacaggcatgagccactgcgcccggcctatttgtttttttgaggcagagtctcactcttgttgcccaggctggagtgcagtggtgcaatctcagctcactgcaacttctgcctcttgggttcaagcgattctcctgcctcagcctccctgaggctgggactacatacgcctgccaccacgcctggctaattgttgtatttttagtagagacagggtttcaccatgttggccaggttggtcttgaactcctgacctaaggtgatccacctgccccagcttcccaaagtgctgggattacaggcgtgagccaaggcacctgacctagggttgttatatgtttgacatccgtcccatttgggaggccttctcatcagtcattttatgcctttaatgccattctaggtaggcaggaaaggggtcagggccagtgggcccatgtagcatatagggaaactgaggcccagagagggcaagccacttcaagaggacccaaactagatgccaggcaggccctctgcctctgggattttgcccatgtggctcacctggcctaagtctgctggcccaaggaaaagtttcaacccaaccctgccctttcccccattcctctcgtgcaggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggttcaggcagctggggaggggtgggcaggactctgagccagtgtttcatcatcgttcttgctctgcctcggtctctacatctgtgaaatgggacttcctctctgttgtggaggtcctggggacagctaggaggactggggggatggggaggttgtggttcttattagacatgcagattcccaggtcccaaatctggtccagccctggtaatcctgatgcagagggtccacaaccacatttgggaaatactgacctaatgtacagcaggaaagcactttcatttgctaagaagtactgtttgcatatgaagagccactcagacctcagcatatagaaaggcaaggggccagggaagttactagaacactgactctgggtttgaattgcctgggtttgaatcgaatcttggtcgcttactggtgatgctacccaaggtgtccgtgccttcatttccccacctgtagaaatagggataggatagtgaaaggtattgaagatgagctgagaccatctgcatagagggcttagcatagtgactggtacttagcaaatgctccataagttatgattgctggcactgacatgctctccagagtggccctcgggacaggggccctcagccaccaaatcctagacagggctgcctctgacagaggtgcaggctatgactgcatggctccagggcatgccactcaccctgcagtacccctggccttgggtggttgttaccacgcttctccaggaggtggcggtaaagctcttttttttttttcttttttctttttttgagacggagtcttgctctgttgcttaggctggattgcagtggcgcaatctcggctcactgcaacctccactttctgggttcaagcgattctcctgcctctgcttcctgagtagctgggattataggcgcgccaccacgcctggctaatttttgcatttttagtagagacgggatttcaccatattggtcagggtgtctcgaacttttgacctcgtaatctgcccacctcggcctcccaaagtgctgggattacaggcatgagctacggtgaagatcttaaagaaggggcggtttggccggtcgtgctgactcatgcctgtaatccagcactttgggaggccgaggtgggcagatcaccaggtcggaagatcgagaccatcctggctaacacagtgaaaccccatctctactaaaaatcacaaaaaattagctgggcgtggtggcacgcgcctgtagtcccagatacttgggagggtaaggcagaagaatcgcttcaacctgggaggcagaggttgcagtgagccaaaatctcgccactgcactccagcctgggtgacagagcaagactccgtctaaaaaaaaaaaaaaagaagtggcagctctgtctgcttctcacagagttgctaggggcaagtgctgaggcaggcacctgccctcaggctccccaggtgggctgctatttgcctgtgggctctgcctgcccgcctgtccagtccccagggatctgaactcctgtgacctcccccttgctcttcttgccctttgcattgcctggcttggcctcattaatgtccccaaatctgtgttctctccagctcctctggcaacccctgacccccttcattcctcacagccagtcctaactcccctccatcccaaccccaatccctcttccacagctgtcggaacatcccctaagctaaaaatcagattgctccttgtcaccttggctcgagtcctctctcccactcccctcactgtccttagaatccccatggcccacacggcctgtcctggccccacccctgcctggggctctggccctgtgactcaccatgtcccgttcccctctgcaccctgcatcctctaggcctttccaggggctgtgttcttggcctggggtggtcttttctctccttacctggctgacagttacttgtccctccgcaggggaccatgttcggacccccaggccagcccactgctgctccttggcactttcacggccctggcgtgtccccgtcatagcccttatcactcccttgtatttacctggtcaccctccatctctgagggtatgggggccagatggctcttgctgccctgatgttttggggggtctgcctgggccccctcctggtgtgtcacaggcatccggtcctggccccctaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggttcgtgagccctggcatggcctctgctgctctctgagctgctccagttctggggccgggccctgctctgccacttggcagctaggagccctggggcaggccactgccctcttgggggcctcagtttccttacctgcaggaggggaggattagaagggggttcgtgaggctttgctgtgctccatgcctggcacacagtgagcacttactgagtgacagtgacagtcgtgacaccaggaaagctgttccatattctcccatgcctcgtcccaccccacgctgggcatggatcctcatggctgccttctgagcagtccccacgatgcccacaggcatcagctgacgtgtccccccaaataacaaatccctaactttcctataatgtaacggagacagggcagactgtgcccatctcctctcctcaccagctgtgtacctgggcgagtcactttacctccttgagcctcagtttcctcatctgtaagatgggtagaaagaaagactctgcagtcagggtgctgtggcgggttagtgagctctatgagtggtatccacgtccgggattcttgtgactgccgttgtgcccttttccagggctgcatgtctgccctgggtccacctgcagtggcacactcaggcctctaagcccccagtgggcacatttcctaggcagcaagaagcctgagcatgcccccaggaccagcccatcccccaagccctttgtcccctgcctctgcccaggccttgtctctgaaggagtctgagaagacggcgctgtcagagaagttgatgggtacacggcacagcctggccaccatctccctggagatggagcggcagaaacgagatgcccagagccggcaggagcaggaccgggtagggcaggctgggcagctgggcctctgtctcatagagaggcacatccctggctgaggagcccccaccacggggcggcatggccctgtcctggagaagcttccaggctgtgggaaaggaggtttagcccttcttttgggagcccccatctgagggaggtggctcagccctgccctgatgaatccttttggcgtgagggagaggctggctacacgggcagcactcactatgcatccaggggttggcagagggtccggcaggccagcgggaggggccgtgtttagagctaaaagtggacagtgcactgagcgggttgggagcagcccggggctgggggacacagcaggaccaagtctgaggagcccctctgtcccagagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggtgagcagccgcccccctcttccaagcagcataccctaaatggcactgtgtgcctgggggcctagttccccagggccc

SEQ ID NO: 320 - DNA, 73674 bp, Homo sapiens
tttatctcttctctatttccacgctatgcagacaagaccacggagagaggaaggcaaattccatcaatgggtgctgttaagccttttctatgaggtagctgcacatttggggcacttcaatactggttacttgagattctagtagacagattgtccttttcatctctagccacatggtaaaattacttgggagctttttaagactactagtggcttccacccacctggaagcatttaaatcagaatctctatgtgtagagtccaggcacttgtgttagttaaaacctcaccaggctttataatatgacagagtggtttaaagctacggagtagacccaccctatttcctacctttctctttgtttctctttcaccataggcttctttcccatgagaaagtaaagattttagtctctgttttcagagtctcaagtaaatcactctctttctcaactggacttccaaggcaaagatttctttctatttatctatctgcatttttacaaagttggcctctggattcccttttcccaaacctaattcaccacaaaggtgcccctcaagtcaaggagctgggctttcatacacctgcacctgtcaatcatggtaaatattttgcaggcagggttgctgggtgctgtgggattgacgtaaactcccaggtattgccagctctgagcctcaggcaagcttgtgactaaatgactccagtagtctgaggatagtccttactcagaagggtctttggaagcaaaagcaaacataggcatgagagggtaaaaaaaaaaaaaaaaaaaaaaaaaaaaatctcatgtcatcttggcttatacctaacagaacttgtgcaagaatggatattaaggtgggtattgtacagagcagaacttaataaataccaagtctggagtttaagggataggctgaagagattttgcaggcttgtaaacatttttgccaacttgaacacacttttgtttgggtttggtttttctcctcattggtaagagctacgcacaatagggtagctaagatattataatttgaatcgatacatttgtattttgccaaggatcaagatgaactatgatgatttccattttttagtactttattttcatcagtttgaaaattaggacttttgctccttttttggcttgtggcacctttttggttttcacactttctcaaagaccagtaacttagaatctaaattatgattgcttattctttcagtactctaggggaaagttgatttaatcttgacaaaatgtattcagttaaaataattgttctcttaaatctttctttctttctttctttcttttttctttttttggagatggagtcttgctctgtcacccaggctagtgtgcagtggcacaatcttggctcactgcaacctccgcctcctgggttcaaatgactctcctgcctcggcctcccgagtagctgggcctataggcgcatgccatcacgcccggctaatttttgtatttttagtagagatggggtttcaccatgttgttctcttaaatcttttcaccttttaagtttgtccttcctttctccaatttgcaataggggagtgtggctcgcagctaaatagtagacttctcagagctacttattcctggagcctggcagtctgcaggcctggagggggagcatctagaaagcagccctctctaagttgagaataactatgagaattgtgggttataaggctttgagcagctctggcctccccgtcctcttttgtttctactgtgggatgtgacaagagaaggaactcatctgagagagacttcatattgtggcctttcaccgattacttctggaaatttgattcaggcaagccagggagagtgtctggtattcttctctgagaagaagaattcattatacagctggacaatggaatctatgatctgcctgtagaggttagaggtgcatcctgttccgggaaataattacaatttaggcaagttatacatgtttgcttaagagaatgctttctgcacatttcatgttcttcctttctatcttagcctagggagaaaaccgtggggactcagggctggaactttagtgtgatggggcagaagcttaattttcacatgattctcaacaaatggcagcatatcccatgtattatcatgtccaatggctgcaatatgaaggaggcttttccgaaatagttgctgctttggtaaaaaattaactagatggattcaaagtcaaatttgaagaaagctgagcaggcagaagaaacaatcagtgaacctgaagataaggcaatggaaatcatccagtttgaggaacagaaataaaaaaagattgaagaaaagtgaacagagcctaagtgaccatcaagtggaccaccatgtacattgtggaagttcttttttgttgttgttgttttggggggtgggaggggggaaggagtttcatttttgctgcccagactggaatgcaatggcgctatctcagctcaccgcaacctctgcctcctggtttcaagcaattctcccacctcagcctcccaagaggctgagattgcaggcatgcaccaccatgcctggctaattttgtatttttagtagagacggcatttctccatgttggtcacgctggtctcaaactcctgacctcaggtgatcctcccgcctcggcctcccaaaatgctgggattacaggcatgagctactgctcccagccttgcattgtggaatttctaaagaagagggagagaagggcaatagagaatatttgaagaaatcatggctgaaaacttcccaaatttgatgaaagacatgaatacaaacacagtagcctaacaaactccaagtaagataaacctaaagagacctacaccaaaacgcattataatcaaactttcaaaagtcaaagagaatctttaaattggtaagagaaaagcaactggtcacatgcaagaaatctttaataagattatcaacagatttctcatcagaaactttggaagctggaaggacaggaaatcaaaagctgccaacaaccaggaggggtggctcatatctataatcccaacactttgggtggctgaggcaggcagatcacttgaggtcaggagctcaagaccagcctggccaacatgacaaaaccctgtctctattaaaaatacaaaaattagccaggcgtggtggtgggtgactgtaatcccagcgacttgagagaccaaggtgggagaatcacttgaacctgggaggcggaggttgcagtaagccaagatctcgccactgcactccagcctgggtgatagggtgagactctgtattaataaacaaacaaacaaacaaaagctgcccgtgaaagggaaaaggatcaataaatgggtattccaaaaagtcaaaagtcacacaaatatcaagccaaaataaactggtttcctgactggaaatcgaccccaggctatggcagcaaaacacagaactttaagcactgaactgcaaggtagagcagactttattgtgcatcctggaagggatccagagcaggcagtttgagcttatgaagaattttaactttgtttcgggtcaaattttgctctttaatttagttaagagaattttttttccctacacaacacacataatattgtcaagagaatttttaagggtagccatgacactattatgtgtgtttgttttaatttgatcttcctatgaactgttaaaataagagatctctaaaatcttttttttttttaattcaggtgtctaatttaagggatccatcttcaggccattggcaagtagaatttccaatggtgtaattattgcaatagcaattcaaccaaatagcccctttgtggaaagcccaggatgtcattttccaggttaacctcctgggaagggcaaagaagaagcaatcccaaagattcccctgcaagaaaaaagttcaatgcaaggagtagaccacagatgggtaaggatgatgttggcctccagtaacccagatatttatgggggcttccagtcacagacctctgaatctataataccaggtaggccctcttgggattgagctttcctaggactaaccaggcaacaagaattgagatgacaaaagcctcaaagggatgggacttcttaagacaaaccccaagagcttgacatggtcagaacaaaaagtgtgctggggttcccagccattttcagacaggccacctagtatgacctgatagttactgcctctttccagatagtggaaaccaagagaaagcgctcccacttgctcacaagtcaagctctcaaggacataaaataagatgagaaggaacctcaaccggtacccccttttatgacagaataacacatagagacaaagacaaaggaacagacaatttctgggaacaaagggattaaacaataggaattggtaccacaaagtaccaaaaagcacaccagagtcactacacccaagactagtcacacaaatccttttctccaattaatcaagattttggagagggaaaagaaagaaacagtgatttttactgtccacttgatgagattccacacagagaaggaggccaggagcctggctggtaaaaaaattcttacccttatgacagctgatcagatcctgggttcttcactgcagcttccagaagagcagagctttcctatcctgcttacagctccaaaactgtaggggccaatggaaaccctccctcttaaccctctgaagtttcactcaaaaatcaagtcgcaaaaggcagattaattggaaaaaaggcataaaatgtactaacatgtgcatggggagagtcacagagtgattaccctcccctacccacaatgggatgcagaagcttatataccatcttgaggtaacagaatgaatgagggctcaaagcatggccaaaaccaggtgcaatcagagtcagaggtatatccaattattgtggacaagataagtgatggtagggagagaagaggaggcttggctagcaaaggtggtcttaatatgtaaatgaaaccctacagttagcagctctcagagagaataaaccctaaaaatttctttcagacctttacatgtgtcagactctcagttaatctttcctagatctgggcaaggaaagacttggctgtatcaatgcagattccctacagatgcaaatctccccaacaaaagacaactttgcagggctacttctgcagctggctttctgaacagacatctcaaaatatgtcaaagaaatgtagtttggggtcaaatatttttaattccttcacatctacagcctgatgcatcggccgtttcaatgcaacattgttggtggcaactccattcttccctatactcaagccaaaaaaccaggttctccttgaggctagtctttttctcacagcacacatccaatttgtcagaaaacttatgtttcctgtttggttaattacagattttgatctgcccaatctttctctttcttggtctctgaattttggcaaaggagtctcctgatacaggcaggatagattctactgacgattctcaaaaccgtcagacacttaagagccttaatctcggggtaggggtttgggccgccctcgaaccttttctttgggcctccccatcaaaatcagtctggccaggcctgtcttcaaggcccaggggcagggccaggtcctcccgatgcttcttgaagcttctcctgccgggtcagcagccaccctccccttccctctgacctgcagagaagcttcagggggcatttattcaatttgctaggagctcacggatgcaggtgcgcggtgactctgtggttcccaccgcacccaccgccctccttggtcctctcactgtctgaagcgggcagtaatgttcagggtgagcttgggctccgaagacacccagtcaaggagggaccagtagggaagggcactggccccttaggtccttcccagctagggatccgaaaaagttcttgaagaaatagaaagggagagttggaagtagatcaaagggaaagaaagaaaatcctagatttcctatctgaaggcaccatgaagagaaagtccgcctcctctgggccgcgtcctcacgtcgctggtgaaccaagttctgttctccattggagaccaaatcagttgactttggcttgactcctagtgaaggagccccgctttgtcctcccctgtttagctcttgatcctgaagcacttgattgtctctcccgggcttttgatggatttcagggatgcaactgagaaatttgtttttaatgcacttaattgaagtaagaatattttaaagtattttggcaaagaaaaacgtttccttttgcaatgaagacattcagatgtaaggaaaatcactaggctctcacaaacacaaattccatgtcagcaagtagatttgaccctcaggttgggcacactttaagtgtactgttggaacttaagatgaatctaggacattcatgattaatatttttagttttttagtacaatttaatattttaaatttaaatacacattctgaaaattgtataaccagcacaagaaaccggctttacgccatatttacaaacataggaaagaaagatgatattttaaatgacaatgcttcataaatggcaacatttttaaagtacctagagaaaaaaagttaatctagaattctatgcaaaaataaaatttcataactgtgagtgaaataaggacattgaaaaaatacaaaagctaaaagaattcaccaacccatgctgcaagaaatcttaagagtcctccaggcagaagcaaaaggataccagataaaaatgcgggcctacacaaagaaacgaatattggaaatggcatttagaaaacatgtactacacgttttcttataatttaaatctttcaaaaaatatttgacgtaataaataaaagtaataatgaatcacaaagcttatagtgcataaagtaaaactacataacactaggataaaggccagaaagggaggcataatgacactagaaagcagactatgataaattaaagatgtatcccggaaaccctaaagcagcctcttaaataagaaaagggttatagctaataaagcaacaaaggaaagaaaacggaatgaaataaaagctatgtaaacactatgctggaacaactactctccaggcctccaccctatagaaatacaccagtggccaatgagagtgtacaagaatgatgactgcagcattacttgtaatcataaaatgataaaaccaacgtaagtttaaagatatatgaaaagggttttatttatttaacagacagacaatggaacaagcaaacaatgggagcaagtcctttgccaaaaggaacacagagggtcatgatgatgctactcctccaaggatttcagagttcccagacgcctagttttctgtctagttcttctggaagatgttattcttggggagcaataggtcctcgagtttggggctctttcaggttctctctccatttccccattctgctacaataaacaaacaaaaacaattctcacttccagaagatcccgcctgtgcctctgcatgcgcctttcaggaggtctggatgtctggtccaccgctcccgggcttctttcccagcttttgcttttccctttacctgctctcgccctacggccccagggccggaccacggcccagctgagccccgcggctccaccgcgcagaaggtgcgccggaggccctgccagtttcccgccctgcagggtactgagaaatcaacgatttgtaaaaagaacttccccatggaaaaaaatctgttgatttccgctctcagggctcttcaaaggactaaaagctaaaggcgacaatgaattcattcgacaagtcctagtcgtgagccctggtgagtgccagaccctgctccccccgaggggacccacgagcgaccctcaccaccatccctgccctggtggagcccccgtgcggaacacaggatccgaagatggcagcggaagctcctccgcggccccgagagcgactgggcagggtgggcacaggctcttcaatgggtgaaggcggcgcaaagaacgggaagaaccatcccaggagcccacagggcgttcagcttcccttggggccccaggcggctcgggctgggtcgccgacccgggagttcctggaagcttctgaagcaggcgaggggcagggcgggcgaaggcaattccgctgttctggctccagaatctcctaacgcgcaggcgtccaacgtgaccggcgcgactcaccgctctaatctctctggttttccaaggccttgctcggtggtcctgccgggcgggctctgggagtagagggaagggagttagttcagtgagtgggcccttcccatatcaccagtagaagcggaagcgcttgtctctgtggcgcaatcggttagcgcgttcggctgttaaccgaaagattggtggttcgagcccacccagggacgcttattggaacttttgaagcattcatgcattgtcaatcactaggtaaatggggaagattttatcttcccgaagtcccaagccactcatttatgactgatccatgtcaagggccgcccacctccccgaccagattcttaaccggctatctcctgaaatgccgggtttacacctgtgtaacttaggaatcctgaaacagagacctaggaacccacttctggtgtgataaaattctaattcagtcccttatacgcttaaacaagtaattcacgtgcctccattttttcatattttagtaataggagtccagtattacctccaggatgtgcctgggtttcctgattgctctatcaataatgtgaccagtggaatctttcatcatgatagtgatcctctccatcatttttgaaaacagtatttttcctcagtctgtgcatgatttatttaacccttttcaaaatgtttttgttagccaggcatggtggcacacacctgtaatcccagctactcaggaggctgaggcaggagaatcgtttgaacttgggaggtggaggctgcagtgagctgagattgcaccactacactccagcctgggtatcagagtgagactcccatctcaaaaaaaaaaaaatgtttttgagatgatgttggtttcatggttttaggattacaaagaatgctgcagtcaccattcttgtacagatatctttggtcattgtggaaatgtctacactgcagacatttctatagtgtagagagctggatgcgccattgctacattatagtgcttatataatgcttctaatttgagtccattctgcaaatgtgtctttcacgggagcagtaccaaataatattccaatatgaatatttataaaatgaaaatgtgcagatgtgcagttgagctgcatgcctctccatggggcccatgttcataaaatggtggcgttagcaatcatctgagagtggagtttgtggccctctgacgtcaaaatctgaggcaatggacatgaaaaccctcactgtacatcctccgtagtctggccagaatcattcctgggtcggtggtctcttatcaggagggaatgctgcttgctttttttgtcaaaaccacaaaagggagggaaagcatcaggctgttggttgataacagtagtgaagcaagtctctccaaaggcttggtttgttaacccttaggaaaaaaatcctaattcttgccagatggtgccatgcatttccaggctcttggtgtcccaaacaaagaactgtacatgacacacacaaagcagcaaagcaaagcaaaagtttattaagcatagtaacactctcagagtggggagagtggactgacctctgggatgtaagataagtattagtttggtgtactttgggtcgttttatgtgtgtttttttttcttctcttcacaaggatgcctaatcgttagccagtgtttgccttttgattgataggtgggttgcttagttactttggcccttgtgtgcttgcacattggctccatcccataattttaagtacatgcatgatgtgcagtccatatgcatgagttttaatgagctgattatcatacggagtcatgttaaggatactttttttctctcatgcacatgcctatctctgaggagctgcccctttactggtttggatctcgctggccatggggtccttgcttgcttttcttttttttttttttttttttttttgagacagagtctcgctctgttgcacagtctggagtgcagtgatgcaatctcggctcactgcaacctccgcctcccgggttcaagcgatgcacctgtctcagcctcccaagtagctgggagtacaggagtgcaccaccacgcccagctaattttttgtatttttagtagagatggggtttcaccatgttggccaggctggtctgaaactcctgacctcaggtgatctgcctgccttggcctcccaaagtgctgggattacaggcatgagccaccgtgcccggccttgcttgcttttttaaatcttactttttgttttggctgctcaacttctgccttttatcttgcttcttgctctcccaccccatcaccttgcttctgtttctgcttttactcgttctgccttttatccaacttccaattccctctgctgttctcctgcctcataatggcagttagtgagcgggggttttgaggtggcatgtccaacctcctagcctgccacatccagaaactgctttcaaggtttctctgtggtcctgtcagccaagagggagtccgcagttgactgtagggactagggcttattttcatttctcaatcctgacaaggtaaggctggattaacgcagattctctgcaggtgtaaatttcccctacagaagacagttttgcagagttccttctgtttgctggttctctgacagccatcttaaaatatgccaaagaaatacattctggggtaaaatattttgattctcttcatctatctacagcttcaccatgctggcagcctccaatccaagcatacctgaaaccttcttttttttttttttttttttttggtttgagacagagtctcgctctgtcacccaggctggagtgcagtggcattatctcggctcactgcaagcttcgcctcccaggttcacgccattctcctgcctcagcctctggagtagctggtactacaggtgcctgccaccgcaccagactaattgtttgtatattttttagtagagatggggtttcaccatgttagttagggtggtcttgatctcctgacctcgtgaccacccacctgggcctcccaaagtgagccaccacgcccggcccctgaaacctttctttttaaaaagctttcccacctttatgactgccttcaagtctctgccaaaacacaagtaacagtgactgactccctgctataccaagctcacagtaaatagcctttgctgtttttcatttggttggtctttgtttatttgcagaagcttcaatgtagagttgacaaggactccaatctttgaccaaaccttagtagtttcctctgagcccttttctctgttacttcttggcctgccaagtccagctttaggaaagaatcctgttgagtctagtttagcaagagtcctcgcaaccacctttgatagctaatcaagttcctcttagtaattttccatccactgactttcttatcttgccaattggctataatcctcaactcctcctgctgtatttgaggttgagcccagttctctgggctcaacctcaaatacacgtgtccagtgcagcccctcagaaactacctttgcaaaattatgacaatcagagaaagctgacatggctgactccatcttggttctagcctcacaggcttgctgtctttgctcattcctgtgcaatttctcccaagctatctttgggaaaaattgagtttatagtttaaatcagggctccccaatccccagggccataagacaggtactggtccatggcctgttaggaacccagctgaacagcaggaggtgagctgcaggctttcgagcattaccgcctgagctctgcctcttgtcagatcagcatgagcattagctgctcatcggagctcggaccctattgggaactgctcatgtgagtgatccagattgcgcactccttatgagactgtaactgatgccactgatgcctgatgacctgaggtggaacagtttcatctggaaaccatccaccacccccttccatggaaaaattgtcttccatgaaaccagtccctggtgacaaaaaggttggggacagccaaaaatctggtttaaatgataaccttccccaaaactaaattacccctgtaaaatgaatgaaaggccaccaagttagaaggatgaaagcggcctgatttctagtaagatgtatgcctccttaaataattaccagccattattccagaagtcacaagattggcagcttccccagttactgctgtgaagaacatcactattgtagaacctaagattggcctcttgagatgtcttttcaggctttggcatttctgactgctggatggcaccatttggcccgaaaatcaaccagtcccttagcccccacccagaagctgactccatgcaggagggccattttccatgcccctgtgatttcatccccaacgatcagcaccacgcaagccctagccccctccccaccaaactatctttgaaaaaccccttacctccaagccttcagtgagattgctttgagtaataactcttgtctcccacatgtcgtggctggcctgtgtcagtgaaactctttcctgcagtgccatggtctccatgaattgattttgtgtgtacattgggcaggaagaacccatcaggtagttacatctgcaggatggtgccagttctttccacaaaggctggtcagatacccagaaaacatttctccactactacctggacaatgtgtctccctgtcaatctccagggaatggggcctggatcaagtatttagtattcagcagttactacactgtcacctaatccctcattttcaatatcttgccatgccttccagtggcctaactggccaccatgccacagaatctttatggtctccaaggagaactctctacttgatgttttgtgatttgagcaatggaatagaatctgatactggtgggctgggggaggtacccggacactggtgggatctcgaccccagccgtggtgtccaggctcttgacaccatcgcgagaacaaagtcaaagatgagtcagcagatagtgaaagaagagatttattgcaaagcaaaaagtacacactcaagaaaggggagttcaggcatacccaagagagaacaatggattctggggtttcatcttgatgggtttctttaaccaaggagtggaatgttcatgaaaattcctgggtaaaggtggagatttctcggaactgtggtgccatccatttttacatcaaatattggtctcagaactgtcatggcactggcgggtgtgtgatttagtatgttaatgagcatataatgagggcctaggtaaaacctccgtcaaatccagcaccacattgggtccactcagccttagccagcttggtccacaccctggtttttcagcgtcttaacagcccacagcctcaagtcatgtaaatctgctgcctagaatttgttatcctgtgaccaccctgtagtattcctgtctgaaatctacttgtaaatattcaaatggtctttcacttgggcattccaactttgcttacttcacagtgtttcctgcgtaatatataagaaaagatgatccagacattgttaaacatctcaaataagatgtagcccaggtatttgtgtcaaatttggattattttgatttcgtctttgcagaatataaaaaactaacatgaggtaagcactaaggtgtggagatggctgtgcaagagatgacaaagtccagcaccacgcttgagagtgtccaatcatctcttctggggcagcatagttttctacaatactgattttggaaaaaaaatcaaaaaaaaaaaacctacaagattcatgaaactggacaactgtctttataacattaccagtgataaaaccagtaaggaaggctggtttgcagtcatctgagcagcctctttactttcataaacatggtttctctcggcttccaattgcaagtggaatgctgcatcacagggataaagatgtgaagagaaccggtttcttctgtaatccgaaacattctagtctgcgaattaaaagccattatttgaagaaggatgccccggctccatctggccaccgaaaggttgctccttaacacaggctaaggaccagcttttttgggagagaacagacgcaggggcgggagggaaaaagggagaggcagacgtcacttcctcttggcggctctggcagcagattggtcagttgagtggcagaaaagcagacggggactgggcaaggcactgtcggtgacatcacggacagggcgacttctatgtagatgaggcagcgcagaggctgctgcttcgccacttgctgcttcgccacgaaggagttcccctgccctgggagcgggttcaggaccgcggatcggaagagagaatcccagctgtgtgtcagggctggaaagggctcgggagtgcgcggggcaagtgaccgtgtgtgtaaagagtgaggcgtatgaggctgtgtcggggcagagcccgaagatctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttctaaaagtagactgtacgctaagggtcatatctttttttgttttggtttgtgtcttggttggcgtcttaaatgttaatcctacagtggagggctggcgaataggaagtaacatgtcgcctgcacgccataggagaaaaagcgagcatcagccgtatcggctttgtaacacaaattagctatcgtgaagtccgctcagctcttccctttctaccctggctgctttttgcagggattggtccgtggtctccagtctcttgggttctcaccctgtgtgaaaatcttcctgtttttccctaccccccaagtcacctcttacacagcctctgcttccaagcgcagcccccacaggagtttgtaggatttctgtgctagcggggagtgtgttctcacctcatagagccaggtagaaactacgcagatgggtgctgttctccaggaagaaagcagggcctttggggctctcagtgtccccgttgggttgtagacataacacgcttactttgcgtaggggaacggctctgccggcccccaggtgccctcgcgcatattcatggaggcccgtaggtcagaaccgcagtctcacctgtcttggcggaaatgccctgcgatcctcccggagatagaaggcgggaagttttatgaggagccaggtacagtttccctactatctccggcagttcatatatctagtgtttcttcagactttatttaagcgacagcttcttgtttgatgtctcgctcccacatcctacatccattgccaggcaactttctagatagcacccagacccatccttcccacccccaagcagccgtttcctatttctggtgccagtgtcctccccagtccctctttcttcaggccctcgcttatcaccttcatggacagaaaatacttagctctctctcaacctgcggtttatacctgacacgcgtcagtaccctgacaaattccttaataccctttctcaaatggcactgaaaatgcatttctttttaactcccagaagtatctaattggttttgtccctgaactacatgaatactagtattccactacagaggaaaaccccaggcctagcgatggcggttctgggcattgtgccagcctctcccagggtatgttttctgacatcacctacttttgatcaactgaggtcaggagttcgagaccaccctgaccaacatggcgaaactccgtctctactaaaaataaaaataaaaataaattgccgggcatggtggtgtgggtctgtaatcccaactactcgggaggctgaggcaggagaatcgcttgaacccggcaggcggaggttacagtgagccgagatcgtgccattgcaccccagcctgggcaatagagtgagactctgtctcaaaaaaaaaaaaaaaaaaattagtccatctgagacattgttgttggagacagtagaatcctgcatccaacaggcacttggtgcagatctgaacccattgagctattggctcatgttccctatgttctattaagtatcatgagcagaaattgagctctttggcttttacccactgagtatggctataggacaggtctctctctctctctctctctctctctctctctctttctcattatttgcatcattattttttgccatcagtgtgggtttttggttttgaggctatgaagtgaatttctggggacaatctctgttgggtcgtgttgacaaggatccagtccctgtttggtgatacatgacagctaatctggtctgtgagtcttctttattgtctatttattgtcctgagaataatggtatttcctgaaatttgagactgcagcaatgataagttgttcagatcttgtctttccaatgtttggtaaaaattttataggcccaattgttgtcaatatctgcaagagtggcatctctattacaagagtgatcttactactcaatgtcccccctcccacccaacttcatttcctaggggctcttggctttaacgaatttactgtatctaaaagacatcttagtacaggaagaaaactaaatctgtagcatgtaaggagcagttttctttgattggtatattcaggtttctaaccagctgaaaaattcaaatacatgtcctttaaggattaagtttaaactacactacagaaagaagagaaaagatttatatgatcacatataagcaatggaatcagcaatatgagcacttttcacaactatataaatcaaatttagtaatctccagaacattaaggaagttcagcccttaatgaaaatgaatgaaaagaaattattcacccactgttacatgccctggaaagagaatgccctgcaggactcaaaagggtaccacaatattactcagattttcagcaatgaaggccctccaaggatctaatgatactcatattttcagtttatttccttcactgataaacattgttaatagataccattgcctctgttttcactttaagtgatgttacttagcacaattcatttctttagaatgccccctagtttagtgaaaggaattttcctgctttataaatataggatattttctcatgaaacaagttggcgtactctttcagtgaagggactagaccgattaggtctctaaaatgttaaaggagtcactgcctccattatcttaggaacaataataatcacttatataaaattaaaataagaaaattaagccaggaatggtggctcatatctacaatcccagcacttaaagagttggagaccagcctgggcaacatagtgaaactcctgtctctacaaatttttaagtattagctaattttttaaagttggcagggcatgataatgcatgactgtaatctcagctactagggagactgaggcaggctccagtgaactatgattgtgccactgccctccagcctgggtgacagagtgagactcccaactcaaaaaaaaaaaaagaaaagaaaatatagaatttgttgaaaattgttttactacaatgctaggctgcatgtcttgcacctgtactcccagcaactcaacaggctgaggcggaaggattgctttaggccagcggttggagaccagcctggggaacagggcaagacctcatctctaaaaaaacacaaggcaagctgagccaggaggattgcctgagcccagaagttccaagttggtcagctatgattgccctgctgcactctagcctggataacacagcaagaccctgtgtcttattttttattttatttttactacttatgcttatttatttatttatttttgagacagagtcttgctctgtagcccaggctagagtgcagtggtgccatctcagctcactgcaagctctgccttccaggttgaagctatttccctgcctcagcctccagagtagctgggattacaggcacacgccaccacatccagctaatttttatgtttttagtagagacagggtttcatcatgtttcccaggctagtctcaaactcctgacctcaagtgatgcacctgtctcggactccgaaagtgctgggattacaggtgtgagccacctcgcccaggctccttatgcttgaaatgtgaggtttcattagggaaaaattttcttgttgaatttctaacatgaaaaaataatagatttagctgtagattaaattaatggtcttgatagtttggtacaataaaataaatgaaatgaagttgatagcagagaggaatttttgatgcttttggacaatttaaataatgtaatatttaatatataaagacatgaaaaagttcattacattattatatttatttatttatttatttatttatttattttgagacatagtctcactctgttgcctaagctagagtgcagtggtacaatctcggctcactgcaacctctgcctcccgggttcaagcaattctcctgcctcagcctcgtgagtagctggaattacagacgtgcgccaccccacccagctaatttttgtatttttagtagacacagggtttcaccatgttggtcaggctggtctcgaactcctgacctcatgattcacctgctacggcttcccaaagtgctggggttacaggcgtgagccgctgcatctggtctattatgttattttttaaaagtcagtgtgactcttttgacaaattagaatggtttaataatcttggttaggctgggcatggtggctcacacctgtaatcccagcactttgggagcctgaggtcaggagttcgagaccagcctggcaaacaaggtgaaaccctgtctctactaaaaatacaaaaattagccgggtatggtggggggctcctgtaatcccagctactcagaaggctgagtcaggagaattgcttgaacccgggaggcagaggtttcactgagccaagatcgcgacattgcactccagcctgggggggcaacaaagtgagattcggtctcaaaaaataaataaataaataaaaataaagtataaaaaattaaaattatgtgttcaagtaaattaaatatatggcaatgaaaaggaggcccagcatgactgactgcattttgctcctaacccttcctaccctgtggtgatgtctttcaggctaactgctttttcttctttctgcacataggccaagctatctatgggagggatttagcttacagtttaactttaaagcacagatgataataatcctttccccaaactaactcctgagaagataggcaggttgttgaagatttataagagcagtgtgacctgacaaaggacaaagaattttcaccatccccttgggctctcactgcagcccatatgtctgtcattgtcagacctcttcacctcaaccgcctccttcttcctcccttccctaacgtacaaggaacctgaaaatcatattaatttaagatggttctttaggatgttagttcaccatctgttcagtttggtggctctctggaataaagtcaccttccctgcccctacaccttatccctggacttattggccgtcatgcagcaagcggtgagtgcagtaagccgagatcacaccactgcactccagtctgggtgacatagtgagaccttgtctcaaaaaaataaaaataaaaacagagaaatttggttttagaaccagacaaattaaatgggagattacttccagtgagacctagaaatttctaaatttctaaaatttctaaaaaaactgagaaaattgcctccattgaggaagtaagctgaaggaggtaaactgtcatgttttctgaattgagaaatattgaggaggctttgtctctttcacctccagctgctccttctcctcctgcccctgcacctgcatagtctttcttacctgagccttcctgtcctgccttgcttcttcttccatcaccaccacctggggaaagtccccagggctctggccacttccccaaaacttctgttctgacagcccctttaaaggtaaaacccaaacccacaggaagaggggagcctaccattgtgtataccacttcaccaaaacgtgaattaagaatattataaaggacttccctgatctaaacttaaatacatttcactcttctgtttctaaagcaggctccgagattctataggctctggcagaaaatttgacttaactgttgaaacctttgagcccaaatattctgacctttatcaatcaattcacatgctggtgaagaaggcaaggccactaactggttgcaaaggcaaattggaaggattttcaaaaagggactgaagcagaacatgaaaggttcacattttcaccaaatatctccatgttgccactccccaggtccttcctaaaaatatagattggaggataattcagcattgtactaaaaagccagacaaatctgtctttgcttaattaaaatggtttgagagccaggtgtggtagctcatgtctttaatcccagcactataggaggccaaggcgggcggatcactcgaggtcaggagttcgagaccagcctgccaacatggtgaaaccctgtctctactaaaaatacaaaaatcagccaggtggctactcaggaggctgaaggaaaagaatcgcttgaacccaggaggcagaggttgcagtgagctaagatcctgccagtgcaatacagcctgggtgacagagaaagactgtctcaaaaataaaaattaaaaaaaaaaagaaaaaatcagcagcgtagtagaagtataatgcacacaagaatgataatcatgaagacaatctgattctagaagagtaagggaacctattccattagagagccaactgaaaacatcaaatcccagttcacaccccagggtgtgggggcacgtgcctgtagtcccagctactcgggaggattagtaaggaggtttgcttgaatatgtgaggtcaaagcagaagtaaaccctgatcatgccactgcactccagcctgggtgacagtgagaccttgtctcaaaaacaaacaaacaaaaaacccacaaaaccaaacaacaacaaattgtcacctcactctgaaatgacagtggcaaacatcactttgctattggaaaattaaaagaaaaacactccctcttgctatcaacctgccctcttgctctaacatgtctgacccatggtttaaaatgcccaaaagctgatgtactcaaattataatacacttacctgttctgcaccagcatttatttttgtctggaggagatcaccatccatggtcctgtaaatgtctaacggcatggaatgatgaagggcagtgtcttttaggatatttggttatatctatatatatggctctgaagaaacccaacattgggcgagttccctcaaacttttcactaggcatgaccactgctctattttagatagagattctgtggggcaaaacctgagaattatctgcctggctatcaagaagatagctccttgcatttttttggggagaacacttgcttcaagggagtgtttcctcccaggattacaaatctttttgtaacctcaggaaacattgctgatgaaaaccaggcatggtggctctggcctgtaatcccagtgactcaggggctgagacaggagaatcacttaagccaaagagtttgaggctgcagtgagctatgatggcgccactgcactccagcctgagccacagagccagacactgtctctgaaagaaaaagaaaaagaaagaaaaacattgctgatgaaactgcggcctcttttgcagctctataaaaaggtatttagtcactggctaaggttgtactagataatcacatcactttaggtgatacatttagctgagcagggagatgtgtggtggcaaataccttttgttgcatatacatatacatttcccatgtagtagaaccttctctagaaaaaatcagaaaagaagccacttggctgcaagaaatcactaaagaagaaatggggtttgatgttttccctgatgttttcagttggctgaaacatcaaatcccagttccctggttcccttactgttccaggatacagattctctttgtgatgatcattcttgtatgcattatatttctactactcaaattattaatgttatgtatttctcattgttttacttcttttgagaaactaaattcatggtactctgaaaactagagatgattcaacaagtgacagcaactatagaattggccgagatatctctctctctctctctctctctttttttttttttttttccatgttgtgatgccacaccagttcagcttttggacgctgttaaaaagagaggtctccttccctcccctgacccccgtgtgggacaggactatctgggaatgagccattctggcaaggagggacacagcttttgatcgacaatgctttcaagaaatactttttttttttttaaacggagtctcgctctgtcgcccaggctggagtgcagtgggcgatctcagctcactgcaagctccgcctcccgggttcacgccattctcctgcctcagcctctgcgagtagctgagactacaggcgcccgccaccacgccaggctaattttttttttttatttttagtagagacggggtttcaccgtggtctcgatctcctgacctcgtgatcggcccgcctcagcctcccaaagtgctgggcttacaagcgtcagccaccgcgcccggccaagaaagacttttcatctaaagggagaatggggaaagaagagaacttttttattttcaaattctcaggcccagcgaggcattacattgagacagcaaccacattctgcttcctttttgtacactactgtatttgaaaaacaaaaaaacaaacctacaagactcataaaactggacaactttctttataacactactactcgtaaaaccagtaaggatggctggtttgcagttatctgagcagcttctctagtttcatagacatgatttctctctgttattaaagggctcccaattttaagtggaatgctacttcacaaagataaccaggtttgaaagggtccggtttgctttgtaatccgaaacgttccagtctgctattaaaagccattatttgaagacgggtgcacaggcttccagctgcccgccagaagggtcctccgcaggacacaggttaagtaatcacttcttcgggggagactagatgcagggtctcggcgcacctccccaaaagacaagggcgagacagaaaggagggacaggcggacgtcacttcccccgccggctgcggcaccgggttggtgggctgagtggaggagggtggggcggaagaacagaaggggactgggaaaggcactgttggtgacatcaccgatagggcgtttctatgtagatgaggcagcgcaggggctgctgcttcgccatgaaggatttcccgtgctgtaggagcaagtccgggaccgctggctggacgtgagcgtcctagctgtgcgttagggctaggagggctcagggtgattggggattggctggggtggtgctcggggcaagtgaccgtgcgtgtaaagggtgaggcgtatggagctgtggcggggcggaagttcacatgtgtggtatgtagagcacatgttatggttatcaaagtggtttactgtaaggctgagggctatgcattctatggctatgttgttgtctcttatttttccaaacgtggaaacctctgttttgtaacttgtagtaataaggtagaaattaaaaagaaaaagtattttcctgtacttgcttggctgcaaggtcaggaacagatagtttctgaaaaaccacatcgctgagaaatgagttctggagactctcttaacagtctgttatccctaggaaggataagagcaagaaacagcaaatgcttttattaccttctcttttccctttaccatttctcactattcaagttttgttaagttcttgatttcccttcagtgcagctgcaaggtcaccagctattcttgcctcgtgagacctgtcacagtttgactagctgcctttgttctgcttctgtaagccctcttgcctgccccgcgagtttggtgccatcatagtcccaccatgccattcaaactagccaaccccctttttgaagtgtgtataaaagtcaaaccctgtctttgttcggggctcagcctttggattttaatcctctgggcctgagggcactcaataaaatcctcctgttccacccattggtctctctgttctcctgattcccacaacagtagtaggggactgtgtctgcactttcccctggtctttcacggtatgaataatagccttttttttttcgcctatagtcgcaggctcggtctcagtgattttatggtgtggtcagctgtttttgtttttgtgagaccttgtttactgtcctgggacagatgtctgtagtcacttgtttccttgggaggcaaatttcagtctctgtggcagaggtctctcatgttagctgtggtggtacttggcaggcggagctcagggatctaggcttccctgctttgtagactgctcaatggtccccaaggcctactggcttttaccaccacttgaaaaccttagtgtttttccactgtccccagagtcacctcttacacagacttattttgtttgtctttttccccgagacagagtctcactctatctggtagcatcttggtttaagcgatcctcccacctcagcctctggagtagcagaggcacgagtcaccacagccagctaatttctgttcttggttttgttgtggtggtggttgttttgttttttaagagttgaagtttcaccatgttgcccaggttggtctccaactcctggactcaaataatccgccctgccttggccttctaaagtcctgggattacaggtgtgatccatcacacctggccagcccctgcttttcactatagcattcatgggagtttgcaggatttctgtgctggggggaacgtgtactcagctcatacagccaagtagaaattgtacttggaactggtgccgttgggttgtagacataacatgcttgctgtttgtatgggaagggctttgccagtgctctgtgcccctgtgcagggcatccaggcctgcaggtcagaacggcagtctcacctatgagtttgtgtaatacgcagcaattctccctggaatataagatgggtggtcttgtgaggttcctacaagtaagaagacaaatttcccttcagtttgtattgacaaaattcaaaattaataataacagcccaacctcttgaatgataaatgtcctttacattgacagaccagaactgccctgcttgcctcagctcctctgtgcaggtgcagctcacaattccccccacacaggtcatttcctccctgctttctccaaaagagggagacagcagttctgcaggaccacagggctcaaggccttccagggccaaaaatctcagaagaagttgcccgttctgcctgtacctcacgactgacctagaaatggcctttgctaggagcaaagtagggggaaatggtcgccagagctggggcctgggtactgggccaggttaccccacaggaggggaagtactcagggttagagggggccaagcaccaagacctcagcatcctcaacctccaaaaggactcagagagatgcagaaaccgagacagggttcctctttcaaggaaagagacttttgaggaagaccccagggctctgaaccaaaatccagatttttccccatctgcagcttaattccaccttagttggtgcaacttcatccttcccctatgctcaggacaaaaaacagttcttctataggctggtcattctctggccccatacatcctattggtcagaaaattatgttttttctttggttaactgcagactttggtctgcacagtctttttctttcttggtctgaaaaccacccagtagtcccatatgtagcttttttggataaacctagaaattgaccctgctggtcttaaagcttgaaacttaatatttgtttcgtctgagttccttcctcaggaaacaaccttcaggcctctcaaaaaagccatcaaagaactgaaattcatccagacaatgagatgctgggacccctcattcatcatgattgcttccttgctcctccctagttcctgttttcttacacattgttacatttcttccctgccatataaacctctggttttgttggtcagggagatggatttgagactgagttctcatctcccccactgcagcaccctattaaagcgccttccttggcaataatcatctcggtgattggctttctctgtggcaaccagcaggaatcccagatctctgaattttggcaaaggagtctcctgataaaggtgggatggattctactgaccaacatcaaaacgatcagacatttgaaagccttaatctcagggtcggggtttgggccgcccttgggccttttccttgggcctaaccattaaaatcagcctagccaggtctgtcttccaggcacaggggtagggccagatactcctgatgctttttgacgcttctcccactgggtgggcaacaaccctccccttccctgtgacctgcagagaagcttcagggggcgtttattcaatttgctaggagcctacaaagcacaggtacacggtgactctgtggttcccactgcacctgccactctccttggtcccctcactgtctctggcaggcagtaatgttctgggtgagcttgggtgctgaagacacccaggcagggagggtagggaaaggcaccagccccttaggtcctgcgcattagggatccaaaaaacatctgaagaaacagaaagggagcgttggaagtagatcaaagggaaagaaagaaatcctaggagatttcctatctgaaggcaccatgaagagaaagtccgcctcctctgggccgcgtcctcctgttgcaggtgaaccgagttccggtctccattggaaaccaaagcaggtaactttgccctgactcctagttaggaagccatgctttgtcctcccctgtttagcacttgatcctgtagcacttgattgtctctccctggctttctatggattccagagatgcaactgagaagtttgtttttaatgcacttttccttaaagtaagagtatttcaggccgggcacggtggcttacacctgtaatcccaacactttgggaggcagaggtgggcattttacttgaggtcaggagttcgagaccagcctggccaacatggcgaaactctgtctctacgaaaaatacaaaaattagccaggtatgttggcaccggcctgtagtcccagctactcgagaggctgaggcaagagaaacctgtgaacatgggaaggggaagttgcagtgaactgatatcaaaaaaaaaaaaagtatcttttggcaaaggaaatgatttctgacaggttttgcacttaagacactcaggtgtgaggaaaacatgaaaaccactatgctagggaaagcaaatgctgttgagaatgtctcataaacacaaattacatgtcagcaggtaggtttgaccctcaggttgggcacattttactttaagttcactgtcggtggaacttaagatgaatctaagacattcacgatgtatgtatgtatgtgtgtgggtgtgtatacatatacatatatgtatacatatatatacacacacacatatatatatatacacacatatatatatgtctctcatatatatatgagagacagagtcttgcaatcttgcccatattggtctccaactctgggcctcaagcgatcctcctatctccccatcccaaagtgctgggactataggcatgcaccacctcgtccagcccattttaatgtttttaatttaaatacacattcccaaaattatataacaagtacaggaagcccactttcagccagttttacaaaaacaaagtggcaacatcctaaagtactgaaagaaataaagttttcctagaattctatgtcaaagtgaaaaatctttcaagaatatgactgaaataaggacatttaaaaacatataaaaaatgaaagaattcagcaacccacactacaagaaatgcaaaaggagtcctccaggcctaaagataaggataccagacagaaatctggatctacacaaagaaatggagactactgcaaatcggtatgtacatagttaaatatatatgttcttattatttaaatcttttttaataatttatttattttaaattatttatgatttaagtctttttttaataattaaaaaaagcaataataatggattctgggatttataacatgtctgaaatcaagttacatgacaacactagcataatggccagaagaggaggtataatgccactagatggcactgataaaggtgtattcaggaaaccctgaagccctcactgaaaaggcaaaagcagggaaagaagtcggggagcggtagaccagaagaaagaaagagttatagctaataagccaacaaaggaaagaaaatggaatgatataaaaaccatgtaatcattatgctggaacaactgctcttcatgcactccagcctgggcgacagtgaaaccctgtctcaaaaaaaaagcccacccctagggctgggcatggtggctcacgcctgtagtcctaccacttggggaggccaaggcaggttgatcacctgaggtcaggagttcaagaccagcctggccaacatggtgaaaccccgtctctactaaaaatacaaaacaattagccaggcatggtggtgggtgcctgtaatcccaggtactcaggaggctgacgtaggagaattgctagaaccctaggaggggaggttgcagtgagccgaggtcatgccactgcactccagcctgggcaacagagcgagactcatctcaaaaaaaaaaatcgtacacttaaaaggtcacggaggcaagcaaaaatcacctggtggctgcaaagcagaccatcgagaggcaaaactctttatctggggaatttagaggcaattagacttccttattatttaaagcaagaatctagttccaggcttctttcccaaaaatttataactaactagaatttctggggttttttttttgttgttgtttgtttgtttgtttgagacggagtctcactctgttgcccaggctggagtgcagtggcgcaatctcggctcactgctacctccgtctcccgggttcaagcaattctctgcctcagcctcccgagtagctggaattacaggtgcccgccaccacacccggctaatttttgtatttttagtagaaacggcgtttcaccatcttggccaggctggtcctgaactcctgacctcgtgatccacccgactcgccctcccaaagtgctgggattacaggcgtgagccaccgtgcccggccagtaactagaatttctatacatctctggaatacgtgcttatcaaaacttgtgcaacccttgctgacattaaggcaccaaaatgtctacaaatgtagtattctgtgagccaccgcacccggcctacaaaatgtttttttaaaaaattattgtgttgggagtgaattattgggctggtggctcatgcctgtaatcccagcacttcaggaggccgagatgggtggatcacttgaagtcaggagttccagaccagcctggccaacatggtgaaaccccatctctactaaaaatacaaaaattagctaggcgtggtggcgggcacctgtaatcccagctacttgggaggctgaggcaagagaattgcttgaacccaggaggcagaggttgcagtgagccgagatcgtgccattgtactccagcctgggtgacaagagccaaaaaaaaaaaaaaaaaagaaagaaatcattattatttctacaatatgggcttatccctgtattactcttctgaacttttcacttaatatatcgtaaccatctctccagtcattgaatgttcttctataacatttggaatgatatcatagtatcccattatatgaataacccatggtttattatacaagtcccctactgctgaacgtttaggtctttctaactttttgctattaaagtctggcatgatagactctgcaagttagccttcagatgcccagcaaatccagttaaccagagcactgtcctctaagcctcctggtgaatgtggttttgctgatggtgggcagagtccaccccagccgagccgctggatttggcaggcacttggccttagcaacctgagggtggtaactccaatcagttacttgtttccctgttacctgagttgcagatttagagccctctgcagtgagcaggtgagcacctggcatgattcttttctggtgagtggtcctgggggtcactgggccagtcaccacctggtgacaggacagggtgaccggtgggtggcagcactggggattcaaatgaccgcagcccggtcaggctgagctgagcagagccaaggactcagcacagcaaggaacctaggctcttcacagagaagggagctggaggaccccccaaggagatgagtatgtgccaccctgcggcagggtcctgtgggctttgggagtgagagggtcaaggggagaggagctgtgtttgccaccccctgttaaaaacctcaagtgaagcagcatggtagagaggaaagagcatgggattggaagccattgaacttcctgctgtgtgtccttgggcaagtgactacatgtctctgatcctcaatctccccttctataaaatggagatgatcctagaacctgcttcacgggagtgttcagaggggactgtagacagagcgggaacatagaagaggaagtaggcggcagtgtggttcacagccagcgcaggctgcctgcagggtgcaggtactgtcaccaagggagacccaaggtgccctggagggagtggcaaggacacaggcctgagcccagccctggtgatatgaacactggagtgggcttcacagggacaggcagcatcagaactggactagtgaggtcatgagcccaccagggcctgggtagggacatagcaagtctggggactccagacagggtcacacagacctgggccatgctgggcatccagggactggctgtgcatactggcagatgtcagtcagccctcctgcagttgggccagggacacctcagggaaactgtgaccttccttccaatcttggtaacatcacccttccaccccaaatcccagggaatggcccgaatctctcctgacaaacagctctcagccctggtccaggccacagtcttgcttgcaccgggccgggtttcagagcccgaagggcacactggcagcctttagtgcagtgtttcagatgtcacagacaggttcctctttgacgaagatggaacttccactgcttccctcctaccacgcaggaaacacagaagcaaccatcagccgagggcctgctggccgttctctctgggtactgtgtttggaaaaagcacaaaatcattaacttaaacatgctttttcaaaccaaacacatccctctcttagccctggagattcagagctgcctctccctttgaaaatgaatgatctcgcccgggtgcagtggctcacgcctgtactcccagtactttgggaagctgaggcgggtggatcgcgaggtcagcagtttgagaccagcctggccaatatggtgaaaccccgtctctactgaaaatacaaaaattagccgagcgtggcggcgggcgcctgtagtccaagctactcaggaggctggggcagaggttgcgtttagccaagatcatgccactgcactccagcctgggcaatagagcaagactccctcaaaaaaaaaaaaaagcatgatttcatccaatgccttcaataacagaaggaggtccaagtccagtgagagggtggaacgaacatactgtcacagtggaaaggacacgagacaggcgcgccaccgggttgagtctcgcgaacaaactgaggccagagtgccttccccagggctgcacgtcagtcaggaaaaaaaaaagcattctctccgacaggtcaaatcaccgaagcctcgggatcgtcgctgggggctgtgacggggctggcatgaaacgtccctctgtctggctgggcgatgggtcagtgctcaggagtttcaggcctttaaggcccggccagaccgcagggggactctgcagccgggtcggggtttcgatcctgcgctgcggccttgcaactgcgaggacttgggggtcgtgcttcgttcgcctggtatcctcgttcgtgcgtgtaggaggcgcctggcttgccgggcggtgccaggcggcaagagggagggcgcacggagcgtgtccgcccagggcggcccctgtaagcgctgcagaagcgctgctcccggcgcccggccccgccccagcctccgccccactaccgcgcagcgcaggctccgcccccagttttccccgccccgtggcggggacgccccgcccggtccggcccgctcggcctcggcagcagcggctgcggcgaaggcgcgcgaaggtaggtggccgggggcgcgcgcgtgcgcgggggcgggacggacgcgctcccggcggaggaggccgcgcgcctgggggcgggctggagccacgtaccggggctgggggcgctgtgtgttccgcgactgccgcggcccggcaccggaggccaggagagcgttcccaacaggctccgcggatgccccgccgcgtcctgccgcccatcctgcccggattgtcgcgggccgggggcacgacaggagactggggcctgcagggcgcagccgtccctccgccggccggggtcccctcgctccgcgggcggccgtgggaggccctcgcgacggcctctgccccccgcagatgccctctgcagctcctgcgtgcgggccccgccctgcactgccctcctcgtgtgggatccggtttcgtcttcattgcagccctgccgagtcggaagcatctccattgtgcggatggggaaactgaggcccagagcgcatagttgggctggccacggaggcagggccgccggatgctgtgcggggatggggccctgcaccccttgcgcctctcaccatgcggcctcaggcctctgtgcccggcagcgtctctggagtgggcattttgaacgagctccctcctgattttcacacagacttaagcctgacgaccatgctggggcggatgtctgcccctctggtgaccaggtcacagctcccttgggaagacgattgactggggaatggggaccctggggaggaggacttcagggtgccatctgtctgtttacgccagaaaacagagatttctgttttctttcgctgggctcacagcaggtgcttaataaacagatcttgtggcgggagcagacgacagcgaggttcaggcaagactccaggagtcaacccctggatctcggaggctccccacccgcgcacatttccctgacttaaccctcccctccccaagtctttcagccctttccacccaagtggcccctgtgggggtcactgcctggttttcaccctgatcttctgggatgcggcagatgctggctggatatgtgttcgctggtgtccttccgtgatccccgtctgtggctgacaccatctgtggcccaacatgaccccagccagagccaaggggaatcatttctttttccatttaacatcctatgttattacttggctcttagcattcattaattcattcagcagctcttcatggagctttggccttagcccatgcactgtggaagtgacagtgagctaagccaacctggcactttgggaggctgaggtgggaggaccgcttgagcccaggagttggagactagcctgggcaacatctcatctctacaacaagtaaaaaattagccagacgtggtggcacgcacctgtggtcccagctactcaggaggctgaggtgggaggatcccttaagcccaggaggtcaacgctgcagtgagccatgattttgccactgcactccagcctggaaaacagagcaagaccttgtctcaaagaaaaaaaaaaaaaaggaggagacagacaacatacatgttggagaaaatggaacagccactggagggacctctttagctgagagtcggggtagctccctcagaaagtgatatttttgagccaaaatctggccgacaagcgggagtcagctgtgcaaaagaagggggaagtgcgtcccaggcagagaaagtggcagtgcaaaggcccagaggtgggtgcctgcctggtgtttgaggaatcaagaaggccatgagcagccaggtgtggtggctcatgcctgtaattccagcactttgggaggctaaggtgggtggatcacttgaggtcaggagtttaagaccagcctggccaatacagtgaaacctcatctctactaatacaaaaattagctgggcgtggtggtgcatgcctgtaatcccagctactcgggaggctgaggtaggagaattgcttgaacccaggaggtggaggttgcagtgagctgagattgtgcaccactgcactccagctcaggcctgggcaacagatcaagactctgcctcaaaaaaaaaggccatgagagaaggggagagaggagatgaggtgggaaaagtggagtggggccagatctggtgggccctgtgggccatggaaggactttgaacttcattttaggtgtggtaagggctagtagagggccttgggtaggggaggggtatgacctttactgtgtgaaacttgagtgggtgaggggatgagcagggaagcatagagaccctcggggagccatctcagcagtccaggcagtggcttatataatacacatcggcgtcctggggtggtgccaggtacacagcaggcgctgcaggatggaagtcattgctgttactgtttttgtttatttgagacagggtcttgctctgtcacccaggctagagtgcagtgacacaaccacggctcattgcagcctcaaccttccaggctcaagcaatcctcctgcctcagcctctcaaggaactgggactacaggaggtgcatgccaccatgccaggccaattttttttatttttttggcagagatggagtctcactgtgttgccagggctggtctcaaacgcctgggctcaggcagtcctcctaccttggcctcccaaagtgttgggatcacaggtgtgagtcagtgcacccggcttgctgttattatttaaaactctgggctgggcgcagtggctcatgcctataatcccagcactttgagaggccgaggcgggtagatcacttgaggtcaggagtttgagaccagcctggccaacatggtgaaaccctgtctctactaaaaatacaaaaataagctgggcgcggtggcgcatacctgtaatcccagctactcaggaggctgaggcaggagaattgcttgagcccaggaggcggaggttgcagtcagccgagatcgtgccattgcactccagactgggtgacagagccagactccatctcaaaaacaaaacaaaacaaaaaacaaaaaccctttggaatcaggcacacctaggtcgcggctgtgacttgagctctttgtggctgggtgcattggagccaattatttaacttcgctgagacttcacgctgtcatctgtaaagtgagtagggtggtgccaggagtgttaaagcaggtaagggacagatgtaacgttttgggcacagggcctggctcgtggttggttcaatatttttgtcataatttctagtcagcagcaggaggataacgaaggggtaagcggataagagcagctgctatgtttgaaacgagtaatctttgaggggctttttggctagttcctgccgctagccctggcaaaaggcaagtttggagggtggtagtggggagggaagggtacaaagggtgtctcctctgtatttggtcaccaaataatgtctcagcatctagaacaaggcacagggttctagcttggggactagaaagagccaataatactcatgatagtaatgataacagtagtaatagccaacacttacccgctgttgaactgcaggtagtaattaaggtaacactagctaatgtgatagtgaaaccctgaattctcagaggcttagcgcaatagaagtttatttctcattcatgaaaagccctgttgggtgtttggcaggtggctttctatgtggcgacccagggaccgagatcccttctgtcttgtggttgcggcatcccctaggaccttggagttatttccttctagctgatggaccaggaaggagagaaataattttatggaccaagcctaaagtggcacgctgtctttctgtcttaattctatggaccagaacttgaccacatggccgtatctgactgcaagggagtctgggaaatggcttttagccatattcctaagaggaatcggaaatgctttgtggtgagcacattgcagtttctgccacaccatatccaggcatatagcttagcacggagtattttatttaatgctcatgctagaaacaggcaccattattatcccattttgcagatgaggaaactgaagctcagagaagtgaagacactggtgcagggtcacacagctggtgaggggctggtgagccaagattggagtccaggtggccagatgctgaagctgttagcatccagatttctaagaggaattcagtctttttttttttttttttttttttggagaattgggtggaagcagtggacacatacacgaggttcagatatgacttcctgggacccacagaacccagcaggactctgggggagaactttggggatggagccaagggtgaatgtcacctggtgccaggggctgacatcctgtccccttcctccaacccttagggccgtggtcaggagaaggcacagaataatccagttcagtccctcaaggacatctggggccccctctgctgagctgggcatgcagggctggacatgctggtccaggggtatttttggcttcccccctgttctggtgggcaggtgtgcagcctgtagaggggattttttggaggctgcctagaggtagaagagtgggcgtccctggggtttgtagtggcagctctatctgctggccggtttagttttttgtttttgttttttttttgagacagagtctctctctgtcacccaggctggagtacagtggtgcgatctcagctcactgcaacctctgcctcccagtttcaagtgattcttgtgcctcagcctcccgagtagctgggactacaggcacccaccaccatgcccagctaatttctgtatttttagtagagacggggtttcaccacgttggccaggctggtctagaattcctgacctcaagtgatcgacctgcctcggcatcccagtgttgggattacaggcatgagccactgcacctggccagtagctggtttagttttgcccaaatctggcttgcttgccattgcaacttggcaacatttatcttttcagacctgtttcttggttttccatttgcagggcagtttccttagttgggcgtgagcggtccagcctggactgatgagcatttatacagcaccgtggcattctgggtctgacctggatacagaagtagagcctcaaagcgcaaatgcctcggccttgcccttcagtcactcattgggaggctgctggtctaagtggaatgagctttgggctcaccacttccctgaagcatgtcgccttgaataggtgagagcccaatgtctctgagcctcagttttctcatctggaaataggttgaagtaaggatttaatgagataatgtgaatatgccccctttggggcacagcatggagcagagggcacccagggacggagggctgaggcatagcagtgtagcaggacaagccgcaggcaaaactcttcagtcaccaggttaaagaaggaaggaactttattcggctgggaacttcaggagacttgtgtcttaaaagccgagctcctcgagtgagcaattcctgtccttttttagggcttacaactctaagggcaggagcccagacacgtgatgctaatgacaataggaacagtggcccccattggctaatagctcaccacctgccaggtgtggtaggtactatcagtcgcatttttttgttgtttttggtaggacagagtctcgctatgttgcccaggctggtctcaaactcctgggctcaagcgattctcccattttggcctcccaaagtgctgggattatagacctgaatcaccacactcggtctagtctcattttattttattttatttttttgagacagactcttgccctgtcacccaggctggagtgctgtggcacaatctcggctcactgcaacctcctcctcctgggttcaagtgattcccctgcctcagcctcctgagtagctaggattatatgcacatgccaccacgccccagctaattttttttatatttatttatttatttatttatatttttgagacggagtcttactgtgtcgccaggctggagtgcagtggcatgatctcgcctcactgcaacctctgcctcccaggttcaagcgattctcctgactcagcctcccaggtagctgggactacaggtgtgcaccaccatgcctagctaatttttgtatttttaatagagacggggtttcaccatgtaggccaggatggtcttaatctcttgacctcctgatccgcctgcctcagcatcccaaagtgctgggattacaggccaattcttgtatttttagtagagatggggtttcactatgttggccaggctggtctcaaactcctgacctcaagtgatctgcccgcctcagcctcccaaagtgctggaattagaggcttgagccactgcacctggcctggtttagtctccttttagagatgagaaaactgaggctcagggaggtaacctgttcaaggtcttactgtcttgaacaccatagttgcaagtgacagagctgagtctcacatgcaacctcagacctgatactgactccagagctgtgcgcctaagcactagagcacatagcctccttgccccagggaaagaacaatgggaggtggtgggtgacctctgggtctcagggccctgggatatagggactgtgccttttttttttttttttttgagacaaagttccactcttgttgcccaggctggagtgcaatggcgcgatcttggctcactgcaacctctgcctcctgagttcaatcgattctcctgcctcagcctcccaagtagctgggattacaggtgtgcaccaccacacccggctaatttttgtatttttggtagagacggggtttcaccatattggtcaggctgatcttgaactcctgacctcaggtgatccacccgctttgtcctcccaaaatgccgagattacaggcatgagtgcctgcgcctggctgggactgtaccttctggattttcaaatgaatgaaatgagtatttcttgagtgttggccacgtgaccccccagcaccatgtcatgtgctgggtatgcacacacgatactgtttcatccccggacggctccgagagatgagtaccaatattatcacatcttacgtaagaggacactgagtctcagagaggcaaagtcagtgtccctggtgcacccagctagtgggggctggggtgggtgtgaaggggccagaagcttcccaataagtgcctgaagggcaaggctagggcatttgtagttcgaggctctaccactgtgtctaggtcagacctaggaatgccgcaggtgttgcataaatgctcatcagtccaggctggaccgctcatgcccaactaagtgccaagcctggcctgggtgatctcacagcctgcattctttgccctacacctgttgtgggaaaacatactcccagcatgctgtaaatcctctcattcttagctaaccatgtgactcccgttctgggccagaaagatggtcacaaatacttaggactctggcctttcccgccgcatggctactgaccccaccccctgggcttggagggctctaggacccagcaacctgcgcagggtgaagagtgtgtgaggtcctgacctccaggtgtctcccctgtttcctcctcccattccctcttctctctcctccctccttttctctcccttctcctcccctctcttcatccttcctcttcctttggctccctgcctctgcttccctcctctcctgtcctttcccatcccctccctcctcagcccacatcctgctcctcccaccgcggtggtcacatgggggcgccgccggatttaagcttaatctgcctggtgctcagcacagcatcctggctgtggcgcgtgctgactgagctagtcttggggtcctggagaagggggctggaggcatgcccacagcctcccccccatgagcttggggctggcgagggcacaggaggtggagctgacactagagacggttatccaggtgggtcctgggggctgtgcccaccctgtctggggcggggcagcgtggacttaacaggagtggtgagaggtgtgtgcgtcttggggatcaaggggtgggagaggtgtggtggtggtggggtatacaggggccccccgcttgcagttcctggcaagatggggggcagaggtacacacagggtgcacctgctgtggctccctcatcccagtgccctgggttgggagaagggggtctctactgccagattttagggcttgggggacctctggcatagccagatcctcatccatctagggtcggaaccggattggggcccccaacactggactgcctccagtggggtttgggagttacccgtagggtttggttctcatctctggccctgggccttcttcctggggcagtgagcacacaagaggctctttgcatggggattttttggattctaactcccaggcttcactccatcttgagggggctcctggggacctgtatcttgggcagtaggattctgtggctctccccacgaggccagggagccccgggtcccatgtcccctgaagaccctctcgcttttcccacagacactggagagcagcgtcctgtgccaggagaaaggcttgggcgcgcgggacctggcccaggacgctcagatcaccagcctgcctgcccttatcagggagattgtcacccgcaacctctcccagcctgagagcccaggtgccacccccatccgctcccctccacaaacaccacccacattttacctcttctcatgtccctttcctgagcagtcaccatgatgatcatgactgtaactcactgtggggcaggcacagctttatgacagaagaacccattttacagatgaggaaacagaggctcagggatgtaatttgtccagacttattccgcatgtggtgcaactagaaggaagggccgagcatctcctgcgtgcttgcctgtagcctgctgcagagatgtgaaccccaaatcccgtattcccacccggggaaggtgtgagctggctgaacccaagatacaggaagagggcagctcagctcagaccagggttttgcggaagtctgagtggatggcgccgtccatccgtttcccacgtgggcaggaaggcggatggtccctgctcctctcagtgggtggcgcacacggtgtagttatgtggcttgaggatctgggaaaggcacactcagttgcagctggtgtgctggcgtgtggcgttttggtgctctaaccattgtctgtgttcaactcccaagctacagacgggccccctccttgggagcgccagggatgttggcgccctggagccccagacagggagagactcagagggccctcaccctgacacctggggtgtatgtccagttctcccagggtagaaggggaacccacaggaggtggacaaccccgcttctcccgctggcctttctttccctcttctctctttctccttctcctcacaacctgacctatgctatgctctcctgagccctagcctttaaagttccatgaagcccttctcttgagcgaggctttgatgcttttctgggaggatctggttactactattctaccttttttttttttttttttttttttgagacagagtctcgctgtgttgcccaggctggagtgcagtggcgcaatctcagctcactgcaacctccacctccccggttcaagtgattctgctgtctcagcctcccaagtagctgggactacaggcatacaccaccatgcccagctaatttttgtatttttagtagagacagggcttcgccgtgttggccaggctagtctcaaactcctgacctcaggtgatcctcctatctcgactcccaaagtgctgggattacaggcgtgagtccgtgcccgccccacccatattacagataagtaaatctgaggccccggagaagaagactaattggaaaaggagggagcaagaactcaggggtctcctggctcctagactgagtgtctctcctgcacctcccaaacctgctgggccacactttagctggagttgtgttcactttacgtccagctttgtatcccctccttgccttcctccctgttctcagctctgtttgcaggcctggtgctgcagccattcccatctggactcctcccaggggcctggatggttttcttgccctccctgttggggggaggatgtcccactggacccagaagccaaccatgtgcccactgtcccttgccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagagggtgggtgccgcccaggtggtggactaggccagggttcccctcgttcaagggcagggaggcatctagaccaggcccacacacggggcaaaagatgggccctggagtcaggttggcctgggcttggattgaggctctgccaccttgagtggcgttgagcaaatcactatgctctttaagcctgttttctgtagtggggattgtaatgggacgtggaattgtaggaatcaaggagataatagaataaagtgcctggcaccaggggtattttgttcccatctgtcccaggcctgttaggggtgtgggacacggagaatgagatccctaaagattcctgccccttgagtttctgggcatctcccattgccacgggccttggggttgaggcggtggctggatgctggctcgaggctggtgtgggcacccgcggtgttctgcagcccatctggggcagccacaagacctgccgccactgcctattggaatgagttccaggcagggaaggaaggagaagcaggcctgtcttcatgtccaggcaggattcacatcacccgtgctgcaggcttgtgggggtcccagggtgtggggcgggagctgggtgtgagccggtgcgaggggtgcgggatgctcttgatgcactgtctgctttgggcctccgggtggccgggaggtggccctgggaagttggtggtggctgaagattggtaagggacactcgcagctgggacagagtgtatgtgtgcagatgagaggcatgcaggtggcaataacgtattaacagtagctactgtttattgagtgcctactatgtgccaggcgcgtgctgagtgtttcacatttaatacaccaaggtcgggaccattatgatgcccatgtaacagaggagaaaacagaggctcagggaggggaagcaccatgctgggggcacacagccagttaaagttagacaccaggtcttccaactcccagcccagggctctgtttggtttctaaactaacccagtctagaaacaaagttctgaagtttcatttcctgtgtatgggaagagacactgggctagggatttcagggcacagctggcccccacaaagttggaagggacccagagaggcaggggctggcccagggtcccctgtgtggtagtggcagagctagggttggcatgggacccctgagctggacttgtccaggctggagcccgcattggcaggagggtgtgtgttcctgtgtatgactgtggggtgtgcccgtgtcctgggatttgcctggctggacaaacccacgactagttgggacttgtagaggagcagagtaggcggcccgcagtggcccctggcatgaggacagtggagagctcgtttccccagggtctgcagcgggtgtgtagggcacgctggccccagtcatgaattgtgggtggtgatggggccctgagccaggcacccctttcttttggtccatgcatggcacagtgccacacccccagggccgcctcttaaatgccaccttctgaagctagccctgcccccaggttggcagggaagggaagaggtgggaggtagcaggttcctcctctgctgggacacagctgctggggctgggactgcagcacagggggtctgggttagtctagaaagctccctcctgtggttagtgggggcccaaatggcacgcagagggcgcccgctgcttcagttgtcctctatccaccatggtttgaatgaggccccacctggaggcaggggtggaacaggaatgacctcaaaggcctttcctggagggtgggtccccagagaacttcagagcctagagatcacctcatcacagatagggaaagtaagtccgggagaggggcatgataggcccaaggtcagtggtggtcctgggatgagacccttggtccagggctctgcagttgggcaacattctctttccctgccacccccttgtccccatggccacaggtggcagtgcctgcccctgtggccctcactggcatgttgggctgggttggtgggcagtcagcgagattgttctgatctttccaaccctgcagcacccctggcatggggagcggagggagggtcaggtctgtgtcctgttaactgcatgtcctgcagggaaactgaggcactcccagaggccacctcccagccgagagagaggacctcagggcccccatgggggtccccccttcttgctgtccctgagaagcagatgtaggcgcagctgggaatggaaaggagggagtggtcacgcctcccttggctccagaggacagaccccctgggctccctcgtgtccatagcaacctggaaagagtaaattgaatggcggtctgagggcagcagttgctaggggagacagtcaacttctttcatctctggcttagtggcagcctccttcccttttgaattgcaagtaaaattgaaaggctgttttgctcacggtgaagtttgtggaaaggggtgaggtgtggccgagagggccctggctctggttctgagcactggagaagggggaggagaacccagcaacggcctgaacccctctgtgtcccagaggcaaacagcacctgcttcacacagatatgcagtgtgtacacgacatgggctacactgggccccacacagacacacagatgcacaaaacattccacaaacaacatagtgagaccctaaaaccaggccacacagaaacactccaattcacagaatatgcacagtgttagccgcacacacagccagatgccacacaaccccacacaggcacagaacagtccccccaccaccggggacctataacaaccatatgcagatgacacagcacgctatctcccacctcatgggtgcacacggacaggaaaagcatacagttcaacacagccaccaatcggcccacaaaggtatgcccagatgcacaaagtgtgtatcacacataccagggagcccaggcacaccccccagacccacccacatgcggttgtacacttgcctcaccgacacacagacatataccctgatacacacagccaggcccaacacccgcgccacaacatagaccttcagccacagatgccgccttagccgttcacgggaaggctcagatgcaccaaacagtcgacgtgaactcagcacccacacactacacacacagtgtcctgcgtggagacaaatgacaaaatacaccccactcgcacctagtgagagccaccaacatcagtgcacagcctgtgtggctgcctcaggccaccgccaccacacacagatgtggacaccgctcaccattgacctcagtgggcttggcacagacgcttgacaggcctgcagccgccatccaggcagaaaccccctacttccacctcccctgcacagccttggactgtgttcctccagactcagggggaagcccccaagtagtcacagttagctcctccctattggtggggctgccatgcacgtgtcccgggggtggggtgggtagagatgtccttgctttgtctgtggctcatagaacatctctcagcatatggggtcaatgcaggcctggagggcaccttccctaccgctaacctggcctggacccaagacccgagatgagcgtgggtgagagcagctgccctcctgttggcttcctgtggctggcgtggccctgcacgggtgggcttttgaatgccctgcctgggctgtagcaggccaggtcctgaggatgcagatggtgagtgcagggctagcatcagagtaagctgggctggggtgttgtcgctgccaggtgcccttgacccactgtgtgctctcccactgccctgctcctccctcacctcccttcccccaacagctggggaagatgaggggccacctggggccagcaggtgccttaagggagttgagagggttctatggctggtagggacagccagagcccacaggggtctgaggatgtgcgggatggaagcttcctgggggtggaggaagggcagcagcaacagaggctttcctgcagtgaggatggaggggacctttttttttttaagatggagtcttgggccggatgctgtggctcacacctgtaatcccagcactttgggaggccgaggcgggtggattacgaggtcaggagttcgagaccagcctggccaacatagtgaaaccccatctctactaaaaatacaaaaaattagccaggtgtggtggcgtgcacctgtagtcccagctacttgggagactgaggcaggagaatcatttgaacccgggaggtgtaggttgcagtgatccgagatcgagccattgcactccagcccaggagacagtgcaagactctgtctcaaaaaaataaataaataaaataaaataaaaaataaataaataaagatggagtcttgctctgtcgcccaggctggagtgcagtggcacgatctcggctcactgcaacctccgcctcccaggttcaagtgattctcctgcgtcagcctcttgagtaactgggattacaggtgcatgacaccacgcccagctaatttttgtatttttagtagagacggggtttcatcacgttagccaggctggtcttgaacccctgacttcaagtgatctacccgccttgacctccaaaagtgctgggatcacaggcatgagccactgcacccagccagaagggggcattaatatgcaggcgccgtatagggcaacacctgtgtgcacctcttacaaatcttaatgctgtgtatatgagggggttccttcgtgtcctccgggaatgtttgaggttgcctgtatgtgttatgtgtgtgcatatctttaaggtcagatatgcatagacagattgacacctctgttttgaatgtattcccatgagctcatcccattaattcactatcgcaacaaatatttactgagcgtgagccatgccattccacagccaccattctagtactaagatacaatgaggaacaaaaaatccaggctttcctgagctcacattggggtcggggcatggtgggaagacacaggcatcaatgtaataaacagaaaccacgacagggctaagtgttctggaggagaggcacatggtgtactgaggcccctgaggttgacccaggtgcacctttgagctttgcctgcgtggtttgggtttgtgggctcacctgcatgtgtccatgcatgccccgtctgcgtgcccgtgcatggctgcatcaccccatacacacgtgcactgcccctgggcttgcccacatgtgctgctccccagggcgccaggctatcagcctacaaggcattgtgggtctgggcccagcctgccacgccctacagaagcctgagcctgccttcccaggaggcccaggactctcacccagggcccttccctgcagctggagcaggctctgcggctggagcctggggagctggagacgcaggagcccagggggctggtacggcagagcgtggagttgcggaggcagctgcaggaggagcaggcctcctaccggcgcaagctgcaggcctaccaggagggccagcagcggcaggcccagcttgtgcagcggctgcagggcaaggtcaggaccacccactcctgctcctgtcctcccacctgttcactttgccccgccccaacccctggggctcaccatcagctccccatccccagattctccagtacaagaagaggtgctcggagctggagcagcagctgctggagagatccggagagctggagcagcagcggctgagggtgggtgccagtgtggggcaggggcaggccctgccctccacctgcccaacctgatgctttaacctctctcccacccaggacacagagcacagccaagacctggaaagcgccctcatccggctggaggaggagcagcagaggtgagggcgcagcagggagggccagggctggcaggatggccccctgcgcgagcgcctactgatcccctgtgccccattcaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggaggtgggcatgggggtgcagggaggccagcctgacccaagaggaaggggcactgcagaggagggaggactcagaagcctggagagggagagggagcactgtccaagggagcctgttagcagaagtaaatagccgtcatcacaatagctggtctttatcagtgtgtagcatgtaccacgtgcacggtgtgcgttgacctttattcctcatgataactgcatgtggtaggtgctatcattctcctcattttaaagagaggttaaggccggtcgcagtggctcacgcctgtaatcccagcactttgggaggctgagagatcgtgccactgcactccatcctgggcaacaaagcaagactctgtctccaaataagtaaataaataaagagagtttaagtaacctgcccacagtcatgcaactggcagctgggatgcaaagctaggtcccttgcatttttgcccttcgttgctgcctcttgcagccaaaagaggacttgaaacccaggtccctgtgcaggagggagccatgaggcttgggaggctgagcatggccgctgcaacacagctctgtgcacagacccacaggaagacccaatccctgaacgacggtgcctcccaggatggtcggagatgagggaagcagtgggagggagtaaacccgctctcacaccaacccttccctcggcatgtcttccctccagtccttcaacgcctacttcagcaacgagcacagtcgcctgctcctcctctggaggcaggtggtggggttccggcggctggtcagcgaggtgaagatgttcactgagaggtgaggcctggccggggacggggcagcagctgagagccagccctgctctttatgtccaactgaactcagttgaatttcagttcaactcaacgcacttactgtgcacaagggccggtgaggacacagaggcaacttgtaataaccattaccacagtcgtggcagtcagcatttattagatgtttactctgggctaggctcattgtatatttcatttcaactaatattcatagcttccctgtgaggtaggaactgtgttcattcacatattacagatgaggacattgtggcgcagagaggttgagtgatcttcctgaggtcacacagtagtacataagtggctgagtcagagtttgaagttcctgattttttttttttctcagacggagtcttgctctgtcaccaggctggagtgaggtggcacgatcttggatcactgcaaccttcacctcctgggttcaagcaattctcctgcctcagcctcctgagttgctgggataacaggcacatgccgccacacccagctaattttttttttttttttgtattttagtagagacggggtttcaccatgttgcccaggatggtctcgaactcctgagctcaagcaatcagccagcctcagcctcccaaagtgctgggattataggcatgagccacagcgccaggccgaagttcctgattttaatccactagaatattcagctttgctaccaaggacctcacagcctcttgtgatgaaaagatgtagatccccaaaattctaggctgggcacggtggctcacgcctgtaatcccagcacttgaggaggccgaggcgggtggatcacctgaggttaggagttcaagaccagcctcaacatggagaaaccctgtctctactaaaaatacaaaattagccgggcatagtggtgcatgcctgtaatcccagctactcgggaggctgaggcaggagaattgcttgaacctgggaggcagaggttgcggtgagccgagatctcgccattgtactccggcctgggcaacaagagcagaactccatccaaaaaaagtaaaataaaattctagactgaggaagcgagtggtcagtgatatgtacgtggaacagagggaatgtcctcgaggctcagaaggatgggaggggtggggaggtcagaaaaaccactttgtggagatggaatttgcacagagcctcaagggatgggtagggttgaagcagagcagcaggcgctccaagcaggagcaaggcatgagcaaaggcatggaggtgggagcccatggcagccaggggggttgcaatgaagagctggtacagggaaaggagagcctgcctcagcgggggagcttgggcctgcctgatccgtgtgagcagtcagctcaacagtagtgtcagggaggctgcggagagagccccaaggcaggaggccaaggtatttcatttagtgcgttaaaaacattttagttagtaatcttttcttttctttatggctcactacagcctcagcctcctcgtctcaagcaatcctcctacctcagatcctgtgcagctgggactacaggtgcatgccaccaggcttgctgatttttttatttcttgtagagtcgaggtctcactttgttgcccaggctggtcttgaactcctgagcccaagtgatcctcctgccttgacctcccaaaatgctgggattacaggcatgagcaaccacacctggtttaataatcttttgttaatatcatcaaatagccagtgtctaaattttccatatgtctcataaatgtcacagatagaccaggtgcagtggctcacgcctataatcccagtacttcaggaggccgaggcgggcggaccacctgaggtcaggagttcgagaccagcctggccaacatggtgagacccctatctctactaaaaatacaaaacttatctaggtgtggtgacacatgcctgtaatcccagctactggggaggctgaggccccagactcgcctgaacccaggaggcggaggtttcagtgagccgagataacaccattgcactccagcctgggtgacagagtgaaactctgtctcgaaaaaaaaagtcacagatagtcttgctttagttttttctttacaatttgtttgaatctcgatccatagacatttacaaaacgtaaatgtttgctttgtcttttttttctttttttttgagatggagtcttgctttgttgcccaggctggagtgaagtggcacgatcttggctcaccacaacctctccctcctgggttcagcaatcctatggcttcagccccctgcgtagctgggattacaggagtgcgccaccacgcccagctaacttttgtatttttagtagagatgggggcttcaccatgttggccaggctggtcttgacctcaggtgatccacctaccttggtctcccaaagtgctgggattacaggcccaagccactgtgcccggcccctgctttgtcttttaagtcccttttaacttatttgttcaggaaactgggctagttgtccttggagattctcatggtctggattttgctggttgcatccttatggtgtcaattaacatgtttctttatcccatgtatttcctgtaaattggatgttggatctaaagctaggtcagattcaggttcttctgcttgcttttttgtttgatcaagactccataagtagaatgtgttcttccagcaggatgcccctatgccagctgtctctcttttcaagatccaacccactcatcaaaggctgcaaaactgtgagcttctcatttagtcactcctgtgtatattaattagaattctggaatgaggcactttctctccttactattagataaccagtggtactgttcattcaggaaaggaaaggatttaacctgtattatggactgaaaatacatttttttttttgagacagtctctctctgttgcccaggctggagtgcagtggcacaatcacaactcacattaggcttgacctcccaggctcaagtgatcctcccacctcagccacccaagtagctgggactacaagtgtgcaccactatatctagctaatttttgtttgtttgtttttagagacagggtcttgccatgttgcccaggctggtcttgaactcctgggctaaagcagtgcacctgccttggcctccgaaagtgctggaattacagaaatggcccaccatgcctggccttaaaatacaaaacaaaaccaaaaattttaagtagcctttaaaatttttatattttacttttgattaagtcacatgttcacaaggttcacatttcaaaagggtacacagtaaaatggctccctctcacctctgaccccagatattcctcttccctccttggaggcaagcagcattatcagcttctttttctttttatatatacagattttttcttttttcttttttgcttcttcttcttctttttttttttggccaccaagttaccatgagaagcattatcagcagtttcttttttttttttttttttcttttttgagatagagtcttgctctgtctcccatgctggagtgcagtggcacgatcttggctcactgcaacctccacctcccaggttcaagcgattctcccacctccgcctcccaagtagctgggattacaggcatgagccaccacaccccgctaagttttgtatttttagtagaggtggggttttgccatgttggccaggctggtcttgaactcctgacctcaggtgatcctcctgcctcagcttcgcaaagtgctgggattacaggcatgagccaccacgcctggcctatcagtttcttaagtgaccttccagggttatcttacataatcaaataaagcagatcacacacacacacagagacacacagacacatgcacacttttttgcatatacgcctggtaaaatttcatcttcacagttcttgaagatgcttccctaacctactagttataactgggaggtggctctgtgtcaggccaggaagaacttctccactggtttttttgttttgttttgttttgttttgagacatagtctcactctgtcgcccaggctggagtgcagtggcccaatctcggctctctgcaagctccgcctcctgggttcacgccattctcctgcctcagcctcccgagtagctgggactacaggcgcctgccacctcacccggctaattttgtttttgtattcttaatagagacggggtttcaccgtgatagccaggatggtctcgatctcccgacctcgtgatccgccctcctcggcctcccaaagtgctgggattacaggcgtgagccaccaagcctggccttccactgctttttcttggccacagagtgttccacagaatggatgtaccatcatgtacttagtagcagtccccttttgatagacatttaggttgtcaccaggatttcttacatgagcaatgctgcagtgaacctccttgtccacaagccatctcctctgtgctggggtatatcgttggatacgttcttagaggaggagccggtggggaaggtcctatgcatgcatagttttcagagctctccctcagtgccctccgttgtggttgtatcaccctcccaccagctgagtaggggagggcctgttacccccagagcccctccttgtgtattatgtatccctttttttttccccaatctgagagtggacaaatggcatcccagtgtagggttttttttttcttcctctttagtttttgagatggagtctcactatgtttcccatgctggcctcaaactcctgggctcaagcaatcctgcctcagcttcccgcatagctgggactgcaggtgtatgccaccgcacccagcctagtatagttttatttttattttattatttattttgagacacagtcttgctgtgtcacccaggctggagtgcagtgtcatgatctcggcttactgcagtctccacttcctgggttcaagcaattctcctacctcagcctcccaagcggctgggactacagaagtgcgccaccatgcctggctaattttttgtatttgtagtagagatagggtttcaccatgttggccaggctggtctcgaactcctgacctcacgtgatctgcccgccttggcctcctgaagtgctgggattataggtgtgagccaccacgccctgcccaagcatagttttaatttgtagttgggagcaagccccatccatccccagcctgtgctctctcccgaagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccaggtgggtacctggtggatgccgcacgaggcaggcgtccctgcagaaggtaaaactggagagttggggagaagggagcatctgttcactaggggaagggccttcctctgtgagctcagccagtcttcccatgcactgaggttccgaaggcacttgcccagtgtttatcataaacagcttagcctcctatggcagaacttgtggccgggtgtggtggctcacacctgtaatcccagcactttgggagaccaaggtgggggattacctgaggtcaggagctcaagaccagcctgtccgacaggcaaaaccctgtctctactaaaaatacaaaaattagctgggcgtggtggcgcgtgcctgtaatcccagctacgagggaggctgagacaggagaatcgcttgaacccaggatgtggaggttgcagtgagccaagatcacatctctgtattccggcctggatgacagagcgaaactccgtctcaaaaaaaaaaaaacaaaaaaaaagaactcgtgccccttactcctgccacctggacaagtcctcaactgctttcccatgagataaagctggtgggaacctcattcccatttcacagatgagaaatgtgagatctggagaggagccgggacttgtctgaggtcacacagccagggaggtggatgttagggtccctgcctcgggtttggagaagcatggtggacacagagctagtggatttgagaagctggggtggtcccgtattcacctctgttgctcccccaactccagagtgacagagctgggcctggcagtgaagcgtcttgagaagcagaatctggagaaggatcaggtcaacaaggacctcactgagaagcttgaggccctggtgagctgcaggtgcccctgagatggggcagggtgagatggggtaccggccagatccatggacgcaggcttagggctgggctgcctgggtcacccccagcgtcccactcacactcaggttcagccctcacaggtgtgcaggctttgtgggaagcacactcacctccatcccatttcttcctcccagcagccctgtagcataatcctcataacacagatggggaaactgaggcccaagaggggtaatgcttgtccagtctcagagccactaagcgggagagtcgggacttgaactcccatccacgctctccaggtccagatgcggcctctggcaacctagctgccccccacccccaccagtgggacactcactcccccagggtacagcctggtttggtcacccctctgtgtggggcctggcctgggttctaggtccggctctcctgcaatcgactgtgtgacctggggcaggacatagctcttctctgggcctggtctgttcagtgagggcctcgggcctgctgtggggtctaccaggtggctggcctatggacatggcttcagaggccacctggtcagtggtgggccaggtagggagggaaaggggaggtttcagataagacagaaccccaaccaccctttgtctccctaaccgcactccaggaatccctgcggctacaggagcaggcggccctggagacagaggatggagaggggctacagcagaccctaagggacctggcacaggtgtgagcccagagaggcgggaagacagcgccctgccaggcagtcccaggctcccccgccacgtctttcggtgacctgggactgaactgcaaatgggtgggggcctgggacccaggctgtagctgctcagcacccctgctagctcacccagcctctgccttggggagcccccagtctcagaggggaggcacgaccctttgggagcccacctgtgagcaaggccaaatgatgtcttcccaataaatgggaggcctcagcggcgagccgaggactgagctagtggaggaggtgaaatcaggaaggcttcttgtaagaggcagcatttggaatgaggcagcccccagcctcacctgggcgtctttgcccagctaaccccgcggttcctaactcagcagcctccttctgcctccctcccccaccctcaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggtaggaaggggcttgagcgttctgggcgcagccagaggcctgggggaggggctcgcgccctccgggtgggggcgggggcgggggcaggtccggggccagggtccgagggaggagtctgagcgccctggggtgcagccagagccctgagaaatagtttctgagggtgtcaggacccccaaggaggtggccgagagctctgcggtgaagccgagcccagaagtgggggtgcttgggcagctgggggtgggtgcttgggcagctggtggagggaggaggctgcggcagtgttagggtcctggtagagagggagacaggtccctggtcatacagagccaggaccctgggaaaaggtctagcaaggggaatcagagcttgggaactaggggcagagccagggtagggaggagtctgagagtggaaccaggatgcaagggggaggagcctaggagccctgggggtgggatcagaacccaggagacgagtgtgcctgggggtttgtctggcatccggggggctttgataggagttgtccgggaccccagggaggtgagggctcagagggtggcgagggcacataggaggggagcggaagcctggctctcaggcctaggcccctatcctgccccaggccaggtccaggccctggaccccgcctagcgtaggctagtgtgtatccctggaaccagaagagagtaggtggctctggaggcctctcaggcccccccagactctgtgaccccccacaccccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcaggtgccggggaggtctgagctggggggtactgaagaataagtcaccgtctgggcataacaccagtcaagccttatgcgtatggctctgcactaatatggtcgccactagctgcatgtgcctattaacgtttatttatttatttatttttaaaatggagtctcgccctgtcgcccaggctggagtgcagtggcgcgatctcggctcactgcaagcgccgcctcctgggttcacgccattctcctgcctcagcctcccgagtatctgggactacaggcccctgccaccatgccgggctaattttttttttttttttgagacggagtttcactgtgtggcccaggctggagtgcagtggcgcgatcttggctcattgcatcctcctcctcccgggtttaagcaattctcacctcagcctctgaagtagctgggattataggtgcccaccaccacgcccggctaattttttttgtatttttagtagagacggggtttcaccatcttggccaggctgatcttgaactcctgacctcatgttctacccgcgtccatctcccaaagtgctgggattacaggcatgagccaccgcgcccggccaacatttattttttagtattcagttttgttttgttttgttttgttttgctttgttttgagtcacactcttgctctgtttcccaggctggggcacaattggtccatcacagctcactgtaacctggaactcccagactcaagcgatcctcccacctctacctcccaactgcccctagttgggggcctgggcctggcctggggaaggatatgggaccgaagcctgagagttaggtttccactcccttcctctgtgccctcaccaccctctgagccctcacctccctgggttcctgggcaactctgatctcagcctcgaggatagtagacaagccgccaacatttctaaattttttgtagagatgggggtctcactatgttgcccatgctggtcttgaactcctagcttcaatcactcctcccacctcagcctcccaaattgctgggattacaggcataagccactgtgcctggctctattaaaatttaattaaaatttttaaaaagtgaaaattcaggctgggtgtggtggctcacacccagcttgctggccaacatggtgaaaccctgtttctactaaaaatacaaaaattaaccaggcatggtggcatgctcctgtaatcccagctattcaggaggctgaggtgggagaatcacttgaaccccggaggcagaggttgcaatgagccaggatcgtgccactgcactccaggctgggagatagagcgagactccatctcaaaaaaaaaataataataataatgctgggcccggtggctcacacctgtaatctcagcactttggaaggccaaggcgggcggatcatgaggtcaggagattgagaccatcctggctaacacagtgaaaccccgtctctactaaaaatacaaaaagtaaattagctgggcgtggtggcaggcacctatagtcccagctacttggaagactgaggcaggagaatggcctgaacccgggaggcggagctggcagcgagccgagatggcgccactgcactccagcctgagcgacagagcaagactccgtctcaaaaaaaaaaaaaaaagaaaaaattcagttctttagttgccctagccacatttcaagcactcatcaaccatacatggccatagaacatttctgtcatctcagcgagttctattgccagcactattttggactgtatttcttggagttttttttagagatggggtcttgctgtgttgcccaggatggtctcaaactcctggcctcaagtgattcccctgcctcggcctccaaaaatgctgggattagaggcataagccaccatgcctagccttgaagattttttttttctcttaatttgagacagggtcttgttatgtcacccagtctggagtgcagtggtgcgatctcatttcactgcaacctccacctcctaggcttaagtgatccttccatctcagcctcctgagtagctggaactacaggcacacaccaccacgcctgcctaatttttctgttttttgtagagatagggtttcgccatgttgcccaggctgatctctaactcctgagcccgtctcggcctcccaaagtactgggattataggtgtgagccatcacgccaggcaccctgaagatttttaagacaagaaattatccacttcttagctgccaggttgtttttgatattttgttgtttggtttttctcttcataaatgtaaccatctaatgaaaagtttgaaaaataggaataaaaagacagcgccttctcacagcctcatctgcccatcctaattcatttagggcactggttttccttcccattgtgttgcctggcagtgagatagcaaacgtttcctgcacacctactgtgtgccaggctcttggccgagtgttttgtatgtactctgtgatttagtcttcctgtcaaactcatgcaattcggaactctgttgttgtaagcttgagagactggctcagactcatacagcgtgtgtggctgggggtggcagggtgggaactggaattcaggtccatgtgagagtaaacccaagctttccatgcctggaaaggagaaggtctttttaagcagttgtgttcacagcaaacatcccattttgcattctgctatttttacttaacagcacattgtcgactgagcgaggtggctcacacctgtaatcccagtattttgggaggccaaggcgggtggatcacttgaggtcaggagtttgagaccagcctggccaacatggcgaaaccccatctctactaaaaataaaaaaaaattggccgggcacagtggctcactcctgtaatcccagcactttgggaggccgaggcaggaggaccacctgaggtcgggagttcgagaccagcctgaccaacatggagaaaccctgtctctactaaaaatacaaaattagccatccgtggtggcacatggctgtaatcccagctacttgggaggctgaggcaggagaatcgcttgaactctggaggtggaggttgcagcaagccgagatcgtgcactgcactccagcctgggcgacagagtgagatgccgtctaaaaaaaaaaaaaaattactgggcgcattggctcatgcctgtaatcccagcactttgggaggccgaggcgggcaggtcatgaggtcagaagattgagaccatcctggctaacacagtgaaacccccatctctactaaaaatacaacaaattacccggacatggtggcgggcgcctgtattcccagctacttgggaggctgaggcaggagaatggcgtgaacccgggaggcggagcttgcagtgagtggagattgcgctactgcactccagcctgggggacagagcgagactccgtctcaaaaaaaaaaaataaaacaaaatcacgctgtgaagttttttcgcacctatggccagtggggaacgtggcagctcatggcaagtctttggggtcccagttgttcccttctcctccctcccctgccgtggccaccatgtgcctgtgtagcaggaagctgtgggatctgcagactcagctctatcaggcttcccagaattgaggggcatggggtgttataggggacatttcctggtcacatggcctagcagagctggtggcacaattgccgtgtgtcccaggagcctagctcggcctcttctacctggtagggtgcttggagatcacaccagcacctccatccactccaagtgggcggactggagagaaggaaagccaggttcttctgctggagtgtgtgagtgaaatgagtcagccatggacagggtggtcagggaaggcttcctggaggcaggtgccttggaagactggaggatgtagctcatggctagaggagcagccagccaccttccctgcagagagcagccccagcatcccctctgctccccctccccttgtcctgaagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcaggtgagcagcatctcgccaccctgccaggacccttcagatgtgcctcgggtcccctgacagtgcccccctggggttaggtgacacccactgggtcctgggcctcctaccgtctggacccctccgatgtcgggttttctaaccagacccatttcaggaaactggggctcagggaggtatagtcacttacctggagtcagagaactagttaaaaggtagaacttggatgataataacaagaataattaaaataacagtagtaatattagcagtagtattttaaaaatttagttagaagaataataatatccttactaatttcactaagtgccagataccattttaagcaattcagttctctcatttaactccatgataactctgtgacatagaagcggttatctccattttgtggatggtaaactgaggcacagagaagccatgtcacttgccccaggtcacacagttagcagaagagccaggatttgaacccagacattctgccttcagagttaacctcttcaccactgcgctgcttacctctcagggacgtgatcgatgatgatgtttagtagactgtggtggagcatgttattcttgtttctgaaggtccttggggagatgtgtcaggcactattttaagcacatgtgaagtttgtatccttaaaacaggccgggcgcagtggctcacgcctgtaatcccagcactttgagaggccaaggcaggcagatcgcctgaggtcaggagttccagaccagcctgaccaacgtggagaaatcccgtctctactaaaactacaaaaattagtcaggcgtggtggtgagcacctgtaatcccagctactcgggaggctgaggcaggagaattgcttgaacctgggaggcagaggttgcagtcagccaggatcgcaccactgtactccagcctgtgtgacagagcaagactgtgtctcaaaaaaacaaacaatgtcacgaggtaagtgttacctcattttgcagatgtgaaaacggaggcccagggtcatggagctaagcggtagtgggcttggttgccctgtggctcaggctgtttctctccaaactcctgcctcaggcctggtccccagcccagcatctcgctggctacaggaggttcggggcaggaaagtgacatgggccacccacccaccctttgtcccacagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggtgggtccctgtctgctgcacaaccacaaacctacctctgacccccagccccaagccttgtcactctggcacagactggtcccagtgtcaggcagacctctgagcctggtcacagactgaccccttccttctggatacaggctgatctttgtcacaggccacagacctctggacctctggtcccagccataagtggactgacctctctttatggccgtatccctgctcttctggatgctcctgggggcaatgcctatagctcagggtcatccagtgcctgagactcagctcctggggtctgagagttgtggccacagcgcagagggtccttggcaggggggcctgcgctgtccgctgcagcctgggctctgagcagtgctatccctagaccctactcaggggatcctctgaactctggccctgccctgcagcttgagctatttttgcacagctctgtggtgtgtggcttttaaatggctcataagcagcaggctttctgcggtgatttttttttttccatctcacactgtgtcccctccttgtctcccctaccctgtctctgagggtccatctctctgggtctcttcttgggcctcctcacctcctcccgacctttctgcctttcctcatttctcggggcctgaccctgcaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccaggtacgctgtgcacctgcgggcccacctgccttgcccacccatcctccccactcagtgaggcaccccgggcccagccctgtacctgtcttggcccctgcctccctttctgtccctggttctctgtctgtctctggttctctgtctgtctgtctatcccctctaggcgtcaaagcacagaagttccatgggccctcctcatctccccctccccagtgtcccatacacccaagggcactgtccctcattccctgggagcctcccctgggctattgttgctggtgggtgggtggaggaggcgtcctggtcctgggagggacgccctgctcacgaggccccactcctacctggcctccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcaggtgggcaaagctgtgtgtgggggtggtgtggagagcatgtggggcaggccgggctcccagccccctgcatccagtcctgggttaagtcacaggcactggagcctgcttctgggttaaatccagccccacttctgctagctggggaccttggacaagctgcccaatctcccatacctcagttgccccatctataacatggggccagccaggcgcagtggctcacgcctataatcccagcactttgggaggccgaggcgggtggatcacctgaggtccggagatcaagaccatcctggctaacacggtgaaaccctatctctacaaaaaattagctgggcgtggtggcacgcgcctgtagtcccagctacttgggaggctgaggcaggagaatcgcttgaacccaggaggcagaggttgcagtgagccaagatcatgccactgcactccagcctgggcaacagagcaagactccgtctcaataataataataataataataataataataatgatacagattaataataggtggagactttttagaattggaatcttagacttttgggaacatcacatctggaagagaccttaatgtttcagggatccagggaccttcatgcaaggtctatcctggagcgcctaggtttctgggaggggcctctagaggatggggtagggggtgcaggaagcagggtgcaggtctccaccttgaggcctgccgagcagctgcacttgggtctggtttatatattcagcttctctgcaagtttagagtaatacaagggttctgttactcccagagctgagtgagggccctcattttttttgtttcattttgttttgtttttgttgttgtttttttttccagacagagtcttgctctgttgcccaggctggaatgcagtggcacgatctgggctcactgcaacctccgcctccagggtttaagctgttcgcctgcctcagcgtcccaagtagcagggactacaggcgtgcaccaccacgcccggctaatttttgtatttttagtagagacagggtttcaccccgttggccaggctggtcttgaactcctgacctcaagtgatccacctgccaaagtgctgggattataggcacgcaccaccgtacctggctgggccctggtttttgtacacacgtgcattgcagatctagagaaggtcatgacttgcccaagtacatgtagcacatcagggcagaccctgggctcaaacccaggccttctgccaggactgggttaggcccagagttggggtgctgcacgatgaacaagctgggggacgctgggagtgctactcagtctctgggtgggggccagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcggtaaggccttgggctctgcccaacccgccctggggggtcctcctggggccacaccatgaccagccacacgcaggcacgggcccccaggggcagttactaaggagtctggcttgccgactcgtcctagctgtggctcaggcttccccagggagtgtgggcctggccaggcaggtagattggcacttggcccatgcctggccactccctgagatccacagtttcctggggccagggaggctgagtcccagggcctcagggactgtatgtgctgcagcttggagaaggaagccctggagggcagcctgtttgaggtgcaacggcagctggcccagcttgaggcccgccgggagcagctggaagccgaggggcaggccctgctgctggccaaggagaccctgactggtacgaggggctggggacttggggggaacaccaggttccagcccagactgcagcctcccaaggtctggggtctcacagaagttgggagcactggagtaggagtctggctggcctgggttccagtcctgtgccaccacttagatctcaccttcccttgagcaagcccctttcctctctgggctgcagattcctcagctgatgattggaggtggcaatgcccaccttctaagcctgttgccaggatgacgtgggaaaagcgtgtaaggccgtggcacggtgcctggctgagtcaacagtaactgccgttcatcggtcatcaggcctgttagtctgagttctctgtgcttttcagatgactctcttggccccagaatcccagccccacttccctgcaccgttcccatccagtctctgaactcagggcttctttctgctcacctaacattaactaagcacctacttgggtcatggaaattaattttcctgtccatgtacacctgagccagacagaaccaggaagggaaatgctggtgggtttccaacccgggagatggtttttagatggtagctataccatttccattccctgtagtcatttccattaatataaatagttaacgtttgacgggtatgttcatgtcagtcattaaaggagatgctttatgtgtagctgtgcagctgtgggaagttgctgctgatctctgagcctccatttcatcatctgttaaatggggatgaggataaactacataggcatgttatgaagacaaaatgaggttatgtctaaaatacttagctgggcgcttgacccatagtaagtgctcagtcaggaatagggttgttttttgtttgtttgttttgagacagagtttcactcttgttgcccaggcgggagtgcaatggcactatctcggctcacctcaacctctgccttctgggttcaagcgattctcctgcctcagcctcccaagtagctgggattacaggcatgcatcaccatgcctggctaattttatatttttagtagagacggggtttcgccatgttggtcaagctggtctcgaactcttgacctcaggtgatccacccgctttggcctcccaaactgctgggattacaggcatgagccatcacgcccagcctgtttgttttttgagacagagtctcactcttgttgcccaggctggagtgcaatggtgcgatctcggctcactgcaacttctgcctcctgcattcaagcgattctcctgcctcagcctcccaagtagctgggactacatatgcccgccaccatgcctggctaatttttgtatttttggtatagacagggtttcgctgtgttggccaggctggtctcaaactcctgacctaaggtgacctacctgacccagcctcccagagtgctggattacaggcatgagccactgcgcccggcctatttgtttttttgaggcagagtctcactcttgttgcccaggctggagtgcagtggtgcaatctcagctcactgcaacttctgcctcttgggttcaagcgattctcctgcctcagcctccctgaggctgggactacatacgcctgccaccacgcctggctaattgttgtatttttagtagagacagggtttcaccatgttggccaggttggtcttgaactcctgacctaaggtgatccacctgccccagcttcccaaagtgctgggattacaggcgtgagccaaggcacctgacctagggttgttatatgtttgacatccgtcccatttgggaggccttctcatcagtcattttatgcctttaatgccattctaggtaggcaggaaaggggtcagggccagtgggcccatgtagcatatagggaaactgaggcccagagagggcaagccacttcaagaggacccaaactagatgccaggcaggccctctgcctctgggattttgcccatgtggctcacctggcctaagtctgctggcccaaggaaaagtttcaacccaaccctgccctttcccccattcctctcgtgcaggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggttcaggcagctggggaggggtgggcaggactctgagccagtgtttcatcatcgttcttgctctgcctcggtctctacatctgtgaaatgggacttcctctctgttgtggaggtcctggggacagctaggaggactggggggatggggaggttgtggttcttattagacatgcagattcccaggtcccaaatctggtccagccctggtaatcctgatgcagagggtccacaaccacatttgggaaatactgacctaatgtacagcaggaaagcactttcatttgctaagaagtactgtttgcatatgaagagccactcagacctcagcatatagaaaggcaaggggccagggaagttactagaacactgactctgggtttgaattgcctgggtttgaatcgaatcttggtcgcttactggtgatgctacccaaggtgtccgtgccttcatttccccacctgtagaaatagggataggatagtgaaaggtattgaagatgagctgagaccatctgcatagagggcttagcatagtgactggtacttagcaaatgctccataagttatgattgctggcactgacatgctctccagagtggccctcgggacaggggccctcagccaccaaatcctagacagggctgcctctgacagaggtgcaggctatgactgcatggctccagggcatgccactcaccctgcagtacccctggccttgggtggttgttaccacgcttctccaggaggtggcggtaaagctcttttttttttttcttttttctttttttgagacggagtcttgctctgttgcttaggctggattgcagtggcgcaatctcggctcactgcaacctccactttctgggttcaagcgattctcctgcctctgcttcctgagtagctgggattataggcgcgccaccacgcctggctaatttttgcatttttagtagagacgggatttcaccatattggtcagggtgtctcgaacttttgacctcgtaatctgcccacctcggcctcccaaagtgctgggattacaggcatgagctacggtgaagatcttaaagaaggggcggtttggccggtcgtgctgactcatgcctgtaatccagcactttgggaggccgaggtgggcagatcaccaggtcggaagatcgagaccatcctggctaacacagtgaaaccccatctctactaaaaatcacaaaaaattagctgggcgtggtggcacgcgcctgtagtcccagatacttgggagggtaaggcagaagaatcgcttcaacctgggaggcagaggttgcagtgagccaaaatctcgccactgcactccagcctgggtgacagagcaagactccgtctaaaaaaaaaaaaaaagaagtggcagctctgtctgcttctcacagagttgctaggggcaagtgctgaggcaggcacctgccctcaggctccccaggtgggctgctatttgcctgtgggctctgcctgcccgcctgtccagtccccagggatctgaactcctgtgacctcccccttgctcttcttgccctttgcattgcctggcttggcctcattaatgtccccaaatctgtgttctctccagctcctctggcaacccctgacccccttcattcctcacagccagtcctaactcccctccatcccaaccccaatccctcttccacagctgtcggaacatcccctaagctaaaaatcagattgctccttgtcaccttggctcgagtcctctctcccactcccctcactgtccttagaatccccatggcccacacggcctgtcctggccccacccctgcctggggctctggccctgtgactcaccatgtcccgttcccctctgcaccctgcatcctctaggcctttccaggggctgtgttcttggcctggggtggtcttttctctccttacctggctgacagttacttgtccctccgcaggggaccatgttcggacccccaggccagcccactgctgctccttggcactttcacggccctggcgtgtccccgtcatagcccttatcactcccttgtatttacctggtcaccctccatctctgagggtatgggggccagatggctcttgctgccctgatgttttggggggtctgcctgggccccctcctggtgtgtcacaggcatccggtcctggccccctaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggttcgtgagccctggcatggcctctgctgctctctgagctgctccagttctggggccgggccctgctctgccacttggcagctaggagccctggggcaggccactgccctcttgggggcctcagtttccttacctgcaggaggggaggattagaagggggttcgtgaggctttgctgtgctccatgcctggcacacagtgagcacttactgagtgacagtgacagtcgtgacaccaggaaagctgttccatattctcccatgcctcgtcccaccccacgctgggcatggatcctcatggctgccttctgagcagtccccacgatgcccacaggcatcagctgacgtgtccccccaaataacaaatccctaactttcctataatgtaacggagacagggcagactgtgcccatctcctctcctcaccagctgtgtacctgggcgagtcactttacctccttgagcctcagtttcctcatctgtaagatgggtagaaagaaagactctgcagtcagggtgctgtggcgggttagtgagctctatgagtggtatccacgtccgggattcttgtgactgccgttgtgcccttttccagggctgcatgtctgccctgggtccacctgcagtggcacactcaggcctctaagcccccagtgggcacatttcctaggcagcaagaagcctgagcatgcccccaggaccagcccatcccccaagccctttgtcccctgcctctgcccaggccttgtctctgaaggagtctgagaagacggcgctgtcagagaagttgatgggtacacggcacagcctggccaccatctccctggagatggagcggcagaaacgagatgcccagagccggcaggagcaggaccgggtagggcaggctgggcagctgggcctctgtctcatagagaggcacatccctggctgaggagcccccaccacggggcggcatggccctgtcctggagaagcttccaggctgtgggaaaggaggtttagcccttcttttgggagcccccatctgagggaggtggctcagccctgccctgatgaatccttttggcgtgagggagaggctggctacacgggcagcactcactatgcatccaggggttggcagagggtccggcaggccagcgggaggggccgtgtttagagctaaaagtggacagtgcactgagcgggttgggagcagcccggggctgggggacacagcaggaccaagtctgaggagcccctctgtcccagagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggtgagcagccgcccccctcttccaagcagcataccctaaatggcactgtgtgcctgggggcctagttccccagggccc

SEQ ID NO: 321 - DNA, 265990 bp, Homo sapiens
  misc_feature (110199)..(160198): n is a, c, g, or t
ctacccagaacctccttagtcaggcaataagagcaataagatctcaagactaagttttattattattattattattattattattattattattattatttgagacagggtctcgctctgttgccggggtggagcgcagtggtgagatcatggctcactgcagccacgacctcctgggctcacgtaatcctcccacctcagcctcccaagtagctggaaccacaggtgtgtgccactacacccagctaatttttttttttttaatcgagacggagtctcgctctgtcacccaggctggagtgcagtggcacgatctcggctcactgcaacctctgcctcccaggttcaagcgattttcctgcctcagccttctgagtagctgggattataggagcgtgccaccatgcccagctaatttttgtatttttagtagagacggggtttcaccatgttggtcaggctggtcttgaactcctgacctcaggtgatcattctgcctcagcctcccaaagtgctgggattacaggcgtgagccactgagcccggcccacccagctaatttttttttttttgaaatggagtctcactctgttgcccaggctggagtacaaaatggcgtgatcccggctaactgcaacctccgcttcccagattcaagtgattctcctgcctcagcctcccgagtagctgggattacaggcatgtgccatcacacccacctaatttttatatttttagtagagacggggtttcaccatgttggccaggctggtcttgaactcctgacctcaggtgatctacgcgcttcagcctcccaaagtgctgggattacaggtatgatccactgtgtgcagccccgtgcagctaattaaaaaaaattttttttcgtaggcctggtgtgaaggctcatgcctgtaatcccagcactttgggaggctgaggcgggtggatcacctgaggtcaggagttcgagaccagcatgaccaacatggcaaaacccggcctctactaaaaatacaaaaattagccaggcgtggtggcaggcgcctgtaatcccaactacctgggaggctgaggcaggagaatcacttgaacccaggaggtagaggttgcagtgagccaagattgtgccattgcactccagcctgggcaacaagagcaaaactctgtctcaaaaaaaaaaaaaaaaaggccaggcttgatggctcatgcctataatcccacaactttgggaggccgaggcgggtggatcacttcaggtcaggagtttgagaccagtttggccaacatggtgaaacccatctctactaaaaatacaaaattagctgggtgcggtggcacatgcttgtaatcccagctacttgggaggctgaggcaggagaatcacttgaacccaggaggcagaggttgcatgagcccagatcgccactgcactccagactgggtgacaagagtgaaaccccatctcaaaaaaagaaaaaaaaaattttttttttttttcagaatgaggtctcactgcattgcccaggctggtctcaaacttctggactcaagtggtccccctgccttggcctctcaaagtgctgggattacatgtgtaagccaccatgcctggccaaagacttacttttacaggaggagtataaaacatctcattagtaattttcataattgattatgtgtcgaaataatatttttgatattttgtgtcaagtaacactactaaaattaagctcacctatatccttctacattttcactgtggctactagaaaattttaaattacatctgtggctctcattacatttctattggacagcactgggctgggtgagatgactaggggcagaaagtacattctgagggccagacaatcaaggtgattgatactggggttaggttaactgaagggtagaaaaggccaggttaataggaggcagggactgagtaaccgggaacaaagttatcagagcatgagagagagattctgggggtcagccgtctgggatattatagggaggaaggaggctgtgctacaagggccaagagacaggaggatgcactcaagttggcctggatgaagggacgaccctctgcgacttgggtgggggtaagggtggcaggctggggccagccctgcactcaccgcttctgcttcctagaaggagaaacagtgtcacttggtacctccacctcaggggcgcagtcaagacccgctgccaggccagcctctgcctgaccgccggctcacctctcttcttccagcttcttccgcaggaggtcccacctccaggcgggcatgctggccagccgggcctcctcctcctcctgaaacacaaccacaaagcttcagagcctgcaggggctgggagatagggggcaccctcaacctggggacctgaaggagtcagggtcacaggaagtgaccctttggatgcatttctgtgggacaagtggatggaggtgcctggtcacaccccctcagagctggcctcctttctcctagtaacccagacccttgtgtcctacaggaggcaccagagagatcagagctgagtgggacagaagcagagaaaaagtagccgggacccagaggtcctgagcctgattccccacaggggcaggtggccaatggccacaggtccaagatctctgggcagacgcagatgcgggcccccacccagcctcttggctcagggagattcaggctgcccctggctcccctgagaaggaccttcagcccatggttgccctcttcccaacagagtggatacgtgctctacaatcgtggggctgcaatgacatcaggggcaggtgtggtgtccaacataggcagtttacagcaaacagttttatttcctgaatattacagaggagaaagggtctgtacaccgcacacttcacacagaacactgcacacgtggctcccttgacctcagccaaggaggtagctgtgaactccagtggaaaaccagagagcaggccacactgccccagggaggagccgcagcccctcactcagaggggcttcttctgctgcctggctccacacagagctcagcaagaccacggggccagagggggacacctggtttgttctgtgcctgccctgcctatccgaccaacgccccacacaacctgctcacgatgggacctcagaggctgaggcagcctggtcctgggccctccgggctgctcaaggccacagtcctgggttcttcccgctgcttcacgcctctggagggcgtcagacaggcgtccaggcccacgttaagacgctcgagggtgaactgcgaattccgaattccgctgctcagatgtcaaacagctctgcctccttctccttccagaaggagaagctgcggtcgatgtagcggcagatgtcctcgttgctgaattcgcccatctcagacactagttccaaagggtcttcggcgggggcttcggaacccggagagtctgagatccggggaggcgcggcggggaggcgcggcgggccggcgggcgggcgggcggtggcggcggctgcggcacaggggccagggcctcgcgctgccccttgggcgggtcccccttctgaaccggagcggcctcttcggtccgctcctgttctttccccttctcttcctttttcttcgcctgttcttcgggggccggcccagcctccaggccgtttccgaagaacctgtgcctgaggtcctcgaagccgtcgctccagccgcgccggccggcctccacctcctccagcaccacgcggtggaagaggcggatgcgctcccacgggtggctgtccagccggtggaacatctcgtagcacagtaggtggcggaacttgcgatcctcgcggctcaggcccatctccggtagctggaagtagccgagcatgaagaggtcgagcgtgaggctttcgtagcgcgggggtgcgccgccgtctaggggcgacaggaagtgctggggccagtacacgccgtgcgccaggcccgggcttggcggcacgtgccgccgcaggctccgccagtggtgcagcagcttgcccactgcctgccgctgcctcagcagctgccgcagccgttcgttggggctgtgggcctcgcccttgctcaccggcagccggggggcgtccgtggcctccagctccggccagcacgggcggccgtcacgccagggagcagtctgcctaggcgcgcctggtccgcggaaggcccggtccgaggaaggcccagaggcgccagtgctccaggaagaggtaaacgatgcgctccttgcgcaggtcgaggtagtcctggacgccgcgcagttccgtgcagaggggcggccggcgcgccagctgctcgggctcaagtagcgccgcctggcaatcctgtgcctcaggcgggcccagggtgtccaggggctcccagtcggccagcgggccgtgggcggcggcggcgctgggctggccagagccggccgccacgtagtcctcctacaggatgggctcgcggaccggggcgccagcggactgcgggggcttgcggcgcggacagcgcgggggcgccgcgtccagtgcgcgcagctcgtaggtggcgcggtgatgctgcacggagacgccgcactcgaggatctcgcgcgccacagcctcgcggcaccagttgagccagtgcgagcggcccaggcaaagcggccccggcagtcagggcgcctcaggcagcggcgccagcggctggcccgtgtcagcggtcggcagctccgccaggtgcgcaggccggccgcccagcgcggctagcagcgtggccatgctcttgagcagcgtggagatcttgctgcaccaggcgggcaggctggcggcgcggccatgcattcggcgcgggtcgacggtgaagcgcggctccacagggcgacggagatgggcagcagctgctcagctccagttgctccaggcgcgcctccagcttctgcgccttgtgcagcacctgcaggttctcgattgctgctcgatgcggaggatgtcggcctcggtcatgagctcgccaaagggccagaggatggcgttgtgctcgcgggagtacctccagccctcgcgggggtacctccagccctcgcgggggtagcagcacgagctggcggccgtcagctaaggcggggaagacaagagaggggagggaggcgcgtctccctctggcccagctcccgccgtggcgccaggaaccttttgcatgtcctgggtggtgtaatggctccgcggggctgcgtctgcagggagggaccgcgtctggccggcggggggtgacgctggggtgaggcttcggcctgagccgccgctccaggctctgggcagtgtccactttggtcgctggcggggggcacggccggttgctgctcgctgctgcggcggcaagaacaggccagcagacggggtctccatgcctggcttgttcgctcattacaccacccaaggaacttgccaaaggccttgaagctgagaggcgcggtggcccgccccaacccatccgagggcggctattgtgaggcctctcctcccagactcatgaccccttctccagctcccctgtggcccaagccttccgctccctgtggtcaatgttttatgtgcagaatgagaggccactcctctcttaaagaggctgcagctgcagcttccactgagctgcccacccttcccctcccttcgtcgtgctggacagctgggcaccgtaatattctcatttgctcacttttctccacctctgatgtccagttttcccccctgggcctgccatcgcctccacagaggtccctgattcatcttggccctatgggatccactccccacatacaaataggaagcagcctcttccctgcttaacactccccgcacccggctccccagtgctccaggagaaagtccgttctcttctgggcctctggccaggtcttggtaacctggcccccactgaggtctctccagctcagcgacccccttcctccaggacagtcagggccacatccactctcacttccagactgccctgtcccacctgcggctcttcagccccctctctgcctggccacccctcactcgtcttccaagtgttaccttagacatcacctcctccttccctaacacaccccccagcccacgtataaggtggccggttagggctgccccagtcccctgcgttccccattgcagctggctgtgttgcatcagcccaggtacttctctccactgccacccactctctcacactgccccattttgtgtgcttggtgactcgcacacatgtccgcagccaccttagagcaggccttgatatgttcaccatgaatccccagaggctacaagcgtgtggggcacataaatggcactcgggggccaggcgtggtggctcacgcctgtaatcccagcactttgggaggccgaggcgggcagatcacttgaggccaggagttcaagaccagcctggccaacatggtgaaaccccatctctactaagaatacaaaaattagccgggcatggttggcgggcatctgtagtcccagctactcgggaggctgaggcgggagaatcacttgaacccaggaggtggaggttgcagtgagtcaagatcgcaccactgtactccagcctcagtgacagagtgagaccctgtctcaaaaaaataaaaaataataaaaataaatggcattcggggaatagtttttggatgaatggaaagcaactcatcctgccagctggtgctgatcagctcaccttacagagaaggaaactgaggctggatgaggctcagtatcggcagctggaaggcggcagcgcagcaatggagaccaggtccctaagactgagaccaaagctctcttggctactcagtgtggtccttggaccagtgtcatcagcagcctcacccaggagctggctagaaatgcagaacctcagccctgcccagacctcctgaatccgaacaggccttttaaccagatcccaggtgctgggcaggtgaaggagagtctgagaaaggctgctgtctcactccaaggacaagctgctgggggtgtgtgtggagactgggacaagccccaaacggggtcgtgccaccctgatttccctaaagaagatggccgggcacagtggctcatgcctgtaatcccagccctggccaacatggtgaaaccccgtctctaataaaaatacaaaaaaattagctgggcgtggtggcatgcgcctgtaatcccagctacctgagaggctgaggcaggagaatcatttgaacccaggagacaaaggttgcagtgagccgagatcgcgccactgcactccagcctgggcgacagagcaagcctctgtctcacgaaaaagaaaaaaagaaaaagaaagaaagaaagaaaataggaggtcccgaggttggtgttgggggtggcgtgggggatgggctgtgcatccagatgcagaccccagggctccctgggcaccccgccccacccactttccacctctgctcctcctcctcctccatcttcagctgcatcttgcccaccatcacctggcgcttccactcgggcttgggacggccctgctcatcgtgcgtggggatgagcgcctccacgtccagctgcacccccggcgcaggagtagtgggcggcaccggaaccaagcttccgttgagcagcggctgaaaccccgcagctggcggtgtggggctccggactggtaacagtgcaggtgacacagacggcagcggccaatcgggctgcagggagaagcggtggggctgagcgcctggtggcctagggccagggaagccgggtcgcaggctcctgctgggcccgcctacctggaaggccggctgcctgctgcctgagaacactgtggtcagccccttgctctgtggcgtcggcttcaggctcttgcctgccttaatctcagccagtagctccgagttgtcgcccatcgggaacatcacgttgaaagacttggtgcctatgcagaggcaggagatgaggcactggccagggtggggctgcatccctgccacccctcacccgcccctctgcagcccccttcccaactccagattggatgggtgcccatcctcggggccagcgggcagctctccagatcccaggtcctgcaggcagctttcagggcccccagaggcaggcccttggttccccgactgtggcaaccccaccatcctcccccaccctactcacgggatggagggcccctgcctggagacccctgggagttcatggtggctcttgggcatatattcctgcccagccactgactgcccagccccaaaacactacctggaatcagccaccggacctttgtcccaggtttcctggctcagcccggctgggtggagcctccctctggccctctccctacatcagcaaagcctcagtgacccttgagctgagtcaattggggcctccatggacatgcagagtccagaccccagagtgccagtaccacctgctcccctccctcgccaccacacccacagacagacgcacaagcagacacattggttgcaagccgggagcacatttatggcaaagcacggctcagctctaggggaaagcagagcccttactaaggccacaggaggcacccaggaagaagggcagcaggtaatatgcaaacacccagggcagagggtgcattttctggcttagccggaggaggcgaatggagatttggagagataggtctcttgagtcccgatgaaggggtcaggtctgggagggaggaataaaatgggccgacagctcttggattcccaggctggggatcccagagtgcagtcaccgggaggagaagagtaggagaaagggaaaatcggtgtggcttactcatttatttaggcaaaaccatcagccaggcgcagaatgcttgggtgcatatgtgggtatgagggtaggtatgaggtgcaaggccccacccatgcatcgaggttctctcgcctgccagcccctgcccctgccctttcctcaaggctgggcccctcctcccgtgcttttcctgcctcttccccccaccccgcgcctcagcctcagccaggagccgcgcacgcagctactcactcttcctgtgcctcaggactctcacttctagggaccaagaggagagaagtgacagcggagttaggagggaaagggggccaggatgagactgggatagcaggggacagggagcgggccagggagagcaggaggggggaagtggagaagagaggaggagcatttctgcccatctgaccctggctcaggctgctctggggccccatgagggtggtccatcgagttcctggtttggctggtgcccctgagggctgggcagggcagggccaccagtggctctagcccccagcaagggcctccaccttggcactgggttggggtagggcacccagccctggctgtgctgggtgggggtgtctggggaagcccagagtatatttttctctgcccttagcttcagccctgctgcagactgtggagggaaggagaaggaggctcggcaggtgctggacatgcttccatgggctctggtctgcaggggctggggctccataggaaccatagggggacaagctctgctctgcactcctagtcagggagatgaagctttgaggggtgccactaagcatgatctctgccctgagtggctgggtgatgaaggcaccccagccaggctgggatgggagcaccacatctaggcaccctgtcctgggccttctaggtgtcctggcagggggacactgtcccaccctacagaaaagaagcccaggaatcctgcgccagtctagctcttaaaaaggatgcctagggaagtcaccggggagggagggggaaacatggtgggtcacagctttgcccccatagccaggctctggctggcccagggcccctggcaggaactggctaggaagagttcctggcatatctaagaaggcttcaggtctgtgctgcttggaaagacaagagaaagacgtggagagaggaagagaggctcaggatagacaggggcagggggaagggtggccagctgcggggcctctctgaagctggttcgacttcaagtgtccctccagtaccagctcatcagaaacaccagcaccagctcatgggaaacaccagcgccagagctggaaggccctttctagcccgtgggaggcaggcccagagaggggaggggacttgtccaggccacacagctagagggtgggaggcaggcccagactggggaagggacttgccccaggctgtgcagcccggtcctgctttggcaggacctcaagcaacccagagccctctcttagggtcaagtactcaatgcggtaggggtggccggaagaccatgtagaagaggaaggacccgggcagtgacagctggggagggggtggtgtctagatttccctcccctttcagggctagcgccgccccccacccctcaacctgcccctactcactgccggtgggcgaggaggagcggcgctgcccgcagccagggccagcgccctcgaggggcagaggcgggaccggcggcggcgaactcgcggcctcgggcaggggcggcggcggcggcggcggcggcagctgctgctccctggacgccttggggtccgcggcgcagccgttaggcacgtggttcccagggagttccgcctgcggggatgaaggtgggggctcacctcccagcttagggagaggctgaggggtctgggtcacatctggccgggggcgcgtgcagagccgcggtcaggtgtggcagagcagttggggcccacgtagcatccgcgacggctgcgccgcctgcgggggagcggaggggccttcgagcgagccgcgggcggcagggccgaggcgcgggcagccggcgggcgcgggctggcgggcacgcacctcctcgcggtgcgccatgcccgggcgtgcgaccagcgtctcgccggggcagcggcccagctgccggtagtagtcccccgtgctgggctgcttgctgaaagcgcggggcttgcggctggagtcctgcctccgtagcccgtcgtggccgtcgcaggagctcggctgcgggaagacagtgaccggtggggctcgggcaagtgcccggtaggcgccccccacgcctccccacccagctcttcacctcctgggaactcgcggccagcggccgtcggggggtgcagcagccgacttcctagaccccctgttctcacggtgggcagcgggcgaggttcatgggggcctcggtggaagggcaggctccgcccgccttacagggaggggttctgggcaccggccaaggggcacagggtcccccactgaggccagaaggggcgggcccaggggcgggccggcccagccccgacgccagggggagctagagaaggggcacctcccagcttagccttcactaggccctcggccgcactccgctctcggctgtcagaaggactgcgggtccccagggctccgcggagccctgtctttcgggggtcccgggccggagggagccccctccagagcctgtgctctccgaggctccggcttgccccggaccccgcttgtccgtctaggggctgctccaacctgccacggtgctggtggtcctgctgtgcacctggcggcgggggcggcaggacccgacacctgctttacgtgatacttcctctcaggttacagacgcccgcgcacggccagcctatgggctccgacggcctgacatcacccggggcccgccaatcccaggccgaaccccccccagccgtcgcggatgccacgggggcgccaactactctgccacacctggccgcggctctgcacccgccccgggccagatgtgaccccgccccctgcgcctctccctaagctgggagctgagcccccaccttcatccccgcccgagaggagagagggctgaccgtgggcagagggggcctctcatatttggctgccggctccgggtcgcgtccccaccgtttccctcctgcatctggaaaccatcgccatccacgaaagcgacaccgacacccgcgctcaagcctcggatttcaggggccgtaaggcggggtcgggtgacagcgcggcttcccgccccgtcgcagctgcccccaactaggcccagctcagtgagggagagtgaggcggccgggccaaagactgagtgaccgggtgggggctgtcccctgccccactctccagcccatgcgtccctgcggtggcctcagacccttcaccccgcccgacctggctcacgttgcaggaaacgcgacaccgcaggattcgttttctgggccagcccgccggctccgcgccccctgcagcccggaggctccgacgccacgaccctgctcccacctgcggtcaggcacccgcgcgggaggcgccgcggcgacacaaagagccctttgtagagcttcccggcccgggccctggcgtctgcggcccagcacgcacacagccgggagggacgcacacagccgggagggggctcgcacagccaggaggtgacctcacagacctggcacttgggctcagcggtggagagggggcactggctgggccacctgtcctgtggatttgggcggggcccacagtctgcgccgggagctcaacgattccagggcccctgcagccctacccgcccggccccctctgcctcccagagatgaaaggggaaagccactgtgggagcttggtctaaggtggcgtgaagagggcagctactggagctggcctgcaggtttggtgtccctcccatgcctcccttgcccactggccttgtgacctgagtcaccttgtatgaattggccctggggtggctttgccttgggcttaagagagaactgcaaggtcccaggctccagcaggaccccagggagctgccacaccacatctggccacctgtgacctcaggctgtcccctcacctcttagaccatccttgctctgttcctgtggccagaacgccagtgttccccagggcaccctgccgaggatacccgcaattgctcagaccagacctctgccccaatccctgctccagagcctcagccaggcgcctgcaggccccagacatccctaggcacctcacacttcacctacccaccctgccctcatcctctccacacaggctcgcttccctccagggctcccagctcaggcctggccctttcccccaggagctcaagccctaaactggaaccagccacagcttcacttcctcccagcccctactgccggtgggcgcccagccctgctagtgcctgctcaccttcctccctccctccttccagcccttacctctacagccatgccactggcaccttccacctggcagccacctcccttgggtgacactctccgactgagcctggggctgtgggggtgggggggcatgcttggggaggggcagtctccatgcattctctgtcaactccatgacaacccggccactcctgtgcaagaggtggcacaggcccagttcctggtgaggaacagctgtctggacctgcgtccttcaccccccagctcccatggagggcagtgacctgctcttactctcctcccagtccagtgtccagccctgacccctcgtgggactcgccaggagctttgactcttgaatatgccatggacccagggacccccaccctgtgcccactagtgaggccaggcctttggcctgactggcccccatcagcccagtacccctgctgggaggcaggcagtgggtgagggctcactacctccttcttgagggcctctgtctccacgtggcggagtttgttcttggtctgcatgtagatgtcagctgcctgtggtcccacaggaggcttgggagatgggtagctaggtgggggtgggggcagttgggtgcctgggggcgggggtggcggggggaagctgggtgggggtggtgggggtatgggcttcccaatcgtgccccaaggcaggcccagctctgggttcagcatgtccatgtagctctgtatgtctgcagctctagtgctggaaagccctggggaggcagaaggaagggccagatttggaagcatgcagacagcctttcccccaagaatgagactctccaccacctggaaacaacttgccgagggccaaggtgggctccgggcaccacttggtacacctgttgtggcccctggcgttgctgggcttcctctccctggccctgccctgccccagcccagcacttattgggggaagaccaggcactccggtttggaggggaagcactggaggctttggtgtgtctagagggcagggtcacctggaaggggagggtctactccttgggagtacagatggccacatccaatctttgcagggcaccctgccaggtctggaggccaccatctggtggcgtgaagcaggcattgcaagtggatggacgcccatgctcagggcacggtcagggtgtgtgtacacacaagcctgcagtctgccgaggcgattgtgaatttgtgtatgtttgagtgtgtacgcatttgtgcacatgcttctttgtattgatgaatgtgtgtgcattgctctgtggacatggtgtgtgtgtgtgtgcatatctgtagtatggaaatagagcattgtgtgcttgtgtgtaaggtgggtgtgtgcagatattagcatggctctgtatgtgtgttcatatctgtatgctgtgtgtacacatgtacaagtgtgtgcttttgtgtgtgagtagctaagaataatgaatggtgggtggcacacgtggattttgtgggtggggagagtacatgtggatgtacatgtatgtctgtgatgagcacacacaagtatgagtgacatctgtctctcaccagaaagggtgtcgcctccccatgtttaaaagcaagtgataagagtagtctccgatattggctgtggcaggctggcccaaggccaaccctcacagcccagcagtctggcttcagtctgctctccctccccctcttcctcctgggcacactcaccacgtggagggtgctggcccttgatgctggagtggctggaggagcaggagtcgtagttggagagggtgctggtgggcgagctgaggtcaaagttcagaggctggaccgacaccgtggtgttgggtgaggacatgcctgaatccggctgcttcgcctccagctccacggatggatcccgggagagcacgcagtgctccatgctctgaaggggaggcagggaggccatgaaggcaactgcaccccaagatgcgttgctctccaggccagggtcctactcagccatgcctttgccgtgggatcttggccaagccacacccctctctggggtctcttccccatcgctagagggtctttcaggttcctccgggttaagattcaagcccagccccgccaggcagaggacccaggttcctgggaaactccctcccctggctcctccctgattaggagggtggagagatcgacgaggagggggccttgagctgcaccccagggggagaactgccaggagatcggccttctccctcacagatcggcacaggctccatggggaagggcacagcacaggcccatccctagtgacctggctggcaagccagctctccttgccagacctgggacctggagcagactcccaacaccagcccggcctgtctcctgatggggcccttggggtaagggtagggcctggatggccagctgagcagtgatgggcagccagagctcaggctgccaggcctgccattcccccgccctgcccggtctgtgcgtctgaccacaggcctgtcccctcccggtgcagagggggctgtggtaggggccctgcttacattgcccatgctgcccctgctgccggcaagcccgcttgctccgctgcctcctgcccaggcctgctcctccttgccccgtgccccctccctacctaagaagtgtcacaggcaccctgggagagagaggcaggcctggcaccaggtaacggctcagcggccgcgctcattggccccgtaattaggggctctgctggagtgtttgccttttctgggccagcgtcttctgtggcttgggtctgtccctgcctcagctgggcctgcttgagtgaggggaccagggcacacacaccccacccattccaggggaccaggccctgttacctaccgcaggagtcaggggagccataggaggtggcatgggcagcacccaaaggtgctctttacctgggcaacagcagtgggtgctgagggcaccaagccctgacccctgtaggcagcagataagaggctgggccacagcaggtgtactgcgcctggcctgagccacccagctctgcagtctgggactgtggcttcaaactttccctccccgacttactagctatttcaggcgagtcacctgtgctttttgtgcctatgtttctttatctgcaaatgggggtaacagcactacttgctctgctgagctccaggacatggcgcccagtaaatgccatactgtcaaatttttttttttttttttttagacggagttttgttcttgttgcccaggctggagtacagtggcgcggtcttggctcagtgcaacctccacctcctgagttcaagcaattctcctgcctcagcctcccaagtagttggaattaaaggcacccgccaccacacccagctaatttttgtatatttagtagagatggggtttcatcatgttgaccaggctggtctcgaaccctgacttcaggtgatccacccgcctcagcttctcaaagtgcaggcatgagccaccacacccggcctgtcaacttttttattttattttattttatttttagacggagtcttgctctgtcaccaggctggagtgcagtggcgcggtcttggcttactgcaacctccgcctcctgggttcaagcgattctcctgcctcagcctcccgagtagctgggactacaggcgtgtgctaccacacctgactaatttttttttttttttgtagttttagtagatacggggtttcaccatgttggccaggatggtcttgatctactgacctcgtgatctgcccgcctcggcctcccaaagtgctgggattacaggcatgagccaccgcgcctggcctgagccactgcacccagccaactatttttttaatgtactgtgaagagtaactgagattacacctttaaggcactcggcagggtacctgcctaagtcagaatccaatgaatagtgtttgctgtcctatgaccactagcagctgcatccagacaggccctcaggtgccctgggctctggtgccaccccccatggtccctcgacagagtcacaggctctcttaactgatggggacccaccactgatgcagaaatgtccttccctgtgtccatcccggcttatataccctagtgacagagtgctgactacctgctgggccattcattctcttccagagactctttctcggggggaagttcaccctcaggcccacctgcagcctctggcctctgggccttgctgtgttctgcagcccccagagccaggaccatccccctgtgctggcagggacgacagatggacagacggtgctcagggcacagaccatctgccttcttccctccgggcctcatttcacagccactccatggccaggctgccccatggagttggtccgcatccttttggggttggctgtgaggcccactctcttccctgcctattgcctcaaagcaggcattgtaccagatggtgcagagccctcacttggagacatccacagctgagttcaagtcccagtaggtcacttcgtggctgtctcaccataaaaacataatttaaaaagagtagcatgggtttccagttatgacccagccatgaagtcagctaatatatggtgcaggggcagagaggtggctcctggtcaggccatcaaggtaggttctccactctaccacttactggtgatgcgatcctggtgccccgcagactccctttacccatatgtggaacgggacacttacactctcttctgcagagggtggctgtgagttatacccaagctaatgtctatgggtaggtgaatgagcctgcctgttcccaatggggcctgtcttgtgatttctccagccttaccccttggggtgaccctgttcttccctgtcctctttccgttaacctttgtgcctctactccctcagtccccagcaggcagtggttctgggctgacaggtcgtgtggggtagcgggcttcacgtctctgaacctcagcttcctccttggtaaaaggggtgacgacacccaccactggggtggaggggcgagaagagagaatgcaacaggagcagcgcagggatcgtaccaggttctccaccgtgcgcaggcagtgggtgcagtggctgtggccgttgaagtccgacaggtcagcggccgcgtacccgtcgcggtcgcggacttccagctccgcgccgttcactaccaggatctggcagcactgtgggggcacgcagtgaggacccggccgcggccacgagctgggacccccgcgcccgggcagggccgtgcggagagcgcggtgccagcagagggcgcgcgcccccaccccgggcccgcgctgacctctagctccccgttctcggcggcgtcgtacagcgcggtcccgccccacaggtcagccgagatctccccgccgtgcagcagcagccagctgagcaccttgctgtggccgcggctcgccgcgaagtgcgtggcggtggcgccgtctttgtcctgctccgacaggctcacgtcggtgcagctcacctgggcgggaggggcggggagagagggccgggggatgggggccaggcccctgcaggccccgcccacggtcctccgccccactcctgatggccccgctccctccactccccgccctgccggctccgccccgtctcccctccgcaccgcccgggcccggagctcaccaaccacacgatgaccgggctgtggcccatctgcgccgcggcgtgcagtggggtcatgccgtcgtgggcgcgcgcgtgcgggtccgcgccgcattcctgcaccaggtactgcgtcacctccaggtggccctcctggcacgccaggtacaggggcgtggcaccgttcttggtttgggcattcactcccctgcggagacacagcgcccaccgtgggctttcagcgcctcaccccctccgaggcctccttacccgcccccctcccctcccggggagccctggacggcagggagagtgggcgggagagggccctgtcaccggcccgctgccgcccggggggctccgcctggactgagtcctgagccaccctccctcagaggcccctgagggcgtcccacccagcactgccctgccctcagtcccacttttttttttttttttttttttttgagaagaagtctagctctgtcgcccaggctggagtgcagtggctggatcttggctcactgcaatctctgcctcccgggttcaagcgattcttctgcttcagcctcctgagtagctgggattacaggcatgcgccaccacgccccgctaatcttttgtatttttagtagagacggggtttcaccatgttgaccaggctggtctcgaacttctgaccttgtgatccgcccgcctcggcctcccaaagtgctgggattacagagccaccgcgcccagcctcagtcccactttttaaccgaggtctacaaagatgtggtgagctggcctttcctcccctctcgcccactgtcaccatgagtccccacaactgctgtgtctgacctctatccctttcatcgtgtgccccctccatctggaatgtccttccatcctcctccctcttgaagactcagtacccatccctcctccatgagggccaccctgatttatttcccccttgctggcctccgccccacactgcccagggccactatgagcatgacctgtcatgcttggttgaccataactgattttgacctttgcctcccccagaagactgagttcccagcgggcagggtggtaagggttgccagacaaaatgcagttcacacagttcaaccggaatttcggatgaacggataatgctttagtattctatatcccaaatattgcatgggacatacttatactaaaatacaacttttttatctgagattcaaagctagtcaaacatcccgggttttgttgttgctgtttttgttaatctggcagccctcgggatgtccactatgtactgaatgcttctgctgtgctagctctgggctacggcactggcaagcaggttcttctttttttatttttatttttgagacggagtctttctctgtcatccaggctggaatgcaatggcgcaatctcagctcactgcaccctctgcctcctgggttcaagccattctcctgcctgagcctcccaaacagctgggactacaggcatgtgccaccacgcctggctaattttcgtatttttagcagaaacccagttttgccatcttggccaggctggtctcaaactcctgagctcaagtgatccgcctgtctcggcctcccaaagtgctgggattacaggtgtgagccactgcgcccggccatcaactattactgtgaccatcaactgagattacaccggtaaggcacctagcaggggacctgccagaatcagaattcagtcaatggtgcagctacagctggggaggctcacaggtggggctgggactctgtgccatcacccatagtcccacaacagaggcacagactcagctctctcctcggtcacacagttggtaagtggcacttgaacacccatctgtctgtgcatgcagggcctggctggcaatatgggcatgcagggagtgaagagatggaatgtgtctcaggggctcctcctagggcctagttttcggctgtcactgtcccttatccttgctctgccagcccagagggggcctacctagggaacagcagggctgtcctggctgctgggctgttgggtgtgaacagcccagggtgcagttgccaccaaaggacactaggtggagccacaacctacccccagacccaggagaagttccaggttgggggccacgacctattgggttccagttcaccttttgtgcctaggaggccaattcctcacaggacttgacatcctgcccatctacctcccccagtctttcaccccgtagatcaaccacatgctccaccctgcattcatccctcgttcacccatccaactgcccatccacttgttgcctgcccatcaacgtgcaccaggctacccccctttgcccacccaccctcttgttcccaacacgactcagcccctcttctgacccctgtcacgtgtgccctctccctccctctcacacacatcctgagcccctcccagctggcatctccctgtccctaaagccctggttctctgtccacttccctgactcctgagaccccaaggctgactctgactgagacccctgactctgcagcccccatggacccccactcactgatttctcctccctccccactccctagacacagggctgccatttgctggggctgatgctgagccgggcacttcatgatggtgcggggagcaggcaccatgcctggtgatccagagggggtcccgtcaacacagatgagggagacagaagacccagctacgtatctatcttcagaaacatgctggctcgtggctgccagcctccacaccccagcgccagcgtcacccccacacacactcacatactgctgcatcagaacaggctgttgaatatttcatgaccgacgctcagcggcctaaattattcaccccgtaaccaaggcacagtgagtgccggggtctttgggatcaggggctggtgggggcccactgggttctttctgcagaggcccacggcggtgtacacagcgggtggggggccagacctgcagtgagctctgctctctcagcactccctacttggcagagatccatgacccaggggtgcccagccagccagagaaggtctgagaagctggcatcaagcaggatctgagcagcagggggaagtggtacccacggcctcctgcagggccgctggctggcactcccagcccaagttcctggcacggaatgagccctcagtaagtgctggagctcatcaccattctcattagtattccaccatctgcactcatgcgccccattatggagtcagagcctccagcttggaataccccagaacatgaggcagatatgctgttgggctgggtgggaaggggtcctggctcaacatccccttccaccttggcctgaggacaagaagaacaatgggcactctcacagtcactggggagtattacaaagatatggatgagcataaggaccaaaatgaaattcccatcacacacctggaatccaagcacctcgggaggccaaagcaggaggactgcctgagcctaggagttcgagaccagcctgggcaacatagagagacctccgtctctacaaacaatacaaaaatgagccaggtgtgttggtgcacacctgtagtcccagccactcaggaggctgaggagggaggatcacttgagtccaagaagttgaggctgcagggaactatgatcataccgctgcactccagcctgggtgtcagagcaagagcctatctctaaaataaataaataaatgagaaaataaacaaaattcccatcactagagagaggaattaataaaagtaataatagtaaataataataatagtgatagcagccaccatttactgaatgattactctgtctcaagcactgtgatgagtacaacacacacgttctctcagctggtctttgtaacaaccccacaggacaggtgttagcattgttcttctggtacagatgaggaaactgaggcacagagagctaagatcactctgtgagaaagaggcagagccccgatttgaggctgtgtctgatgcagagcctgcttctgactccaaatgtgccacgtctacaccccttctgctcttggtcggtctgtccctctgcctccctccctccctcccactgcacagaccactgcccttccccacagacctcactgctgggaactcaggaacactctttgacagctgctggggcacagccccgcaggaggacctggctcgagtcccgtgcctttgagctgtgccacagtcttgcttcttgtctctttgtgttcccaaacccatccatgaaatgggggcaacagttgtcatcctgacctcgtgcagagtgcctgagaagtgcctgcagagccctgagcacaggcctggtgcctggcgcacagccattgctgaactttaggatccttccctgtgcctgggaggaccagccaccaggggggtctatggctggcctggcctgtccgggtcctgccaagtacgggccaggctgggcatcatttctgctgtggggaacactacctagaggggagaggatgggtcttgggggagacctctgactcccagacccttgccagctctagccctgaccacagtgacagctgcagaaaagtgctcccagaccaagcccttgccctttgccccggctttgacccaaaccctctttgtaggtcagaggcgccctggcgatgatcgtataaatcatgatttgttttctttctcctgggaacaaagatgctatggatgaactgtaactattcatcaagtcacctctgattacacaaaagaaacatgggtcccccgtgtgggctgtgggaatctctggcggagactggtgccagctgactgccagcaccgccgcagggagtgagctgcccatggagccagagtcgggctgcagaatgattcccgcagcccgccccactgccagtcacgcctccccagagggaggccaggaagaggctgtccctccgaggatcagtctggttgtggcccgtgactgctttcaattgaaattcacggagcctttggtggatctacggctctcggtgtcctccagtcaaacttcccggcctatgttaaaagattcccaagtaggcctggcccagggaagaaatgcagccccgatttgagaaaggttctacaccccagcccatcagctagcatggaatagttccagaagcctacagttgcctgcaactctcccagcctcccaggtcttcctcctggcccgtaattaggccaaatttgaccccccctgaggcctctacacctccccacatcactgccagttccaccatggcagggctgcgaggccgaccctcttttcattaggttctcagctctcctcccctcaaagatgcctggcttccctgacccctcaacttaaagaaccatccccatcgcttcctaccaaactcctcatttcactatatagcacttgccactcctgaattatcttgttctcctattcctcagacccatacatgcgtggatagaagaatgtgtggctgacgtgatgacaggccgggcagttgagtgcacccacttgctgtttgttgaatgaataaatatgagaagggacatccaggccaggagtaggggatgtctcttcactcatggccgcagcctggtagagcaggttagatccacttgccagataggctcggaaatgcccagaggggagttttgtctagggtcacatgcaatgagctgtaggcagagtggacaagtccctgggattccatgccccactcattcagcagatgtttactggagtcaggctctgggcatacagagccgggaagacaaagcccctggccttattagtcacggacagacgggatgaaaacacacatctgtctgtgtgatgcagggcccagccagaaatccgggcatgcagggagtgaagagatggaatgtgtctcaggggcttctcctaggggttagcttccggctgtcacgcaggatgcacacagaacgcaaagccaggcaaccatagggcggctgggaggccaggtgcagtggctcatgcctgtaatcccagcactttgggaggccgaggtgggcggatcacctgagttcaggagttcgagaccagcctggccaacatggtgaaaccccatctctactaataatacaaaaattagccaggtgtggtgccatatgcacctataatcctggctactcaggaggctaaggcaggagaatcacctgaacctgggaggtggaggttacagagagctgtgccactgcactcaagcctgggcaatagagcaagagtcgagtctcaaggaaaagggcagcagggaacaaggtcagcgggaaagtgagtgggcatcatgggcgcgggtgacaatttcagcgaggctcagggttggccttgctgaggtgaggtctgggcaaagacttgcaggaaggcagggagcaggcggggatctctgatccctgcagagggatcagcctctgtgaaggcaggggtgctggcctgttggaggggaccacagcccggaggagggacagcctctgggccattgtaaggaagtgagcagcattccctgtcagtggccagaagcctgtgacgggaggtgctcttttttttttgtgaaacggagtcttgctctgttgcccaggctggaatgcagtggcacaatctcagctcactgtaaccgctgcctcccaggttcaagtgattcttatgcctcagcctcccaagcagctgggactacaggcgggagccaccacacccggctaactatttttccccctgagatggagtcttgctctgtcgcccaggcttgagtgcagtggcgcaatcttggttcactgcaacctccgccttccgggttcaagcaattctcctgcctcagcctcctgagtagcgggattacagacacccaccaccatgcccagctaatttttgtattttttagtagagacggggtttcaccgtattggccaagctggtctcaagttcctgaccttgtgatccgcccgcctcagcttcccaaagtgctgggattacaggcatgaaccactgcaccagaccaggacttgcattgtcttttcttttcttttctttttcttttttgagacggagtcttgctctgtcgcccaggctggagtacagtggctcgatcttggctcactgcaagctccgcctcccgggttccagcaattctcctgcctcagcctcccgagttgctgggactacaggcacgtgccaccacacccggctaatttttgtattttttagtagagacggggtttctccatgttggccaggctggtctcgaactcctgacctcgtgttccgcccgcctcagcctcccaaagtgctgggattacaggtgtgagccaccacacccagcaggacttgtgttttcaaaggctgcgggtggacatggacgggtgaaggccagggcctttcaggcttactgaggacttccccttttccgttctgtagtgcacagcctcacagagccttgggcccagctgagcccaaggggttcaggtagcccccacgtgaggcagaaagggggtttctcagaagccctgggatgccccagcagcgtgctgcttacagagccccagggtccaaggctcagctctcccccttagaagggtagggcaggagcactagccccggttagatgacagctgggaccaggagctgctggtggagacacgagatggtctcctgctgtgaggggcttccccggactccaccaggcccttcctttcccagagcctccacgtgggtcagggagtcaaggacggcagccacctcctcagtgtggacacaggccccgcccccacgccctgcagccaggtgaactgacagacaccaggggtagatctggggctgctgataaaaaggaatgagcccccacggcctgtggcagaatcagggaccaccccaggcagagcctccagccttctaagggggagagttgagccctgggccctggggctctctaagctgagagttgctaggggcttcccaacaaactccctttctgtcccaggtgggggctgcctgaacccctgggccgtgggagcagccagactccgtgaagctttgcacaaaggaagggaaaaggggaagtctgcagtggacttgaaaggccctgagtgattaggacctggaccaggagtgggagagagacccagagaggaggtacagcctgctcaaggccacacagcaagccagtgatgaccacagctggtgaatcagcctctctaaaacaccatttctgtacctgtcagctccaccaggcagggacgcttgtctggttcaccagcatatcactggcatttagaatattgcctggcacatagaagatgctcaataaacattagttgaatgagtccatctgtaaaatgggctgattacatagctactgctcggggtggttgtgtgactcagatgacactgggtggtgccagacccctagaagatactcagcaccaggttctttttttctttcctttcttttctttccttcctttctttcattcgttccttttttttttttttttttttttggacagagtcttgctctgttgcccaggctggaatgcaatagcatgatctgggctcactgcaacctccgcctccctggttcaagcgattctcctgcctcagcctccctagtagctgggattacaagcatgtgccacctgtacaggcatagcccagccacacacccagctaatttttgtatttttggtagagacggggtttcaccatgttggtcaggctggtcttgaactcttgacctcaggtgatccacctgcctcagcctcccaaagtgctgggattacaggcgtgagccaccatacccagccccaggtactttccaatcccattccagtctagtctggtcaggggtaggggaggctttgggggaaggaggcacctgctgaagttgataacatctctgggctaactggttttccagcttgctgtgactggcagcacccacgagcccaggggaagagactggagcctcctcactccccagcctggaagctcaagcctcagggtcccagctgatccccagctccccgacccacacagccctgtccagctgctcaggccctgggacagccagaagcaggtgtgaggggggcagagtgagctcctgggccccaggaccctcctgggagggtggccactggccttggggccacctgctcttcgcccctcctcactctgccctgaatgggggtctggaccccttgttcccctccatcagccactggagctcctgctgggagggccaaccctcccaactcaatctccctgagacccagagcctgggacttgcccagcccagctcctgccagccccgtacctcccaactgagaggtcctttttctttttcttttttttccccacctggagatggagtttcactcttgttgcccaggttgtagtgcaatggcgcgatcttggctcactgcaacctccgtctgccgggttcaagcgattctcctgcctcagcctcctgagtggctgggattacaggcacgcgccaccacacccggctaattttgtatgagagatcccttttctacaagggctcagagggagggtcccacgtggcagcagccccgaggtcactgtgacaagtcctctgcttctgggaagacttggccccatgaacgggatagacagggaggtgtgggggatgtgcaggacattcctgcaatctcaagcactttctattataacaccccaaggtgtagccctggaattagctgagcctccccgaggctgtccagccttccagctcctctgcagcgtgtcacttccatgtctcatggccacccacagcccctccctgggcaggatcgagtttcccaccagcaggtccgggagcccttcctccctcagcactcacccacgcgccagcgagagagctgagccttgtgaataattcacagcaattcacagcaggccccagaggctcgcaagatcatgaagctgggccacctgggtgccctgattgggccctgtggcctggggcagctcaagcctctgccctacccagctcccagccttcatatccacagcctcggtgagcaggaatccctacccgcaagataggaggttaagtgggtaccccagcccccaaccccaattcccagctgctcttcctgcataagcccagcctggcaaccacagaaagacaccttcttatcagtcgagtcacatgctgctgtggggaacggagcccaagccctctgtccacctccctgagattcatggtgactcctggggggctggcagctcatcagtccaggccatctggccactgggtcggcaccagcgcccaatcacacacagcacctggcatggcctgggagggggtcagggttccccagccccggagccctggagggcgttccacagcacagccagtcttcctaacacctgggatccagcccacggagggatcgtggcttctcagtgaggaaggcttaggggccggcggtccccaccagcacttgcataaggcgggctcagcgtcttccagttcacacttgggccatattggtcccgccatcaggggcacctgcccctctcaagacctgtccttctcctctgcttgaagtgagggggtgggacaggtgcatcagaatcaccgccatgagggtggggacatgtcccaggtgtggctcccaggccccaacctggagagtctaactcaggaatctgggacagcctccaagaggtgttgacaggagccagttggaaccctctactcaagggtccctgggtccctcctagtctaaatcccactgactttgacatgatccaaaccctagtttgtttggaagtagtgaattcataccaaagcagccaccaagaaggcctggcagggctggttgtgaagcaccccttcctccgggtgctgcctgttgggtctcccactaaccaaaccagggagccccttcttagcaaggatggaaccaggcccagctcccttgtcctgggctgaggggaccactggagcccggcctggtgggtcctagggccaccctacatccacgccagtgtgcctgggcccaagaggctgcagctgtggctaccttgccacatggccatatggccagaactggcctccagcttgctccctggtggccaggggccctgcaggcacacccagaaactgaccagtggtggggacaggccagaccctctcacctcgtagctgctctcgtcctgaggctgggtccacattcacatttccatctcaggctcccacttagactaacgagggtcacccatcagagtaacccactccccgctcagacccctgtggcatctggcaccctaccctctcagacagggcctgggcagcttttcccaggatccctgcctccccaggcgcacctaagacctgagtctcttcctccctccccaagactcacacatgccacctgctctgttcgaccccccaccccacccgggggagctcccagaccactccccaggaggtttgggatccccatgcttcccttgatagtgggaatgggctgaggggccacaggagataacaagttgctttctggatggcctccagccaggggctctggggtcaggaggtggggtgggggttggggaggggcctttctcccttaactgcttggtaactaatggggttccctttctgcctgtttgactagggcctaggaggcgctcctgcccttgctgcccccaactccattctgaacagtcttgcaaatgagcacagcctgagccagagagagcccctgcggcagaagcagcccaaggggaacaggtgaccttggcctgtgtgcccagcctcccaggtccagctgcgtgcggccgggcagctgaggatgttgggagcacctgcttgcagggctctgggggcagccccagaaggggttttccaggaggggaagatttcatgttgagtgggagccatttctctggcctggccctctggccccaggatggctactggagggatcattgccctggagtgccagagaagtgtggaaaatcccaggcatcccccaaagccctggcccggcccacccagaggaccccttaagaggagtgatcttactcagggtagtgcctgacgagaagcctcagggaggggaagtctcctttggctgcagcgtagtggataggcagggcgcccatgtctgtggccgcggtgggatccccaccgccatgatgcaagagccagttcaccaccttggggtggccaaagcgggcagtcagatgcaagactgtgggaccagaattgtctttgtcctgtgggaggagagcgggttcaagtcctaaagcctgttgctgccccgcccctggcttgggccgctcccagactcccacaggcctggaaggtagctctgtgctctctgtcttccctggaagaattggccaggcctcactcagcagtggtttttttgggtcaagcggatcctgggtttgaatcctgcttctgtccttgggcaactaattggccctctctgaaccgtacgtagccaataggcagcaccgtgcagggttttcagaggctgcaggtcctgactgcgagctgcctacacgacaggcacctggttgtcatggcaggagactggctccaggcccagggccacagccctgactcccaggggctcagggaatgcctgaaggagtgacacagggttactgggctgagcagggccaggaagggtggctgtggggctgtaccaagctagcatcaggattggggggcagcccctgcatccaacacttgccccctctctctccacccttcctaggtgtcacgtgggaacagagacctccaccttggtgcgcctccagcaacccaacctcagtgccttagtcaggcaataagggccctggggactggtttgggtaggaaggacacaccaaatgagcaggaggaatttccccatagaggcgaagagaatccagagatggtgagggagaaaagcacataagaaattaaaaacaaatgcaaacaaacaaggttgaaacagggctggagggtgtgaatgtggtgattcttctcttcctgaggagacagggtcctgcgagttttgtcacaagtcaggaagctccatcagctctgcaacacctgagtcctggatggcgggagatgatggcttaagatatctgggcgcaaagcctgaggccctgcctgtaactccgactccctcaagggcagctgagagggaggactcagggcactggggaaagtcagcagacccagtcacagaattagaataaggtggagctacgcagggaagacaacaccaactatttcctttttcttattttattttattttatttatttattttttttgagatggagtctcgctctgtcgcccaggctggagtgaagtggtgcgatctcggctcactgcaagctccacctcctgggttcacgcctttctcctgcctcagcctcccgagtggctgggactacaggcacctgccaccgcgcctggataatttttttatttttgtatttttagtagagacggggtttcaccatgttagccaggatggtctcgatctcctgacctcatgatctgcccacctcagcctcccaaagtgctgagatcacaggcgtgagccaccgtgccctgccaacaccaactatttcattggcagtagaagaatcacactctgcagctactgagaggtggaggtgaagccaccctgccgagcagccaacctcactttttggttattatccttgtgccgatgctgccggacaaactctctctacaaatctcagcatgtggaagaaacagaggcaggaacaattgcccagcacctttctatttctcgaggacactcttgaagttattcatcaatgttttaattaaagcagatcttatcgcttttcctcaaatgggaacttgttcacttttagactttgttattgttcattttgggcttatctttggtcttttcctgtgctcttaaaagggtgcaaatcaaaatctgagttatgataatccacttatcatatgactaattacttcagtacaaggagttcctgcctgtctgtccaatatgaatcttactacgtcccaatgtcacattggcttcttttccttctcggtggcagcatttggagcttttacttaacttagggtcaatttcgacctctgaattttccacccctcccccacagctgttgctgggtcatgctgttttcttttatctctataaatattgtgacttgtaattgtcacttataaattcattctggctatactgaatcattcccccattatccaagtcatccaaatattcgatgtgcatttccacaaatcatgtagtggccccctgattggggatgatttgtagaattaattatatgctttagatctccattcaggtcttcaggtcaccaatacattaagcagagcagggccctgaacagcttatatggatcaacgattgacagagctgtcggggttgctgcaaagccactgactttttgctgttccccgtaacaaagtatgttcaaatctaggtcacaggtttgtggtagggtcgattcacagtatacatgtgcaacggcgttcagtagcatagcagttgaggttgtgaagacatgtgcacccaggtcaaagaagaaagatccttagacaaagccgctcaattcccaggcacccaatcttccttgggctttgtgaacctgagatttgacaggctcttgggaatgtctgtctctaagactctgttggcaggcttaatcaggctggtggccatctccatatgtgcccccccagcatttgtgacaaaataagggaagggggacccaataaagctacttctgaaagcttatgatcccacccctcatttaaactatgtgatgttgtcattctatataaactctttccaagtaacttaactaaaacacactttgccattagtcttgagtgtgggcacagcattattcttttctaggccttaagggttccttctgcttaaaaataatgtctaactttcatgaagtttacccatgattaaagtgccttctgaatatatattatcttgttctattggtttcaatatacctattttctttaaaaagaaaaaaatgatgaaccatgagtgttaacaccagaaaaaccttaaggtacatctgatctaatttcccactttaaagtgagaaaatcaaacagtgcctaggggtttgatttttccccaggctaattcgggttttcatatttccatctcaaagtggactttctttggctaactttaagttttaaacgtaaaggcctgaaaagtaactcaggatctagctttttcattagttttgatcgtgtatgaaagcaaatatttctttcccccaaatgaaaccccagggcttccagtatttgtagtgatagtgtgaatccattaggtctatttttaattatatctctcttattggttatttttttcacatttcctaactcatttgtgatattgcttccatataattcaactttttgtgcgctgggttcccatttgccccacaaaggcctatgtgcaaatctgatatcctgtttgaatgacattgttttgtttttaccttattgcttcctatctttcacaacaatgttgtcagttctcaacattaaggcattaaaaattagcttttctcaaatgctcagcatcattaatcattagggaaatgcaaattaaaaccataatgaatatcatctcacacctgttagagtggcatttgtcaaaaaggtgaatgatgtgttagacataatgcagagaaaagggaacacacacattgtgaataggtatgtaaattagtacagctggtgtggaaaacagtatggagtttcctcaaaaaactaaaaatagaatctaccctatgatccaggaaccctatttctgggtacatatccaagagaagcttcagagagtgctttgttgggttttctggaacccggcagggctcaggtgtgtggggatgcgctctgtgagcctgtgtttcctccgccgtgagggctcctcccgctcctgtaggaaaaggcagtgcccattttgtcttgtccatgtgggactccaaagggtccagacgcgacagaaaggcggcgaatcctctcagagtgggcaggggaggagatgatagaatatggggaggagatagaatatgggaatggggcagtagaggggtgggatttcatgaaatttcctgattcaaggctatcatgaagtaggcctctttgggagctcggccctccagtcgctggtgagggtaacatcccaccagtctctggtgaggtccagtcgcctccgccgactgcattgaaagccaaaagcagaactaggccagcaccgcggcctggcgtccagtgacccagcggtctgcatattccccagggtggaagcactcggacttcaggtttgaaggcaatgcggtcaccactgcaataagaaaagcaactagggaaaatggcaccttcttctccaaacttttgagacactcttgctctgtcgtccaggctggagtgcagtggcacgatctcggctcactgcgacctctgcctcccgggttcaagcgattctcctgcctcggcctcccaagaagctaatttttggcatagagagagagaggggggaagggggggggagagagattgattttaatgtcttcaagcaaaaagagactctttctgcctgttggccatctgctgccaggtgaacgtgaaaatccatcgagacgctttctgtgaaaaccgcctttatctctttgtccctcttaggttaaaatccgcactccaaaaccttattgaacagaaaaattacaaaaagcacatataagacgtttcagttttgtaaagggtaaaatgaaactgcccttcaggaagaatcagaagaccgacgagggagagaggagcgatcgtgaaatctaagtgggctgcccccgggtcttccagggttttgtactcggtggcttggcctgagttgatgtgcccatattttcaaacagccaagtgccctgagacacagcctttgctacggtacctgctgaaatctggaagtgtgattaactattacttaaattgagtggggcagactaagagacagcagcagtgaaggatgccctttgggagaaagacgtcgaggcgctgaggccaaagggtccgtgaggaaagagcccgcagctcgcgcccctcggcctgcggaagggagggcaaggagggtcctacggttcctgggaggacgcgaagagccaagagctctgacagctggcgccggggaaaaggccccgaggcggggtccgcatccctggaagggcggcgtccacactcctgcgaggcacggggcgcccggggctcggaagctcaaagcccgccggcttctgcagcttctggagcttctgggagccaagagtgtcagccggaaggatcccgcacacggcgcttagttctggaactggatacccgggggaggatgcgggatcccgaagcccgggtgtgggtccccgtggtcttcgtgttgggggtaggtgcggaacgctaagcctgggcctactgggagccatagtcttcttgatggctggtgcttattgggcttttttcagtcgaatttcaaaatgcagttgaatttcttactttggaaacgataatagaaatggctgacctcagattttcatgattatgttttgccttttccagtgtatgtgcagtttctgtagtatagtggttatcatgtttgcctcacatgtgaaagacccttggctcgagactggagggaaacatggttttttggtttttctttttgtccctaaatttagtgagtttaatcgaggttgggaaacaaacagaaaagtagttgaacctgtggctacactttagacctcctcaatctagacagattgttgaccaggctacagtttccactggtctgccagcaagaggcctgcttaatgttagctttggttccagaaattccttaagattctcttcattctcttctgtcgcctgaattttcataggctgacactgaaagtggatgacatcttaatgcatttcctaagtgtcccgctgggcttcgctttactctgataagttgcagatctggctgatttgcgagacaaaaacaaaatatttttttaaaagattctaaatctgcatctggaacttgtagagtcaataatctgaaaccacacgaattatctacatacaaaagattttgaatgcataccccttccccaaataatcctcagaaaaccggttaagttttagcatctatgactctgagatgcatatgaggcctttgtaaatttagaagttgagagtagaaagtacaggtttgtattttagaaggagatttgggaataaatatagctctggtggatatagatcatatgttaaggtttgttggccagagctggtgtgtgtcttgggtgttgggcaaagaacagagaacagccaaagctctgcgaggtcaatgtgaagggtgatttccttggtgggctcaagtttatgacgcagcctggacctagcttggcttctcagctagagaagaagcatgattccatgtcacagctcctgtctttgaaaaagtcataatgactcccagacccaacatgtggggaaaactctggatttgtctcttcagttgaatgtctccgttgaaaattgaggaaagaaatctctctactatttgaacttcatcaaaagactaatatgttaatattttgaccgtcaatatttccttaaactagtctactcctttcatagctaatacatcaaagcatattaacttaggaaatgggattctcccaaacaaggaaacattgacggcaagggttcttaatcttttcacaccacatttccttcaaatgctttatacatcttcaagcagacaaataatagtattataatgattacgagaccgatcattactcttttgccaaaaaaaccagcgacaaaagactaacttagtggaccaacctttgtttcttcattatctgtacattgattctgtccttttatttcgtctttcttctaattctgcttctgcttcttgtttcctccctggatttgaactttatttacctaaactaccagttaggttaccttctcagaacctctaaggcagcagtttgagattgacaatggaagatttaagattagaaaaaagaaacatgaatgaatttctgatgttttattataggggtttataatgcaggtagaaagacctttttcagacttaagagtttgatccaccaaatgagctattttgatatttataactttgtctagtaaaagtttcctataaaaacatttggtttggatatgtttgttagcttttagtcgacacttgaaaaaggcggttggaaggttctaagtctttttggatactcttttctcttatcccccaggccgtgggtgtgtagaggccttggtggtgcagtggtagaattctcgcctcccacgtgggagacccgggttcaattcccggccaatgcagcaggtacttcttcatttcattatggccttttacccgtcttttacgctgcaaaattatactgcataacctaatagtgcatttaggggcttggccaccacaaggtaaagtgacaacattactcacgagagtagcggcaagagacattcaggacactaacccaggacccatgcaattgttggactcaaacagcttagcaaagtggcaagcacgaagtctttccggtgagtcactgcagttttgatattggtacctgttactttcatctattcacggggcggatccctgcaaacccgaagaatcatcaggttcctgattcgcgtgctggaccttgggcttactgctgagccactgtagagaggatcaagaaatgacgctcttggaaggagagaagctgcgggcaggacagtcacgtcagaggtccaagaggcttcagcggcccaaagaaagggaaggtgtgtggggaagaatctgcgtggagatgaggggagcggcggggactggtccttgcgcagaggtggccagtggaccctcagggctgtaccccagacaccgtgaaccgaatttgctcacatcgtcagcggccgcggcctccgcgtgctttgtgggcccatcggtgttctgcgagggattccgtgtgtctggcaatgtctgtcaacaggtgttggcctgaaatttggccgggcacgttggctcatgcctgtaatcccagcactgtgtgaggccgaggcggatggatcgcttgaggtcaagagttcaagaccagcctggctaacatggaaaaatcccgtctctactaaaaatacaaaaattagccgaatgtggtggcatgcacctgctattccggctacttgggaggctgaggcaggagaatcgcttgaacccaggaggcagaggttgcagtgagccaagattgcgctactgcactccacctgggcgacagagcgagactgcgtcaaaaaaaaaaaaaaaaagcagcgaaagaaggcagagatgtcaatgggacaaagagacctcccaggaggcttgttgtagaggcagtgggtggatcctgggagatgagatttttttaaaattatgtagcagaatggggagagaaacggagaagcgcatgaaagagagaaaagcacgaaaatcggcggcgtccaagaataaagcagataaaatagtgtgagtgtttttacattcaaaaaatagaagaagtgcaatgcttgtcagcaggctttgtggtcgtgtagtggttaatacttgtagttgtggttgccacaacctgggttctaatctgagtcacagtagtgttttctagcctgcgattgtggctaatagacctgtcgtttgctttgcctttaatcctagcagcctccagagagcagagtaaacctctggccccgaagggcgccagcttctggagtttagcccacagcgcagaaactagggggcggcctggccgataggaaaacttggacatgctctttgtctcacaattgagcaggaaaaattcccgtaggtgaagatgccgcctctcaagggccctttgtctgtagcttccactggtgaaataatgcggttatagtctttttcggtagagaaaacggctgtatcagtggaattttttaaaaacacaaaacgagaacgagtttttaatgagctgacaataaaatctaaactagttgtcatggtctgcacaggcttgcctccattccccatctgctaatttttatgagaacagtaaattattactattatcattatttttgagacgtagtcttgttctgtcacccaggctggagtgccgtggctcaatctcggctcactgcaacctgtgtctccgaggttcaagcaatgagaacagtaaagaagctacagttcacataaagtgcacaaatctttagtgcaatttgtttagttttgatcaatgttatcaccacccagctcaagttatagaaaattgccatcatctgagaaaggcctgttagagcccctgtccaggtgattcccaccctgtgtcctcttagttatcactattctgatgtctattcccacaggttacaattgcctgttcttaaagttcacatgagtgaatgtacatatgttttgtgtctggcctttttctccagttacattcattatactcatgagatatatccacgtagtttcatagatcacttctcaattttggggttattgatttcttgtgctgaatattcttataacagtctttgtgtgcacttgagattcatggaagtccttcaattgctgggtcatgacctgagtataagtttaacatcagtataaattgccagtcttctagaatgctttttcgccagcgatgacagttgaagtggcaccaaattcttgtcagcatttggtgtactaactttgttaaatgtagctatgctctcagaccaggctggccaacatggcaaaaccctgtctctactcaaaatacaaaaattagctgggcatggtggcatgcacctgtagtcccagctactccggagggggatgttgcagtgagtcaagatcgcaccattgcactccagcttgcgtgacagaatgagaccctgtctcagaaaaaaaaaaaaagtagccatacactggtgagtggttagtgctatctcagtgtggaattaatttgtatttgcctaatgagcaatcctatgaagcatattttcttatggcttccagcatataagaaactctcctttgcaaaggcctattcgaatattttgccctattttatttggcttagctctatattactgacttacaaaagttctcttatatattcaagaattgagtcttgttttgacgttttttaaattatactttaagttttaaggtacatgtgcacaacgtgcaggtttgttacatatgtatacatgtgccatgttggtgtgctgcacccattaactcgtcatttacattaggtatatctcctgatgctatccctccccctccccccaccccacaacagtccccggtgtgtgatgttccccttcctgtgtccaagtgttctcattgttgaattcccacctatgagtgagaacatgcggtgtttggttttttgtccttgcgatagtttgctgagaatgatggtttccagcttcatccctgtccctacaaaggacatgaactcatcattttttatggttgcatagtattccatggtgtatatgtgccacattttcttaatccagtctatcattgtgggacatttgggttggttccaagtctatgctattgtgaatagtgccgcaataaacatacgtgtgcatgtgtctttatagcagcctgatttataatcctttgagtatatacccagtaatgggatggctgggtcaaatggtatttctagttctagatccctgaggaatcaccatactgacttccacaatggttgaactagtttacagtcccaccaacagtgtaaaagtgttcctatttctccacatcctccccaacacctgttgcttcctgactttttaatgatcaccattctaacaggtgtgagatggtatctcactgtggttttgatttgcatttccctgatggccactgatgatgaggattttttcatgtatcttttggctgcataaatgtcttcttttgagaagtgtctgttcatacccttcgcccacttgttgatggggttgtttgttcttttcttgtaaatttgtttgagttctttgtagattctgatgaaactacagatgagtagattgcaaaaattttctcccattctgtaggttgcctgttcactctaatgacagtttcttttgctgtgcagaagcccttaagtttaattagatcccatttgtcaattttggcttttgttgccattgctttcggtgttttagacatgaagtacttgcccatgcctatgtcctgaatggtattgcctaggttttcttctaggctttttatggttttaggtctgacatttaagtctttaatccatcttgaattaatttttgtataaggtgtaaggaaaggatccagtttcagctttcaacatatggctagccagttttcccagcaccatttattaaatagggaatcctttccccatttcttgtttttgtcaggtttgtcaaagatcagatagttgtagatgtgtggcattatttctgagggctctgttctcctccattggtctatatctctgttttggtaccagtaccatgctgttttggttactgtagccttgtagtatagtttgaagtcaggtagcgtgatgcctccagctttgttcttttggcttaggattgacatggcaatgcgggctcttttttggttccatatgaactttaaagtagttttttccaattctgtgaagaaagtcattggtagcttgatggggatggcatggaatctataaattaccttgggcagtatgaccattttcccgatagtgattcttcctacccatgagcgtggaatgttcttccatttgtttgtatcctgttttattttgttgagcagtgttttgtagttctccttgaagaggtccttcacatcccttgtaagttggattcctaggtattttattctctttgaagcaattgtgaatgggagttccctcatgatttggctctctgtttgtctgttattggtgtataagaatgcttgtgatctttgcacaagaattctgtatgctgaggagtcatttttaaaataaatatattgcaaatgacttttcccagtcagtgaaaagtctgactgaaagctgtcaactgaaaaatcacacaatttataaatttagaagggagattttattttttataaatggttacagcctgcaaggtggccattctgacagacagggaggcataccctcttgctgctgaaacctgaaaagtacgtttccagggaggggaggggggaacagggatttatgttgatgtggtgggccacatatacatattcaacagggaataggaggagctctgaatattcatgaagggatcctgctgcatgcatgctgagtaaacatgcctgttacatgcaacccatgttcattttggggtggagacaacatttaaatacattataattaggccctatgcttcaaaaggggaagcagggacacaaaggcagtcaagtgcacagcctctgtaaaccgtccagaacccgtccacagccagtgctctcttatcaaggggaagttactgaaatcagtctcttgtccaatcaaagctgtagttatggcttgtgtagggagggctcagtcagtttatggtaatgggtgagctgcaagtgcttcagcattgcttatctcaaggccagtgcttgtttagctagagaaaaaaaggaagaagaaaaaaacctgtggcaattggaacatagtttattctttaagttgaggggcgcatgactccaccttgcctggcgtggccttaggtctcgtttatcataccatatcttactactgcaaggagtctgttctgtcagtcttaggatctctattttaacaataatgctggtcagttgtgtctaaaccacaaagggagagagtataaggagaggtgtctgagattccaactactgggcaggaactcagtagttaagacttctctggggtctccttggccaagaaacagtctgtccagttggttgagtggctttggattttaattttagttctcaaagcatttaatttgatgaaattttgccatattttttctttatttttaaagcctgttatgttctataagaaatctttctactcaggatagtgaatgtattctcttaattttatctctctatgagttccagcgttttagttttaatttttaaattgatgacatctaaaattctactcctaaccaaaacattcctgggggtgaccaaggacaactccaaaaatcttccataaatggaagtaagacttactccttgaagaacttactgggatctgggcctgcagggcacagtggctttagtgcacctctgctcttacgactattcagaaattgtctttgtgaacccatcaggctgtttcaaaatcagcaatttagggcttgcttgcaacatgcagttatgcagcagctgttttgtggatctggtgagtgcctgcacgcatagttccccgggaattttctgaatttgaattctcatggtatttcaagtggctcagttgtctctttcttttcttttcttttcttttcttttctttttttttttttgagtcagagtcttgctctgtcacccaggctggagtgcagtggctggagtgcagtggcgcgatctcagatcactgcaagctccgcctcccgggttcacgccattctcctgcctctgcctccccagtagctgggactacaggcacccgccaccacgcccggctacttttttgtatttttagtagagacgaggttttaccgtggtcttcatctgacctcgtgatccgcccgcctcggtctcccaaagtgttgggattacaggcgtgagccaccgcgcccggccagttgtctctttcttttgcctactgccacacacgtaccaccaaatcctgcactccaagctgcttctacaccctggactcccaacctccagttagacaatccacatcttcccacacctgcctcaggctccatcaggctactgtgcctcctgcagcaaccaggccagggggaatctggattcctattacacttctgaggaaggtggtcagggagtgtggaggatgtgggtgggagggggtgaggttgagggcaggagtacactgtggtcttctgtcttctacctcattggcccaggtgctgctctccctccggttgtctgctttcagccctgcctgggaaatcaggccggcgccctgatcttcctgactctcattttgtgaggaacctgaacggatgagccatcgctcttgtcccacacgttctgtccaaaaggtgccctcctctctgcttgctcgggggcctgccctctgagctctggcactcaggctgggatgccgcccagtacagaggctctgcagccctgcaggggtctgactgttccacaccagcaggataaaggccacagggcatgctgtggtggaaaagcattcagaggtgtgggctgaaggcctctctttccacagtccctttgaagacaccatggaagtaggcacccccttgacagacaaggtggcccaaggcctggcttcacatgcaggctcttgggtcccagcgggtcctctctgtgcctggtatagccaactgcttcacgcatcttacccggtttcctctcctccacaacccaagctcctcctcgacccccttgctcagctgtcctcaggacagcaagatccccagcccttggaaaagcccatctctagtgcttggggagggagttgggttcaggtggtctaaccacagaagaacagagaacctgaggcaggaggaaatcccttcccttgctgggtctcttggcacagcccatccaggggtctgggtcagggtccaggtatactctaccctccttgaggacctgggttttcaggcccccgaggttggtcaatgtggagtctttcccactgttcatctgggaactgaaggaatatcccatggggccctctcttactcattagagacacccagaaaatactccatccagcagaaactgggtgcagtgtaccagaccactataattataattgcaggatgtggaggtcagatacgttttgtgggtattttctctctgtctgtggcttgcttgccttttcgctttcttagtggtatcttttgatgagaaggtgtggctaatgttgatgaagtctcatttatcatgtctttcttatatatgtattttttctgtgtcctgcttgttggtaggctaatctttgcctgccaacaagtcacaaagtatccttgaaatgctttatatctttaacttttaagttttggtgtgtaatgcggctgaaattacttttgtgtgtaacgtgagggagaataacattgttggtctccccacatccatatagaagttcattaattgaaatgatttattttcttttattgaactgcttttactgaaaacccatttattgaccgtatagctgtggatcaatttcaggttttctaactcaggctgtttatccgtttgtcactcttgatgccttgtgtctaatagcttatagtaaaccttaaagtcagatagtacaagtccttgttcttttccacacattgcaataaattttgaaatagataataactcatgaaaccatcacacacatcaggatatgctgtcacttcatccctttctgacatggtttggccgtgccctcacccaaatctcaacttgaattgtatctcccagaattcccatgtgttgtgggagggacttaggaggaggtaattgaatcatgggggcgggtctttcctgtgctattctcctgatagccagtaagtctcactatctgatgggtttctcaggggtttctgctttggcttcttcctcattttctcttgctgctgccttgtaagaagtgccttttgcctcccgccatgattctgaggcctccccagtcatatggaaatgtaagtccaattaaacctctttttggtcctggactctgttatgtatttgtcagcagcatgaaaacggactaatacactctcatttctgagtgggacacatgctgtcactcacatatgctggttgctgacttgtgacggaagattctctattgtaccctctggggacaatacatctccagttgcctgcggggaggatgaaccctcaagagtcaatgtgttgactgactctaaatatgggttcctggtgctccatgctcatgcagccatagggaaggaaaggggactatcaagagccaagggatcccccatacgactttactcagatcttggaacttttagatgctgtccaactcccaaagaaataacaattactcactgcaggggacaccagaagggagacacttttattattagaggaaattccctggtggaaagagcagctaaggccacaactaaggaaaccctggtatttcaagctgctgcgctactaccaggtactgcatccgtgtcagtgacaccatactatacccctaaggaaattaaagggactgagtaaaaggcttccagggagacccctctggatggttgctacaaaagaacaaactctattcctgaggctgacagatgggaaataattaaacattttcatgattcctcacatttgggacgggattttccattcaaattagtttcctaaatattcttcgggaagggactgttctaaactataaaaagggttaccactcaggaagccaccccataccccgatccctgcttaaacctgtacaacaccaaggaacataccatggtgaagactggcagacagacttaacccagatgccaccttacagggaactacaagatttgctagtatttatagacactttcaccaggtggatagaagctttccccacaaggacaggaaaagtactggaagtgtctaaattcttaaagaaatcattccaagatttggattaccaaaaggtttgcaaggtgacaactgacctcacttcacagctaaggtgacccagtgaggtcatgcctcagccttaggcattacctgtcttcattcctcatggagatctcagtcttcaaataacatagaaagccaatcgcgacattagcaaaactctttcagtttgggggcttgcctgccctgcgtcactatcattgtttccttgggtttcccaggaatgtacatgtgtgagactgccgccctgcttatagatctgtttccctgcaaggaaacaggaatatgttgcctgtggcttccagagttggagatacatgtagttgcaccactgagggctaacatttaattttggaatcaagtgatgcattcagactggttgctatcattctgtggtatatatttagtgaacacattcatgattgagtttcttgcttttagctggagcaagaaagttttataattgtgatttgtatgaaaaaatcataggcaagggaatggatgtaaaataaactttattgtcagaggtttctaaaggctcatccttcaaggaaaatggacatatgctgaagagctgataaactgtctacagcagtgttattctaacctaatcttgattccaagttcttgccattttcctccagctactgttgactccagttatatataggatgggggaaaggggattatctacgaatgtaggcatcactttctcttgggcagttatcacattggcagactgaagggaagtgatttctacaatcaaactatccatttggagtacaaatctggagtggctgtaaaattcggttctcagagatgaacttgcagattcggactttcaattgttctgttgttttagtttttctcatcaactggggaactgtttgtgactaagctttgttaaaagtagagaagagcttttcataattccaacattagttgttacctgaaacaaacaaaaacacacacagagacaattaaacagtaatctttggtgaggtcttgctgatacctgaggctggagtgagagctgagtggtgatacagctcatgtgcgtgatccagattgcgcactccttatgagactgtaactgatgcctgatgacctgaagtggaacagtttcatatggaaaacatccaccacccccttccatggaaaaattgtcttccatgaaaccagtccctggtgacaaaaaggttgaggacagccaaaaaggctgctttaaatgataaccttccccaaaactaaattacccctgtaaaatgaatgaaaggccaccaagttagaaggatgaaaggggcctgatttctactaagatgtatgcctcgttaaataattaccagccattattccagaagtcacaagattggcagcttccccaattactgctgtgaagaacatcactattgtagaacctaagattggcctcttgagatgtcttttcaggcttttgcatttctgactgctggaaggcaccatctggcccgaaaatcaaccagtcccttagcccccacccagaagctgactccatgcaggagggccattttccacgcccctgtgatttcatccccaacaatcagcaccacgcaagccctagccccctccccaccaaactatctttgaaaaaccccttacctccaagccttcagtgagattgctttgagtaataactctgtctcccacatgtcgtggctggcctgtgtcaatgaaaccgtttcctgcagtgccatggtctccatgaattgagtttttgtgtacattggtcaggaagaacccatcaggcggttacatctgcaggatggtgccagttctttccacaaaggctggtcagatacccagaaaacatttctccactactacctggacaatgtgtctccctgtcaatctccagggaatggggcctggatcaagtatttagtattcagcagttactacactgtcacctaatccctcattttcaatattttgccatgcttccagtggcctaactggccaccatgccacagaatctttactttatgatctccaaggagaactctccactcgatgttttgtgatttgagcaatggaatagaatctgatactggtgggctgggggaggtccctggacactggtgggatctcgaccccagccgtggtgtccaggctcttgacaccatcgtgagaacaaagtcaaagatgagtcagcagatagtgaaagaagagatttattgcaaagcaaaaagtacacactcaagaaaggggagcttgggcatacccaagagagaataatgggttctggggtttcatcttgatgggtttctttaaccaagaattggaatattcacgaaaattcctgggtaaaggtggagatttcttggaactgtggtgccatttttacatcaaacactggtctcagaactgtcatggcactggcgggtgtgtgatttagtatgttaatgagcatataatgagggcctaggtaaaacctccatccaatccagcaccacgttgggtccactcagccttagccagcttggtccacaccctggtttttcagcgtcttaacagcccacagcctcaagtcatgtaaatctgctgcctagaatttgttatcctgtgaccaccctgtagtattcctgtctgaaatctacttgtaaatattcaaatggtctttcacttgggcattccaactttgcttacttcacagtgtttcctgcgtaatatataagaaaagatgatccagacatttgttaaacatctcaaataagatgtagcccaggtatttgtgtcaaatttggattattttggtttcgtctttgcagaatataaaaaactaacatgaggtaagcactaaggtgtggagatggctgtgcaagagatgacaaagtccagcaccacgcttgagagtgtccaatcatctcttctgggacagcatatttttctacaatacggatttttgaaaaaaaaaacaacatcaaaaaaaaaaaaacctacaagattcatgaaactggacaactgtctttataacattaccagtgataaaaccagtaaggacggctggtttgcagtcatctaagcagcctctttactttcataaatatggtttctctctgatattaaacggcttccaattgcaagcggaatgctgcatcacaaggataaggatgtgaagagaaccggtttcttttgtaatccgaaacattctagtctgcgaattaaaagccattatttgaagaaggatgccccggctccatctggccaccgaaaggttgctccttaacacaggctaaggaccagcttctttgggagagaacagacgcaggggcgggagggaaaaagggagaggcagacgtcacttccccttggcggctctggcagcagattggtcggttgagtggcagaaaggcagacggggactgggcaaggcactgtcggtgacatcacggacagggcgacttctatgtagatgaggcagcgcagaggctgctgcttcgccacttgctgcttcgccacgaaggagttcccgtgccctgggagcgggttcaggaccgcggatcggaagtgagaatcccagctgtgtgtcagggctggaaagggctcgggagtgcgcggggcaagtgaccgtgtgtgtaaagagtgaggcgtatgaggctgtgtcggggcagagcccgaagatctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttcaaaaacagaccgtacgccaagggtcatgtcttttttcgtattggtttgtgtcttagttgttaatcctacagtggaggcctggggaataagaagtaacatgtggcctgcacgccataggagaaaaagcgagcatcagccgtatcggctttgtaacacaaattagctatcgtgaagtccgctcagctcttccatttctaccctggctgctttttgcagggattggtccgtggtctccagtctcttgggttctcaccctgtgtgaaaatcttcgtgtttttccctaccccccaagtcacctcttacacagcctctgcttccaagcgcagcccccacaggagtttgtaggatttctgtgctagcggggagtgtgttctcacctcatagagccaggtagaaattatgcagatgggcgctgttctctgggaagaaagcagggcctttggggctctcagtgtccccgttgggttgtagacataacactcttactttgcgtaggggaacggctctgccggcccccaggtgccctagcgcatatgcatggaggcccgcaggtcagaaccgcagtctcacctgtcttggcggaaatgccctgcgatcctcccggagatagaaggcgggaagttttatgaggagccggtccagtttccctactatctcctgcagttcatatatctagtgtttctttagactttaagcgactgcttcatgtttgatgtctcactcccacatcctacatccactgccagccaactttatagatagcaccgtgacccatccttcccacccccaagaagccctttcctatttctggtgccagtgtcctccccagtccctctttcttcaggccctcgcttatcaccttcatggacagaaaatacttagctctctctcaacctgaggtttacacctgacacgcatcagtgccctggcaaattccttaataccccttctcaaatggcactgtaaatcatctctttttaactcccagaactatctaattggttttgtccctgcactacatgaacactagtattccactacagaggaaaaccccaggcctagcgatagcggttctgggcattgtgccagcctctcccagggtatgttttctgacctcacctacttttgatcagctgaggtcaggagttcaagaccagcctgaccaacatggcaaaactccgtctctactaaaaacacatacacacgcacaataataataataatgataataataataattgccgggcgcagtggtgtgtgtctgtaatcccaactactcgggaggctgaggcaggagaatcgcttgaacccgggaggtggaggttactgtgagccgagatcgcgccattgcaccgcagcctgggcaacagagtaagactctgtctcaaaaagagaaaaaaaattagtgcatctgagacatattattggagacagtagaatcctgcgtccaacaggcacttggtgcagatctgaacccattgagctattggctcatgttccctatgttctattaagtatcatgagcagaaattgagctctttggcttttacccactgagtatggctataggacaggtctctctctctctctctctctctctctctctctctctttctctctcattctttgcatcattattttttgccatcagtgtgggtttttggttttgaggttatgaagtgaatttctggggacaatctctgttgggtcgtgttaacaaggatccagtccctgtttggtgatacatgacagctaatctggtctgtgagtcttctttattgtctatttattgtcctgagaataatggcatttcctgatatttgagactgcagcaatgataagttgttcagatcttgtctttccaatgtttggtaaacattttataggcccaatttttgtcaatatctgcaagagtggcatctctgttacaagagtgatcttactactcgatgtcccccctcccacccaacttcatttcctaggggctcttggctttaacgaatttactgtatctaaaagacatcttagtacaggaagaaaactaaatctgtagcatgtaaggagcagttttatttgattggtatattcaggtttctaaccagctgaaaaattcaaatacatgccctttaaggattaagtttaaaccacactacagaaagagaaaagatttatatgatcacatataagcaatggaatcagcaatatgagtacttttcacaactatacaaatcaaatttaataatctccagaacattaaggaagttcagcccttaatggaaatgaatgaaaagaaattattcacccactgttacatgccctggaaagagaatgtcctgccagactcaaaagagtatcacaatattactcagattttcagcaatgaaggccctccgaggatctaatgatgttcatattttcagtttatttccttcactgataaacattgttaatagataccattgcctctgtttgcactttaagtgatgttacttagaacaattcgtttctttagcatgcaccctagtttggtggaaggaattttccttcttttcaaatataggatattttctcatgaaacaaattggcatactctttcagtgaagtgaatagacaaattagatctctacaattgtaaaggagtcactgccccaattatcttaggaacaataataatcacttatataaaattaaaataagaaaattaagccaggtatggtggctcatagctacagtcccagcactttaagagttggagaccagcctgggcaacacagtgaaacccctgtctctacaaatttttaagtattagctaattttttaaagttggccgggcatgataatgcatgactgtaatctcaggctgcagtgaactatgattgtgccactgccctccagcctgagtgacagaatgagactcccaactcaaaaaaaaaaaaaaggaaagaaaattaagaatttgttgaaaattgttttactacaatgctaggctgcatgtcttgcacctgtactcccagcaactcaacaggctgaggcggaaggattgctttaggccagcagttggagaccagcctggggaacagggcatgacatcatctctaaaaaaatacaaggcaagctgagccaggaggattgcctgagcccagaagttccaagttggtcagctatgattgccccactgcactctagcctggataacagagcaagaccctgtgccttatttttaaatttatgttatttttttactacttatgcttatttatctatttatttatttttgagacagagtcttgctctgtagcccaggctagagtgcagtggtgccatctcagctcactgcaagctctgcctcccaggttgaagctatttccctgcctcagcctccagagtagctgggattataggcacacgccaccacgcccagctaatttttatatgtttagtagagacagggtttcatcatgtttgccaggctagtctcaaactcctgacctcaagtgatacacctgtctcggcctcccaaagtgctgggattacaggtgtgagccaactcgcccaggctccttatgcttgaaatgtgaggtttcattagggaaaaattttcttgttgaatttctaacatgaaaaaataatagatttagctgtagattaaattaatggtcctggtagtttggtacaataaaataaatgaagttgatagcagagaggaatctttgatgcttttgaacaatttaaataatgtaatattttttatataaagacatgaaaaagttcattacattattattatatttatttatttatttatttattttgagatgtagtctcactctgtcgcctaagctagagtgcagtggtgcaatctcggctcactgcaaccactgcttcccgggttcaagcaattctcctgtctcagcctcctgagtagctgggattacaggcacacaccaccacacttggctaatttttgtatttttagtagacacggggtttcaccatgttggtcaggctgtcttgaactcctgacctcatgatcctcctgctatggcttcccaaagcgctggggttacaggcataggccactgcacctggcccattacattattttttaaaaatcagtgtgactcttttgacaaattagaatggtttaataatcttggttaggctgggcatggtggctcatgcctgtagtccaagcactttgggagcccgaggtcaggagtttgagaccagcctggccaacatggtgaaaccctgtctctactaaaaatacaaaaattagccgggcatggtggggggctcctgtaatcccagctactcagaaggctgaggcaggagaattgcttgaactcaggaggcagaggtcgcagtgagccaagatcacgccattgcactccagcctgggggggcaacagagtgagactctgtctcaaaaaaatcataaataaataaaaataaagtataaaaaattaaaattacgtgttcaaatacattaaatatatggcaatgaaaaggaggcctagcatgactgactgcattttgctcctaacccttcctaccgtgtggtgacatcttccaggctaactgctttttcttatttctgcacataggccaagctatctatgggagggatttagcttacagtttaactttaaagcacagatgataataatcccttccccaaactaactcctgagaagatagagaggttgtatacacaagtaacagtgttatgctgaagatttataagagaagtgtgacctgacaaaggaccaacaattttcaccatccccttgggctctcactgcagcccatgtctgtcattgtcagacctcttcacctcaatcgcctccttcttcctcccttccctaatgtacaaggagccggaaaatagtattaatttaagatggttcttcaggatgttacttcaccatctgttcagtttggtggctctctggaataaagtcaccttccctgcccctacacctcaactctcgacttattggctgtcatgcagcaagtggtgagtgcagtaagccgagatcacaccactgcactccagtctgggtgaccctgtctcaaaaaaaaaaaaaaaaaaaaaacagagagagagagagaaatttggtttttgaaccagacaaattaaataggagacttaattccaatgagacctagaaatgtctaaatttctaaaatttctaaaagaactgagaaaattgcctccattgaggaagtaagctgaaggaggtagactgtcatgttttctgatttgagaaatattgaggaggctttgtctctttcacctccaactgctccttctcctcctgcccctgcacctgcatagtctttcttacctgagccttcctgtcctgccttgcctcttcttccatcaccatcacctaaggaaagtccccagggatctggtcccttccctgaaacttctgttctgacagcccctttcaaggtaaaacccaaacccacaggaagaggggagcctaccgttgtgtataccacttcaccaaaacgtgaattaagaatattataaaggacttccctgatctaaacttaaatacatttcactcttctgtttctaaagcaggctccaagatcctgtaggctttggcagaaaatttgacttaactgttgaaacctttgagcccaaatattctgatctttatcaattaactcacatgctggtgaagaagggaaggccactaactggttgcaaaaggtaaattggaaggattttcaaaaagggactgaagcagaacatgaaaggttcacattttcaccaaatatctccaagttgccattccccaggtccttcctaaaaatatagattggaggataattcagcattgtactaaaaagccagacaaatctgtctttgcttaactaaaatggtttgagagccaggtgtggtagttcatgcctgtaatcccagcactttgggaggctgaggcgggtgaatcacttgaggtcaggagattgagaccagcctgccaacatggtgaaaccctgtctccactaaaaatacaaaaattagccaggtggctactcaggaggctgaagcaaaagaattgcttgaacccaggaggtggaggttgcagtgagctgagatcctgctactgcaatacagcctgggagacagagcgagactctgtctcacaaagaaaaaaataaaaagaaaaaagaaaaatagaaaaaaaaatagcagggtagtagaaatataatgcacacaagaatgataatcatgaagacaatctgattctacaagagtaagggaacctattccattagagagccaactgaaaacatcaaatcccagttcacaccccagggtgtggggtcacgtgcctgtaatcccagctactcgggaggattagtaaggaggtttgcttgaattcatgaggtcaaggcaggagtaaaccctgatcatgccactgcactccagcctgggtgacagtgagaccttgtctcaaaaacaaacaaacaaacaaacaaacaaaaacccacaaaaccaaacaacaacaaattgccacctcactctgaaatcacagtggcaaacatcactttgctattgacaaattaaaagaaaaacactccctcttgctatcaacctggcctcttgctctaacatgtctgacccatggtttaaaatgcccaaaagctgatgtcctcaaattataatacacttacctattctgcaccagcatttatttttgtctggaggagatcaccatccatggtcctgtaaatgtctaacagcatggaatgatgaagggcagtgtcttttaggatatttggttatatctatatatatggctctgaagaaacccaacactgggcgagttccctcaaacttttcactaggcatgaccactgctgtattttagatagagattctgtggggcaaaacctgagaattatctgcctggctatctagaagatagctccttgcattttttgggggagaacacttttgcttcaagggagtgtttcctcccaggattagaaatctttctgtaacctcaggaaacattgctgatgaaaaccaggcatggtgtgctgtacaacttgtagtaataaggcagaagttaaaaggaaaagacaggttccctgtacttggctgactccaagacctgccatagatagagccctagcagatcctcggtaacacgatctgaaaagtcagagccgcgaggagtgagttccggagactctctcaacacagtaagccccaacaaagataagaggaaaaaacaacaaatgcctttactaccttctctttcccccttcccatttctaattattcaagttttgttaagttcttgatttcccttcagtgcagctgcaaggtcaccagctatacttgcattgcaagacctgtgacagtttgattagctgcctttgttctgcttctataagccctcttgcctgcccccgagtttcatgccatcaaattcccgccgcgccattcaaactagccgaccccctttcagaagtgtctataaagttaagccctgtctttgttcggggctcagcctttggattttcatctgctgggcctcagtgcagtcaataaatcctcctgttccacccattggtctctctgttctcctgattcccacaacagtagtaggggactgcgttcccactttcccctggtctttcatggtatgaataatggacagcatttttttttttcacctatagtcgcaggctcggtctcagtgattgtatgctgtggtcagctgtttttgtttttgtgagaccttgctttcttgtttactgtcctgggacagatgtctgtagtcacttgtttcctcgggaggcaaatttcagtctctgtgggggaggtctcccatgttagctgtggtggtacttggcaggcagagctcagggatctaggcttccgtgctttgtagattgctcaatggtccccaaggcctagtggcttttaacaccacttgaaaaccttagtgtttttccactgtccccagagtcacctcttacacagcctctttttttgtttgtttgactttttctctgagagacagtctcactgtatcttggttgaatcgatcctcccacctcagcctctggagtagcagaggcacgagtcaccacagccggcttatatctgttcttgtttttgttgttgtggtggctgtcttgtttttttaagagttgaagtttctccatgttgcccaggcgacgtgctcccggcgaaggaggccgcctgcctgggggcgggctggagccacgtcccagggctgggggcgctgtgggcactgtgggtgccgcacccaccgctgcccggcactggaggccaagagagcgttcccgacgggctccgcggatgccccgccgcgtcctgctgcccatcctgcccgggttgtcgcgggccgggggcacgacaagaggccggggtctgcccggacgcagcggcctgcagggcgcagctgtccctccaccagccggggtcccctcgctcagcccatgagacaaataaatgaatacataaataaataaataaataaaagatggagtcttgctctgtcgcccagggtggagtgcagtggtgcgatctcggctcacttcaacctctgcctcccaggttcaagtgattctcctgcctcagcctcctgagtaactgggattacaggtgcatgccaccacacccggctaatttttcgatttttagtagagacgggatttcatcacgttggccaggctggtctcgaacccctgacttcaagtgatccacccgccttgacctcccgaagtgctgggattacaggcatgagccactgcacccagccagaagtgggcattaatatgcaggcgccgtatagggcaacatctgtgtgcacctcttacaaatcttaatgctgtgtatatgaggggagtccttcgtgtccccctggggatgtttgaggttgcctgtatgtgttatgtgtgtgcatatttttaagctcagatatgcataggcggattgacacctctgtttgaatgtattcccatgagctcatgccattaattcaccatcacaagaaatatttactgagcgtgagccatgccattccacagacaccattatagcactaagatacaatgaggaacaaaaaatccaggctttctgagctcacactggggtgggggcatggtgggaagacacaggcatcaatgtaataaacagaaaccacgacagggctaagtgttctggaggagaggcgcatggtgtactgaggcccctgacgtagaccccaggtgcacctttgagctttgcttgcatggtttgggtttgtgggctcacctgcatgtgtccatgcatgccccatctgcgtgcccgtgcatggctgcatcaccccatgcacacgtgcactgcccctgggcttgcccacatgtgctgctccccagggcgccaggctatcagcctacaaggcattgtgggtctgggcccagcctgccaccccctacagaggcctgagcctgccttcccaggaggcccaggactctcacccagggcccttccctgcagctggagcaggctctgtggctgcaatctggtgagctggagacgcaagagcccagggggctggtactccagagcgtggagttgcggaggcagctgcaggaggagcaggcctcctagtggcgcaagctgcaggcctacctggagggccagcagcggcaggcccagcttgtgcagcggctgcagggcaaggtcagggccacccattcctgctctttccctcccacgtgttcactttgccctgcccccacccctggggctcaccatcagctcccaatccccagattctccagtacaagaagaggttctcggagctggagcagctgttggagagatccggagagctggagcagcagcagctgagggtgggtgccagggtggggcagaggcaggccctgccctccacctgcccagcctgatgctttaacctctctgccacccaggacgcagagcacagccaagacctggagagtgccctcatctggctggaggaggagcagcagggagggccagggctggcagcatggccccctgggcgagcgcctactgatcccctgtgccccattcaggagtgccagcctggcccaggtgaatgccatgctctgagaacagctggaccaggcaggtttggccaaccaggctctgagtgaggagatacgaaaggtgaccagtgactggactcgcagctgcaaggagctggagcagtgggaggcggcatggaggcgcgaggaggaggtgggcatgggggtgcagggaggccggcgatataagaggaagataatgcacaattatgctagtgagactctcttttccaataatgtttgcacttctcaatactacatttaaaaaggaaataggagcacttgaacggttaagtaagaagatgaacaaaattgaacagaggaaaaataactgtctgaagacatgttgaaaatacatttaaagacagtctgtctgagacaggagctgagctggccaatccatcttttaaatcattgaacatcattcaggtgtcaagtatttgacctggagcctggaaggggaggagagagtccaaaaaaaagtcaaaatataaagaaaaaaaattaaagaacttgtcccacaaatcaggcaaccaaggtctaaacttataccctctgcctgggtaaattgttgttgcttctttctgtgactcttaaaagatgtaccatatacctcatttaatgactttgctttattcatgaaaactctatccccatgggaaaagctgttaaatgaaaaaagatttcttttaagtagaaaaattatgaaaggattccttccaaccctccatacccaaaatatctcaaatgaattatgtatctatcaattatcaatatatatcaaaatataccaattaaaaatatcagttaaacaatacgtcaattgaactatgaaagcaagcttatttaagtagcaaagaataacgtgaaggttagtaagtatagcttatacttaaaatacaatgaattgaaagctcatggcacttcatagagtaggaagaagaaacttaatagaaagtggtagttgggcgagaaggactgcaagggagttatttggaaaatgcattttttatttctgcatcattttgttcacaaattattcctaatcttttgtgaatttgtggatttcttgaactcaaaccagacttaaaaatacagttatagcacagaaaaaaatctttaatggcaaaataaaagctaagcaagagagcctttcaaaacacatgaaaataacacacacatacaaaaaaaaaagaataaagagatgtacaagtgacacctcctcaaccttctcacttggtgtacatatgcacagtaaattattttgggctcagccaagcatgggagcaattcaaatagatccatatgatattctctgattagaaactcttgtggagtaagttggtgagtgtatctttgcctaaaacagtcatgtcaaaatatagcttcctatagcatatttatttagtatcattttggtgaaaaagtggttatacagaatagaaaagagttgtccaaaactaagtggttgacctttccagagccattacctgcagaattgttatgtaagtctgttccatactcataaaggaatactcagctgacccaactgattttctcgtgttttttccttcaagggctagtagaagtctatatgttgtggtggaaaacaacctcagccctatagtccaacatttgcctatcaaaacttgtcctatgatttataaaactagaacctcactggtaagtcacattcctagagtctcccccatccctaaccccagtcacggaaaataaatcaaatcattgtcactctttcttaacaaagagcatacatttaaaacttgagtaaaattacaggtaccgtctgggtccttcaagggggaacttgaagtctcaataccgcagttgtccaatcagaggatccaagatgaatatactcaaggactttatgcttggcatcctctggagacagtacataaccaccagcttggtttaactggagattcatttgggttaggagaaattatgtaggcaatgtacttagtcaatggaggcctcatccctgaagacttacaagaatctgaattcgtatgttacttttcctttaatggagtggaattccaaatgaaaataatcaaacagcatgtgcataaacattagatataatacccacatttacaaagcctttatagatatgcaagtgttattgcgtctgtccctagcttctgtacagaatttaatgggtagctgttactattttattgctgtataaaaatgaggaaactgataagttgtctaaaggtgcacaatcaaaacacatcaaagccattgtgaaatacaggtccccggatttcaaaaacagatcttctgcttataaattcagtctttttcatactgccataaactccagaatgggaaaacaaagttactatcagaaaagcttcttttagctgggcgtggtggctcatgcctgtaatcgcagcatattgggaggccaagacaggcggatcacttgaggtcgggagttcgagaccagcctggccaacatggtgatctctactaaaaatacaaaaattagctgggcatggtggcggacacctgtaattccagctacttgggaggctgaggcagtagaatcgcttgagctggggaggccgagatggcgtagtgatccgagatggcgccactgcactccagcctgggtgacagagtgagccgacatcgcgccactgcactccagcctgggtgacagagtgagactccatctcaaaagaaaaaagaaagcttattttttcccctaatcaccataatattcactattaagtgagggaaatagaaataatttatttagcaaatcctttctagttcaaataatttgtatacaggctgtgcaaacataataatgagattctttttagtcatcttgctttatatcactaattacactcttatttaatgatattttaaagaaaaacgtgtttattttcaagtagaaaactcatatctgtccaccaaggaaagctgtaacaaatgtaaaatacataaaaaagataactgctaaatttctaaagcattccagaaaaagacaaatagaagggtgtcagattaggaaagtatgtcttgtaaggtgtaacggacagactgatgagcttagagatgtggatctcaaagtggttctcagagcaacagcatcagggtcacctgggaacgtgttagaaatgcagattctcaggtaccatcccacatttaatgaatcagaagctcagagtagagaccagcaatttgttttaacaagtccttcagggattctgatacagctgatgtttgagaaacactagctttaggtaaacgtaagagggtcacgttagtatttttaaatcattggaagttggtttgttttgttttttcttaagtgggactcatttatacttcaatacacagaatggatatttagaggaagtcgtttttgacctaacacggatgagcatttccaattgaatagcgctttctgataatggggctgcccactacaagtgaataactgggtttctctaggctggagctgcagacaggtcactatgtgtatggaggattgtattaatatgatcgtggctctttatagctctgcattactaatattctgttttaaagtctctcctcaatatccaatgtctctgtgtgaatgatggtaaggagtgggtaacagtaacaatcatcctgttgttgacaacagatgataagagaaagcccaactttacactctgtataaccttacaccaatgccccattcctcgtctaattttttttacatgttaacacatgaccttggcattactaaataagaagccctctcacttagaacccgatgcagtatgataaaaattattttgagaacaatcaggagctctagttttcaattctgcttctcttctcaagtagttctgtgccttagtttcttctttgtaaatttaaatggttggaacagaggatctgttaagtgtgattcaagctgaaattgtatgtagcccacactgagtttctctgctatacccctaacccattcaacaatcacaccaccagttttcaggactcacagtaggatagccgtctatcatttgttaataggtgtgctctttcatccaaacaagaaactcatgatttctgcagttttttattctagccaggttctaggtgctggcctggaactataaaacgaacatttcacaaaaagttatgacaatatacaaaggaaagacaatttctttgaatatccataatctcaatatgcagtctggctgtggatggccaagagatagtttccttaactggaaaaagcttttaaatgaggcttggtggaagatatatctttgcatcattacaaagaagaaaaaagagaaatctcacaactgaagaaagtgaaatccactttacttaatgcggacctctgtctctggtgtgcaggtcctctgtgtccaaagataattagcactttataatgctaattattataattaggtctgagaaaaaaatcattagggggtaggcccgttcactgattttcaactgccccctctatttaaaaataaggtcatttttctatgaaatacctttaggagctcaaagcagaaagagggttatagaaaatcctgtgtaggtataagcctgagtttttaatattcttataattctgtgatgtgtctggaaactgaaccgggaggaaaacagtgaacctatttagtccaggagactagaaatcaggactcagaagagtaaacatttctgtaatagttagtcctcaaatagtcattcattgaccttccactgggtgtctggcaatgtgcaagctgcttctagatgctacctcatgtaacaaccatcacagttgcacagagcaagtactagtactccactttcatagataaagaagtaaaatcttagaaattagctgcccaatgtcatgtatgtaggaaaggaaagctggattctgattcatatttgctggctccaaagcacttgttgtaaatacttcactatcctgtgcttacatgtaaatgtaccatttctcttaggggtcttgaaatactgaaccaaagaatggtgtaggggaagggcagtttagaaatacctggaaatttggttgtttgaaggaagcccactctcagatggtaggagatcaagctaacagaatagctgagaatattttctgaggccccagaagtataaaaacggtctaggggggaaaatttgggacacagagtgaaaatagcctgcctctgaagaccagcttcatttcttcccctctgggtgttaatgaaagagcctttaactttgccaggcctcagttactaatttctaaaacaactgctgctactattactacggatcttactgctactatgaccaccaccaccaccacatcagttactgagaactgaactagatgccaagcaaaaatggtaaacacttcatatacattatctttttaaacacaaaatgtactattaatccagttttacatataagaaaactgaggctcaaagaggctaagtaatttgtatgtgaacatgctttacactatgtaaaacaccttattagtagatatcactattattaagaacctatcagccggagaggaagaattggccttttatctttctaagatgcacagttgtctttctgtttaatggttttttaaaaatccccctgtgacaagctccagaggacaaataatttgtttcttgtggtgtatggctctctaaatgaattaattgataggcatcccattgtcagtctcagggatgtggaaataaaacagacatgagatgttttttaccaaactaatttgtgctttaaacacataaataataaatatatatatattaaagtaaatgtgtatttaccgtctctcctgctccactttgaattcaagaacccgtgtctttgttgggtcactgcactgtcaattgagaagtttggttttgtttctttgagtgttagtaagtggcattaaatggtaaatattgccgggggaaagaaaggagaaaaacagctcttccaatccatccctgtttccattcaattaaaggagggtagaaagaatacttaagataattgtaataagtctaatagaatagcaggagccactcttttcctttcagtaggccattagctcagaactattttcagagtaatactaagatgatatttgccttttcactgtgttggcacttgtattgataaggcaaaaacagtggagtcttagcaaaaattaagaccatgaaaacaaactgcactaggaataattctcttcttcattactgtttacttgcagggggaaaaaccattttcgtttaagaaagtccttggtgaagtagtaaaaatattaattttattaaatctcaaccttgagtacaagtcttgtccttgactgtacttacaagttttgtcctccccaaagcatatggcgtcaaggctgggcctaacccagtctcatgaccttgtgaatccagtccacaaacacagagacacgcgtgaagacggctggccagcgcgaccttgtgcatactcggttggggattctaattcctttcaggacccagcagttgtgggtaaagcaggcaagtgggcccccgtagtcaccctggcaggtaggagaactgatgagggccccgggccacagcaatgactagcctgcttcatgataaaatagttcatttctagccccccatacccttccagggctggcccagggccctgccaccaacctcacaggcccccacaggggccaacagtccctcagtgcacatctcgctctcccgcacatgtcctcggtgcttgatgttacactcctggttggagatgacgttcagcaaggccacatttaggactgtgtcattacccgtacctgcagtgaggggaatggggagaaggagacggtcctggaggaagatccagggctgggcctcctggccaccagcagtcctgtgcactatgctcttacctttggtctcaccccagcctgcaatctcacacttggtccctggaggcaccacataccattcaggcggcaggcagatcagggccacacgctggttcagggtcacagatctttaacaagaatgggggcactcagggtctgaggccacaaggctcagccccacctcacatcctcccaggttgtccacatacctctccagcttgagcaggacaagctgggagcctgagggcccacacagcatcttggctactgggacccgctgtaggcctggctctccatgttgtgggttctggaacagggtgcccaaccatacctcatagcccgtgagaggcatatggctgggagagaagctctgctaggtcatttgtgactctcagtccgttgccccaaggctcacttgttagcttgcctggggaaaggggaaagtgggatgagactgggtccccaaacacaagggaggctcaccaggaggagaagcactgccgggcagtcagtatccactgctcctttactagagaccccgcgcagaaatgctggccctgcctagaggagtggggaattaggacagggaacagactcctgggacagatgctagacctgccatcttctggctaggacctctgggggcagggatagattcccagcccccagtggcataaccacagaggacacaacctcagctcctctctgtgggagacaggcagttgtgcctcaccgattccgcaagctgactgtccagggtgagttgcccggatggcccccagccacgcgcagcttggaacgacgctgatccagccgatccaccctcttgccacacttctcaaactgcacctggtctgtaggatggggtgggctggatgaaacccagactgtgtggatgtcgtgggctaaagggcctgacccataactggcccaactcgtaacctgggggggtccaggattgatggcggctggtcatcagctgaaagacaaagttcactggggttaagggagccagcctttggtggtgagggctgaggtaaggtcatggggcaagcgtcactagtgctcaccgcagcgtcgcagggcacagtagtcgaatggggtccttgggtccatcgtgtagcaccagggcccatggctatccccatctgggtctggcagaagttctcctccagttgtgcatgcggttcggaggtaaatgtgaaccgaggcgggagcgggagcaaaatcgtggcagggtagtctcaaccatttccaggctctggtcccagacatcaaagcatgccgccccagggttagggccctggcggggccgggagcaccagggactcactgcagcttgtgcggcgtctcagcggaccagcgctggcactggacacccttgcgggtcttgctgaccgtgccgcggtactgctcccccgcgccgtggtagcagtctgcggccggtgcgggcagccatcaggccgagacctcgccccggccctccggttccaggcttccagccccggctctgtagcccccaagcttgggcctcaccctggggccgcacgtcgtctgtacaacgccggatctggtagcaaaagcccacgcgcgtgccgggccgcagggtgaagcaccagggcgcctctgagccgtcgaggttccagcagaagttctcccgaaggtctctaagcaggcgctccactcagccctagcccgccagcctccagccctaagcccgtgactaccctcctcccgtctcacccgcagcagcacgtcccaacgcccgcccccccgcccacctcacttgcacgcgtatttttctggcgtaaatcggtgctgatgtgggatttgcgcgtcccaacgctggcaaggtacgccgcggtggtggtattggctgtgccccggtagccctcacccttcccgcggaagcagctgacacttgtggcctcttggcggggctgtgcctcggacccttagatggaccgagataggtcgggccccgagcgacagctgagatccctctggggctgggaccaaacccgcctttcccaggtgtacggtactccacgggatatgctctcaggtcacgcccagcccctctgacctccccggccaagccacgcccctccccaaggttcccaggtaccctcccaggcctggtccccgccgcctaccgcagcgggggaggtcacagaactctcgctcgatctgcggatccgtagtgtagcaccatggccgctcggagccgtcaggattccggcaatagttgtcgtccagaccttggtcgaggaacctgggggcggtaatggggcgtgaagaagaccctggtactctggcttatctggccccgcccagttgccctacacggagccctgcccctggagtcctggaccttccctagcccggcccccagggcgccgataccgcctacgcgtacttgcccggctcgaaggggtgctggtgcgggtgctgaagatcccagcgctggcactcgcgccctgactcggtgcggtctaccgcgccgcggtattcctcgccattgcaccagacacacgcggctggagacaaagagccagtgggttcgtggatgggcgtgggcttgcccctccactctcccagcttgacccggcgccgcttacccacccggcaggatttgatgctgcagctctggaagcgcacggcagggtctgttgtgtggcaccaaggacctccggggtcgccatcagggttacggcagaagttctcttccaggccattccggagcgtgggcatgtacctgagggcccagagcatcactatagtgtgtgctgggggaaggtcccaggccgggacggagggaaggtgtttgtctcacttgtgatcgttcgggaacttgtggctccaagcctggcaggacaggccacccacggtcgtggccatggtgccccggtacccaaccccattgttcatgatgcaggtccgtatgtagtctgggagcaagagacagaagatcaacttgggctgaggtcccctgtctcccaccctgcccctctccacccccactcgcctttctcctggaagaggtcacagcgcccagaatgccacagccttgagtggggcgagtgttgagtccatggcagcagttggcaaccatggctgctcacattgtagtggaacgccctggagagaagaaggcacagggtaacgccacggcccaggctcccctgcccccagtcttatctaggcccagtggccactcaccagcagtccattaagggcccacagcgaccagcacactcttcagcatctgccacatcctcctgccaaggcccgggcaccaccgcatgtagcaggtgctgtagctctgtgccccggagcacctggaagtcattcgatggcgagcgctgccctgcagagtgggcatgagtgggtgcaggtcaggtgggcatacatgtcagtaatgtgtattggcatgtccacactttgttcattcaggggatcaaagctacaaggcttctgggatggaccctgtatgcactttcaagggccagtctagcccccctgcacagatacttgtcaaaaaaatttcccctgggaagcaggcccagacttggtagttatcaccggtgcctctgtgtagtggcccaggcactgggctcagatctaacacatacgctctgtgagagcagtgggtgatggagcttgccccatctcatctctcaaatgagaatgctaaggctcagagccatcacattacccagccaggggccctggctaggcattcagactccaaatctgggctctcacctgcacaaaggcatacgctaggttagaggggtagatcaggctcaggaggggtcatttcctgctgtgtgcgtgcatctgtgtggtcctaacactgcttcagtgctagagcagacgtgctaatagaggcctaagtgggccgtgtctgtgtgttcctagggcttcccagctgtgctcaagaggccaaggtcactgccccatgcccactgagcctctggctccccgacttttttctcatcccagaataggagaatagggccaaccccctcctgaaggcagatggggatcagggttgggggcactcaccagggacccctaagtattgagtcagaagcagcaggagtgggagccactcctccaggatgacttcatcttaactaattatatgactatgttgactgcaacatatgtatgaagtttcatatactcaattcctttactgcttccttgagcctatgaaccccctcctgcatctcctagtcttcactgaacattatgtcaattctcagcctcagctctaaatgctcatggtttccaaaaacatatttacaacccaccataggtcctgagcaccaaagcctgatgtccagttgcccagtggacagacatctccactgggacatctcataagcactaaaaatctcaatgtactgaaacctgaatttatatttctctccccaaatgtgctccatttccatcttccctttctcaacatccatccagtggaaatgttgctcaaacccaagtccagagccacccttggcacgctcatcttcctgagccccccacttccatcggccacccaggtgcttgtcagtttgcccactttctccctctccacagcccttttcctagttcagaccttctgtctcccttgttgggatcatgtcaacctcttcctcactcgcctctggctctgggcttgtgccttcaaccgactcttcaaaccgtagcaagagggatgcctcgaatcacagatcagatccctctctccttaaagccctgcagcagcttcctgtggctctcaggatagaattcaaacacttccaggatctgggcatctcctgcccctccacagccctgcctcgccctgcattccagccccaccaaaccacagtcagtcccttccatggttttggatctcttgtctgggaactttgcacctgctgttctctctgcttaaactctcgctttcacccatgcgacctggttcactcctcattctcctgcatgtctcagcttggaagtcacctcttccagaaagccttccctgaccctcaggtccaggttagatcccccacctggattcccacagcaccgtgtttttcccctaccacaaccctagtcatgccctttagcgaacagccaacagttactaagcacctgctgtgttaggctgtttcttaggactttataagaaagatcacatttaatcctacgaagtaggtactgctattatcctattttttagatgaacaaactgaggcaagagcagtcacacacacatagagtcagtaagtggtaaagttgggatagaaaccaagacaatctgactcatggatgttacaccgtgtgttagaactagccttgaaaaaaagacacaagcttgtgccctgtgccaagaaagtttctgataatggtggcggtggtggtggtggtgggatttaatcagttggcagaagtctgtatttctaacaatctctgattcaaatgggcaggacccatgtccatttctctttattgcaattgtactatgtttcttaccttcactctgcaacaagcttggtgaagacagagaacatgtatctgaggcccttcatctcccctcagttcctagaccagcactagcccatagtcaaccctccatcaaagtagagggagaaagtaagtggcttttaccctgtgctttctgaactcctgggatgctaggaagagccagaaaaccttgtccaccgaacccacaaattcactctcttcatcccttcctcactccacttccttcccagtagttgttggagtttttgaattttccctctgtgagcccttgccctcccctgccatgttctcagcaaaggccctggcctccaggtccatgagaacaggattccctgtagtaagagctcttccctagcctcctccacttccaaaggggctggaatcttcaccccttgatcccttccctttttagagcacagaggaagcggagccctcctcctgccctgggctcccatgccccacatgttcctggagagcacccttgggccactgttgtaactacatggtgacttgcttgctctcatccttcatgaccccccctcctcccatgccccactttgttaatttcactctcctctcaaaactccccacagtgccagtgatggggtataaatgcagctgggcaacgaggctcccacagacagacccaaacctatcttccaagtgttaatttcttttctctcctcttcttcaaataggtctcttccttacacatttctgccattcctttctctctctgccttgcctctcccttttctcccggccacagccttatccaacctcccagcccagcttggactcagctttcctaggaggctcccagacaatccagtgggctctcatttttttgagtgtattcagcagttggctgatgctgcatctccagcacttgccctaggttgttttatctccctaatggcctgtaaaccccttgagggcaggatctggcctttgtactctaaaaaggtcttcctactagagaatgctccacacatgtgtgatgcttcggggagtcccaaccttcatcagagattcccactggtgccagctcatagctcatcatgacgtgtcccagatggtgactgggagtagcctatgccaagcaggagtttttccccgaagtcttcctgtttattgcaccgggctggctgcaagacattgaggatgctgccccaggggccagcagggtgactggggcaggcgccatgatggctgtgcctgggtgctggccagtgtggccccaagaagaggccgggagccagagctgcatgccctctgtcagcaccagcctcctaaaaacactctcgactttctccaagcatggattgcctgagctcccctcctgctccccaaagaggccggggaacaagtcagacaggggataagtcagacaggctcagctgtgggaggctggaggaaaaagaccaataaaactgactttatttgtaatgttcccatgtttgtgattttgttatttctactctgtttcctcagagcaatgaaacaaggaaacggaacaaaaaataacaaaacccagctctaagtatacgtgaactgtaaggcctccctctggcctcctctcttcctccttcctcaccaggtttgcctggctgacccttccagccagtgaattcctttcccaggttgagtgttttccattttaatttttgtggcatttccctggattaatggttaacgcattcattttctcccctccagcctccattatcaaagagtgctttgaataaccattaactctctggttaagcgaaagaaacacgttaatcatctacaagtcctggggcaggaaaattattcttggtaaccttctcccaatggcaagaaaaccactgtccctgagcagctcaacttcagccacacctgggtctacaagcttgcaaaacccctccggtaaccttgttacaaggacttggtaaactgaggtcataaactgctgaatggctaagcgctgtgcttttcaacccagccaccaccggttctctaggaccctataaagagacaaggctgggctgctgcttctccctttacttttaaaaattgttttgccagtaaagtctcatctattgtacattccttgttacggggaaactcaagtggctgtacaggctgttcttggagccacagttaaaagcgctttgactcaaacacacatgtggcgtcatcctgagctccgtttgcgtggggccggaacaccggactaggaaacctctccctgctttagcaactgagtgtggctagattgagggaccacagggggtggctctggatgcagcaatccaagtccccttttcagggagggtgacctctttccgaagttcagtggatggcccccttccagggttagggagacaggaggaggaggaagaagaaaaggaggaggaaagctctcaacagccccccacccccaacccatccaggagagaaggactgcagtccccgagaccagctggaggagtggcgtgtgcatggtgtgccctcagggtagagcgcgccatcttggagagatgcctctttcattcacaaagcggatctgttgcagagcccagagccccggggagagcagggcggcgtccaagtgcttgctgggtttggcttgcactccctctcccttaaagaagacagaggcggaagggagaggctgttcttcggaggcgagcctcaggcactgctagacttagtaggaaagatattgctggggtcttggcaagccgtaggtgcagcgctccccatcgtcattccggtgcggctggttactgtcaccctgcctcctccccgccggcctgagagcctctctgttccagatccaaacatttccacattaggcagcctgcatgtgcatttccctggcagtggagggaaaggcacccctgtgacctgggatgaccgacgacggggacttgccctcctcccccacaggtgcacttgctcttttctgggccagccttgtgatctggtgtccgggcacttggcagcatttagcaaatgttcctcagtgctctgtttggtagttaatgctgttgacacggacacctttgggagcacgtgggagaagctgctgcctccgtttcccccgggttacagcgcctggcgcagtctgttgtcccctcagaagtggtgggcgacattatctcctttttcatccctagccctctcccttgaagctgtcctgatctctcttttggacccaggaacgtgagcagaggttactactcactatatatacacactgcatctagactcatgcatgccttcttggtgtcaaggacacctcacatttcaaagacttcatgaaaaagaacgtgaggtatctcacacggtgacatgataaagctttggacaacgtgggttaagctaaaaacaggtcattacaattaattgtatctctgtcttttgacccttcagtggctcctgaaatccatcacacatgtggcttgcaagtattttggtcggacaacgctgccgtagattgtcccactctgaaatggttccctctgggcttacgggactgctatagaagggtcctaaggtcctgtgcctccctgcttttcaagtggctgcaaacttctgtgcctaccgcttcctccactggatgtttccttcctgccctcctccctgaggacctcctagtccctcttcaggatgcagagctggagcctccactccaggaaagccactcatgttgttgccaacacaaccccctgcacacatgcagtattaggcattggtctgcctggctgtccctgggctgtgctgtccttgagggcagtttttgtgtctaattcccagagagtgcaagaacacaagcatgctcatccagacgttagtaagctgccctaaggggtggagcagtcagattccggttttatttatttttcccctgcaaggagcaatcaattattaaccgaagtcacgatactttggttgctgttatcagcacatgaaaatatcagtcaaggctgggtttcagacccgcctggcactattcaaaggaaattttttagtaattcttattttattaagagcactagtatattcagatcaagtaaaacttcacatataacaggttcactcttctatatgaaatgtttgtgggaaatctatcatgcatcaggtgctctcaaaaggtggtgaggtgtaaatgtcagcctcaaaggctgcagtgtccaacatggcacacagcttgtgtggctcttagcacctgaagcatgcctcgtccacagtgagatgtgccgaaaatgtaatatacatccagattttgaagacttggtaaaatatctcaccagcaattttttatattgattacatgaggaagtgataatgttttgggttggttaagttaaacgtattattaaaattcatctcacctgtttctttttaaaagtggcttctagagaattttaaataacatgtagttcacattatatttctatgagacagtgctgctctaaggcgattatgctttgtttgttttgagacactcacaggtgtatgtgagcatttcaaccgggtttataacagcttaggaaactgggaactttgacttggaactttcccgccaagtgacaaaacatccgtccagtgatagaagttttaattctacttcctccagctagatcttgcctggaggacccacgttgacttactctctccagaaacggccccactggctctctgggggaactcctgggttctgcagggacttgctaggtagtaattacaggtgtgtagagaccctcctgcttcatacgctcagtcatcattatttacttttaccaggcaccaggggcgtgatgagagcttagctgaaaggagagaagactcagcaagcacatcaccttgaagctgacctgtcagccagatttcgcagcacctgcctgttccagcctgaggggctgcgattcattccttgggaaagagagctgcaaattccctctctaggccacagtccaaatccttgctcttctctctcaggttctggaagacagaatggaggcatctacagagcaaggacatgttttctacctgaattagcttttctgacaccttgaaaccatctctaagaaattgattttttaacatacacatatacaggtaaacatttaaatctgtgccataatgtatttgcacttcgagtccccctgaagtcctaagtcacatgcttctcttcctaggggttctgtctgaagcagagacccctggattggagcagtgggaagaatcctgatgaatcaggtgttcctgcctgtttacattaactgggcaccctgcctgcccaccccacatgctgaatactgctggggagaagagaagaaacatttattaaaggcaaggaaaaattagagccttttcattgaggtcagaagatttttgaggttggatcggctggccaggtgcatgaccaattttcttggctccttagaagcagcaaagtatttgaaaaataatggagcccttcgtcctacaagtaaaagcccatttatattgggaattttttaaaaagtgctggcgatggaaaatttccgatgagatgcatttcttcctgcctgaatgtcttgaatgcctgctggatttgtctccctgctaagacactcacacttgcaaatctgtgcttttcaaggtggggagatgaaaataaaaagtctgtgacatgtatttctgggaggcctgaaaacaggaagcaaattggaaccacagcatgtggggcacggatgctggattctgggggatatttgcttatttggaaaggctgcaaacattccatcctacccactgctaggagctctgcactttgctaacgtcccatggaaaccaaggttctctttaggactcgacaggactgggttatttttctcagcttaaattgtttttatatggttatcctcagtactcttttctgttttgggatattttcatactttttattttttaaaaaccccagaatatcttgattttgaaaaggtacattcacccaaataaagtgcccagcgcatagacaaggctgcctcaatatttcacgtgtcaacagccaatgcccccggtacgtgcagaaaagcctgagaacaaggaaggaagaaaagggtctggtccttgctctgcgggtatttaagcatttctcagccccctcctctgacttctcaactatgttcacctatatggcctcaaatggagagaactggggttataaaagaggatattagctatgcctgctatagaatgaggaaggcatttcaggatgtgcttggggaggagatggaatgaatggcaaaggggatgtttgtccgtgagggtggtctgtgatctgtgggtgggggatgtctgtgcagctcccttcatggcctctcatggcccacacagtaggcagtgtttgccacacacagaccctggacaaagtcacagagtggtgttggtaccatttcataggaggggtcctaggggacattctaggaagttcttcatcagcttaggaaggtgcagcctctgcagtcattaaacacagtctaccagccagagaagcccaaaagctgctgctcctgctgttctgcgtggtgtgggaaactacggcattggcacaactttgggagctctctttgatctcttgtttgtctgcatttcccatactcttccagtcaccaagtgtcatcattcttccccaggttgtctctgtctcccttccttttctgtccccatgactcttacctgtatccaaaactatggcgtttaaggtgaaagagccagtctgtaggagctgcttcgaggaaagtcttgcaagactgccttcttgaacttggtgctcaaactcccctctggcttcacaacctgcatagttgcctgggtcagaaacaggttcctcaggcaacttggtgttgcattaaccaagtgacactgattgtcacttggaagacactcagtgactgactattagagatcatctgcctctcattttggggatgtgaaggttgagactcagagaggtcaggcaacatgtctgaggtcattgagccaactagcagcagccccagagttgtcacccagatttcccgactccccattcattccagaaaacctacccatggggaatgttctgccaggctgttctacatcaccagtagagagaagttgccttgagtattcggtttggttttgaagttaacctattcagacacacttgagcatgcagtgagtcactgactggattcattcccagacctatggactcagcacatcagctcaccaagcctcctgcatactctgcttctacgctggacaactgtgcattttgagaagctggaggaaattgtttggcatactgttctaggccagcagtcatgcgatactgagctaggcctggctcctataggctggtgaaagccaagtgttaactgttcaggatttttttgagttggttaactattgatagcttcaaagtcgccatggcaggggtatttataccatagaaattggtacatgttacaaattagggtttcatttttcaccatccagagatctgatttactaactcactactgattctgaggtaggaccccagcttaggaaggcactttcaggcaagactgttctgcggtaattagaaaatggagagtggccctgtcagatgcaaaggagaatatcaaatttggaaaaaagtactgcctattgcacaagaggtaagagtcactgagacatcttgcaccagacccaagtgagggatggaaggggccctgatggtcatcttgggacagcttcttagggtcacccaggagcccaggagccaggtatgccactccgtggtgggacagaaacccctgtaaagagcaagcagacactcagtcacccaggaccctccccaacactcccattccctgcaatctatcagcgcatcctatcaatcccgtctggagtagatatctgatcatgccttctctcccttgtgactgccatcacccaagtccaggttcctgctacatccttcctaaaaggccttcccctgcaagcttgcctacctcacatcgactttccccacatagctgcaaaagtggacgtctgagaagaagggggaggaagaggagaagaaggaagagatgaagaaggcgaagatgaagaaaaagaagaagaggaggaagaagaagaaggaggaagagggggaaaagaggaggagatgatgttatgtcatcccttcacccttcccctgcacacacacacacacacacacacacacacacacacacacagacacacacacacacacacacacaccacgaaaacccttcaagagcttcccattgtacttagaataaaatccacgcttgagtaaagctctgcatgatttggcccctgcaaacctctccagcctcctcttgcttgggagcctctgtgctcacaactctcctgtcaccctggtcttcttccaggtccttgaatgccggctaagctctttgctgccccaggaccttcgcacctggtcttctactggcaggaatactgtttcctgagtcttcccctgactggctccttcatttcctttaggtctcagcttgagtgtaacctcacagggccatttcctgctcacctggtgaaaagtcaggcctcgtctgttctctgttttagctcctaagtttctttatgacaattatttcagcccacagttcttttatttacttgtctgcttacattttgttttaatcttttctttacttccccccacttcaacagatgctccatggagaaatgggttaaccactgcattgccagagcctggcatataggggtgctcaaataaagacttgatgagtgggctgggtgtggtggctcacacctgtaatctcagcactttgggaggcaaaggcgggcagatcacctgaggtcaggagttcgagaccagcctggacaacatggtgaaaccctgtctctactaaaaatacaaaagttagctgggtgtggtggtgagtgcctgtaatcccagctactctgggaggctgaggcaggagaatcgcttgaacctgggagacagggattgcagtgagctgagaccgcaccactgcactccagcctgggagacagagcgagactccatctcaaaaaaaaaaaaagttgatgagtggttcattctactgccaccacctatgggaagacaggtcaggaatgttgaaatgaaagaagtgcttggcttcctctgagccccagctggacacaggcatctgtgatgcatccagattcaggctgctcatggactctgaggactcaacgctcccggagggctagcagggagctttgcacacatacaaccagttctcaccaagcaactggggattaatagtgcaaggggttaaatgggttcaaactgttcctcttaagctccccaagatggtgaaccgcacttcaaagctgcttgaaaattcttacttggtgagcatgctgttctgtgtcccttttgggcagaggattgggaaggcagccaccaaggccgcctgccgagtgaacagggggagggggcactccaggtgacgtgtgtgcagagacccgctcatgcctgacccacagttagtgcacgctcacagtggttccagtcttgtcccagcgacccgactggcctgctttgttattggaactagagctgatgattcactttaaatagatccttaacctcacaatttgtttttcttgaaacggtcctgagaggtgctttccaagaaacaaggaaaaaactgactgcacagtggtgactttgagtctgtctgcagaaagcagtgtgagtggatggttcattcccatggcaaagcctttccctgtcacccggtgtcagggacagtgaaaaaaacgggccgtagcttgggaaacaggggtgctctgcagttgccgtagcaggtcttcagggagagcttacgggaacccacggtgtaggggcgggggagggggactgggtgtgttcatttcccggggatgctgtaacaaattaccacaaactgggggccttaaaacaacagaaatgtattgtctcacatttctggaggctggaagtctgaaatcaatgtgtcgcaggaccacacttcttccttgccgctttctggcttctggcgcttgccagcagtccttggcagttctcggccggcggttgcatctctccagtctctgcctttgctgtcgtgtggccatcttccctctgtctctgtctctgtctccgtattcaaatctttttctctttgtgagaacaccagtcattggatttagggcttgccctaatccagtaggatcttattttaacttgattacatctgcaattatatcctattttctaatagggtcatattcacaggcatcagagttaggacatcagcatatcttttggggctggggactcaattcaacccaccacaggagaggtccccttgctactaggcgggtagtcatatcacacgcacatgtcgtaaacatgctgagcagacgagaacccaaaatctctgatttgggtaagatgtgattccaaaatgtagagtgcagaatttactaaaacgttttgaggcttagagtaagagactgctgcagtttaggaagacttcctcattaaaagattccaaaagacatattccatgagtcaccagggtagactgaataatgagcgctcaaagatgtccgtgctgtaatcccgggagcctgtgactatgttaccttgcatgacaaaagggactttacagatgtgtttaaattcaggatttgagatgagatgatcctggattctctgaatggatcttctaagaatcacaagggtccttacaggagggaggcaggagggtcagagttagagaaggagacgtgatggctgaagcagagatcagagcgcgaggggttggaggatggagggaggatctagaagaggaaagcaggcagcttctagaaactggaacaggcaaggaaatagattttcccttcagagcctctggaaggagctgaccctgctggacgcttcaatcctagcccggtgagactgatttttttcttcatgacaagtcagttgatgttgttttaagctcctaaatttgataattggttacagcagcaataggaagcattgcagtcacatagcccagtttggcatcttgtattattttaacaaactctccatcaatccacctgtgtatcattttagtctgctaacaccaagaacaatatgttgcatgtggaagaccttaataactacttgttggatgcatactctgagagcttattatacactcggtagtatgctaaaccctttggatacatccctgtcctcctatctatcagtgtggaggagaattggacattgaacaaataattttacaaataaaacagacattgatttatgtgacaagtgctgtcacagaaaaaccacagggagacatgacagggtagagtcggggaaacctaacttcaacgtggggtcaggcagagccttccaggacactcccagctgaagccaggactggacataccctcgcttggttccagttttaaagacaagacactttgcccaaggaggtgacccgagttgagcactcggagcgtccaccatcttttctgaatggtgcgaggttgtctgttgttcatggagctcgtgtggggtaggccaatccctggtctgaacttgaggcggtgacacattttcatcttggttctgccgtaggtttagcgggtgacctttgacatatcgtctgcccttcctgcatgtcgtttgtgctctggctgacaaacaacgatctcaccagccatcagcgctccacaggaatgaaaagagtgagtgaccaggacagggagggaggaaagaagaagttgccttgttgccacggccttcctcagatgtgcctccgtgccttgggtcacccctggggctactggcaccttctgagacagagccggggctgagggctagattgtcgttcactgggcacctctgcaccggggaaggggacgggagctgaggagggggcactgagcaaggcagaatccttatccccaagcagttgctgacaggtggagagacaaatgcaaacactcagaatgcaaacacacagtgtccaaagcagaagcagcaggaggggcgtgggctctgccccaggaattcaggtgcacagaaggagctgggcctgcagggatactttggggtttggtaaatgaaggcggggtcgtgcactctgcggtggacaacaagagagaagcctccccacacatcagggttacacgtggcttggggtatggcttgccaccttctcccgtttctccccacatgagcaagggcggtgtccattatctctcaagcaattcctacctccctggcactggtagatgctggacacatggtacctcctccagcctcacaacaacactgtcacatcgtcacctccatttctcagatgaaactcaaagaggtgacacttgtccagtgtcaggtggctgtgaagatcccagcacagtctccttgcatccaaggccctagctcttaccacattgttgatcctgggttgatggtgaaggtgtaagctggggttcctccccagcccctacctgtcgtgtgcacacctggccttctctgggggtgcatttcccagctgaggagactgtctgcgtgtgtggctccgaaggaagcctagctggtgagttcagaacaggccctgtgtgtgatgtggtgacctgaggtcataggatacagactgcgtcccaggagcacctgccattttaggggtggctcaggaaagcctctgagctccctggaggaagttgtcccctctccactgctgcaaaggagagttggtcatggggccaggcagacactctctggacatgctcgtggaagagctctttgggagaaaagacactcgagcatgccaacaaggggacttaggggccagaatgttctgccacttgccactcgccaacctgaaatctgcacctcctaatcacctcctctcagccctgcctcatcaagtggggtcttgcaggaactgctggcagctcggccaccatcggggaaaacaccccagtcaaacacaggctctcctgtgccttggcatagagggaagagccagccctgcccccgcccctgcccactatggtctcaggattcactccttgctgaagcctttacaggggagccaaatgccctctcacccaaggcccttccaaggccctcccacatcctttgggtgaatctgtttcaggagcacccatttgagggaaaacttcgtccccaggagaaatggcaacggagaggtgaaggggtggaggtacgctttggagcagggccaaggcacatgggggtgggctccagcctcgagcctgtccttctccatgatcctgaacatgactcttctggaacctggccggaagttgcccctcaggagacagcgggggaaggaagttgtggtccagaaactccagaatgcagggtgcccttcccattcaatcacggaggctggtccaggccaagagcatcctcggcctttgtttaagctcccgtgagttcttggttgacctggagaggctgagagaggcccacaggacctctttccttctgacccttcattgcctttggatccagctcacctcagtgcaagcctgtggcctgcaggggaggccctgaggtagaggcactcagccctgataccgtgagggacccttgaaagtttgtgctcttgtttatggtctcaaagacaagaggccaaattcctcagctgacatttttactgtcaggacgtgccaatgttgttcactttttgttttgctttgcttatgattgtctggcaccttgagatgatgctgagtatgccaggctataggatggagatgtgggtgggagcaggcaacagactggccctgatcttccagagctgatcacattctctgacgtcagctctctctgttcatgtcctttgaagggcaatggactccgtgaggggagacccgaagtctgtgaatgcccagcttctgagataccgtcaatactgttgactgcatgaatggatgaattgcaagtgagttgttgaacacagtggcaaggaggctccttactagcttggaaccccctcctccggcagggaaagtgattaccaacctggaggtcagccaggccaagagggctttgagatctacaacaccatctccatctactgggtttgggttacgtgttttaagtggctcaaccttcctctgaaatcatagcaatagcaatgaatgatgtcccatcaggcactgccctggtttttttgcacacactatctttcatccctataaggacgatgtgggatggccattgtcatgttcctttcacagaggtgaaaattaacactcagagagagtaggcatcttgctcaaggctagaatggggtaaagccattcatttaatttatttattcaacaaatattcattgccaacctgctataggccaagcccctggcactattccaggtatcgggaaaatagcagtgagcaaaatggacgagaattcctgctctccgggagcttcacttctaatgggggaagcagagcaacacacaagataaaatacacagcatgccagaggttgttaagtgccaaggaggaaaagtggagaaggtggaggggaagggaagggctggtgggcagagggatatgcctactgctgaggaagctcccaccatgaaggtgacatttgcaaacaaacctgaaggaggtggaagactggccaagcagagacctccgggaagaggggctaggcccagacccaagcatgagggtggccagagtgttctgggaacacgaagaccagcgctgctgcaggtgggaggggatgtggggaagataagatgagacagagtaagggtgtgttggggggtgacagattatggagggccccagaggccatcctgaggatacgggagccattctctgagcagagaagtgacataatccaatttcagtttctgcagggtccttctgggctctaggctgagagtggactgagggatgagggtggagtcaggggcatggattaggaggctatggctagtccaggcaagggggatggcagtctaaatcagggcagcagcagagtcaggttttggaaatgttttgaaaatagagccagtaggatttgccaacattggcaaagattggatgtgaggtgccagaccaagtgttgtcctcagcaactgggaaaaaagagttaacgttctgcattaggctgttccagcattgccataaagaaataccagagactgggaagtctataaagaacagaggtttaattggctcacggttctgcaggctgtacaggaagcatggtgctggcatctgctttccttctggggaggcctcaggaagcttccaatcatggtggaaggcagagggagagtgggcatgtcacatggccagagcaggagcaagacagcaaggggggaggtgccacacacttttaaacaaccagatctcatgagaactctctctctatctgcaggatggcaccaagagagatggtgctaaaccattcatgagaaatctgcccccatgatacaatcgcctcccaccaggccccacctccaacattggggattacagtgaacatgaggtctgagtggggacacagatacaaaccatatcatgttccctgagataggatggctgggggttgggggtgaacagtatttgggagggaaaatcagggactctgttttggacacaatccattggagttgcaggtagacgttccagtggagaagacaagtggctggctggctctctgagcctggagttgagggggtgatgtgggctggagattggactttggcatcatcagtgttggtgaggcagctacaatcatgactctggatgagctcattgatgggggcagcaagtgtggacagagaagcaggaggtctgaagactgaggtctgaggtgtttggggagaagaggaggaacctgcaaaggagatagggagcaagcaaggaggcaggaggagagccgggcaggtgggctgcagccaagcaaggagagggggaggaggaaggggggaaggggaaaggcggggagtgggaagagggtaggagggggaggaggagagggggaagaggagagcagggggagtaggggtaggaggagaaggggaggaaggggaggaggagggggggaagggggtgagggagaggaaggggaggaaaggaggggtaaggggggaggaggagaggggaagaggggagaaggagtgaaatatacctgtcgtgggatttgacctatattagagaatcactgtgcagtgcaccaagtggcactggagaagtcatccccgaaataaattggattgtgtgacaagagatgggttcagcagatgcaacagacagggaggagggaaactggaccagccttggctgtggattggctgcgcgatcttggacaaatcacccatcatgttttccttccgtgttacgtggaaatgtctctgatatctactgcccttacctcacagagtaaagacccaaaggagatgtcatgaaagcattttgaaatgctgctgaacactcagcacagtggctggcacagagtgggtagaactcaatggttggaaaatgtacttggctgttattgtgcctttttcatgaaaatatgaaaagctaaataaacctgaaacatgttggggactgagtgaggggagatgagcacgttctgagagtcctaggaccatgcactctcagagtgcctttgctattgtttcgcctcccgtcctacagaggaagggcttaggtttgctgtgaatttcccccttgcctaccagcattgcgccaattaaggtttctacttcaccgcacgtttcagccaaggatgtcaagggaatccactgctgctccagtgagacaaataacatatccagcatcaacactgccatcatcattagcatcattgtggccattaggatggttggcaaggcaataggttggcactactgatgggcagcaccattagtcttcttagtgatttttcaaaatggacagtctggagctaaaagcgtgagccctggaggagctcatttcatcagacctgctgcaggcaaacactcttctcttcatacctttcccgcctgtacgtgtggggtgatgcctgtcttgggaggaaatatagatgcagtgcctagatattccaaagcccaggttcggaatctgtgttccctttgttttttgatatttcccctcctttcctcctgccctttagatcttgtgcatttgtgggtttttccctttctgctcagctctgatcacttatttgcttttgtttttggagagctgcgtcctctctttactcacccacctgcttcattagagattgctactcacctgcagtatccatgctcaccttcttccacgataattgaaagagtgtccggcacacggctgtctacttaaaaactgctttctctagtatcccttgcagcctggtgtggtcatgggactgatttctgcaagaagagtttgagcttcagtgtggtgtgacctctggacctttgaaaagaggggtttattccttccattctcccacctttctcttccttcctccttgttggagtgtggctatcatggtgatggtgaaccatcttggaccacatggatgagggccacacactcaggatgctggagcaacaaggtggaaggtacctgggtctcgactgcccacccttgtgaaaggtaaatgcagttccatcttatctgaaccctagtattttgaggttctgttagaattgctgcacctgtattctaactaataccttctttaggctctttgacccacttgccagattgcaggttgcaggaagacagaacatggttttgctcaccattaggtcatcagggctggcacagattgctcaacacataataaatacttgttggaagtgttaatgagttatggttttactctggtatctggacttctgctttccaaaggatgagtggcccttgacgcattgttcccttgggcaactgcagcctctgtcatgggccaagtatggaatgtccctgggaaataaaatctcagaggaagagagctcctgcccagccgaaattctccctggaattgtgagcctccaattaggctagaagatacagtcttcccatctgttgtagaaacagaaagttatttagagtataaaacaatctcccggcttcatgtgtgaagcctatttgagagtcagagggttccagcagagggaggaggaacatcagctacacctggagctctggggatgaaagaacccatgagggcctcatagattatagggctctgactcctccagggaaagatgatccagtgttctggcctatcttggcctgtggttctttgtgatccatggagtgagagtgtccacaatcgcctgctgtgtggtatttccctgacttgagcctttgctcataaccagcatagcccacaaacaccagccgtatccctcaattcctgacttctgctttcctgtctttacagaagaaccccagctgtgctaatggtcctgtaacctctcagctcagggccatgagaccttctctctgcatgaatctcgcctcctctgcaccccacacttccacaccacttcctcatataacgtgttatctgactacacaaccctggaaatgatgttcctcctgatgtgttcccaagcattcttgctattctgcttcctctagaagccagggaactttagctgaccaggtctgtgtcttgggcacctgccttggtgagcgacctctgagaatttctcactaaacatttgttgaatgaactaggagatatataagggaatgcctcttctgcctaccatgagcatggccttaagtgttatctttgttgcttggccaagtcatggccttgagtcccaagtgaggtgcccagcccttattcctgatcaataaatacttttagactcctgattattctcttgcttgcttgcttgcttgctaatctctaatagattagatctattccctaatctaattctctgatcttcctcctgaaacttggctccatattgagttccttgccctatatccgtacttgcacggccgctatttgccacccagagtccctgtgctggcaaattcaacacccggagcattatcattttggtgcaattcctgagcacagcttgctgactcttcagtacttattgtttctatctggaatacaagagggagtatattatgaggatgatggtaaacccagatcatggtgctcagagcagatctgaaactctggcagcgtaacacctctctccagcatggacagataagggtgattattatttaattggacttttcattttgagagaaattgtaggttcacatgcaaatgtaagaaatgatgtggagacctatgtaccttttatacagtttctcccaaaggtaataccttcaaaactattgtatgatttcacaaacaggacactgacattgatagagtccagattcagaacatgtccgtcatcaccaaggtccctcatgttgcccttttgtggccgcacctgcgtcctcttactctccccatctctgccccatctttaactcctgacaactactaaactgttctttgtataactactaaactgttctttgtataactactaaactgttctttgtataactaaagttataattttgtcatgtcaagaatttcatatgaatggaattacacagcatgcaaccttgacttttcttactcagcacaaccgtctggaggttcacccaggttgtggcatgtgtcaatagttttctcttttgttgctgagtagtattccataatagagatgtactgcagtttgtttaaccactcaccttccacctgaagggcagctggttttttccactttggggggattacaaacaaagctgctgcagacattcacatgtgggtttttgtgggaacctaagttttttgtgtttttttttttttttttcctgggatgaatgctcaggagtgcatgccaggttgcacagaccttgcatgtttagttttataagaaactgtcagactgttttctagagtgattgcaccattttacattctcaccaacaatgtatgagggatccagtttctccacatccttgccagcatttgtggttgtcactcttttagccattcaatagtcatgtaatgatatctcattgtggttgtaatttgtattttcctaatggctaatgattttaaattacctcttcatatgcttatttgccacctgtatattttcctcttcagttaaatatctcttcatgtcttttctcatttcttcaaatttaaaaattcttatttatttattttttattttttttactgtggagttttgagagttctttctatattctacatactagtcctttgtcagataggcagtttgcaagtattttctcccagtctgtagcttgacttttcatcctcttaacagggtctttcatagagcaaatgtttaactttgatgaagtctaatttaaccatttttcctcttatggctcatgcttttggcatcaagtctaagaattccttgcctggccctagctttcaaatattttctctttttttctctataagttttatcgttttatgttttacatgtaaatccatgatcaatttggagttaatttctgcatgaagcgtgagactagattgaggtttatttatttattttttgcttatgaatatcgattgcttccataccatttgttgaaaagggtatctttcctccattgaattgcctttgtacccttatctaaagtcagttggaaattttgcgtgggcctatttctattaacttccactggtctgtgtatctatcccttcactaatagcatgtagccttgatcactgtagctatacagtaaatcttgacattaggtagactaatctatcccatttcatttttctttttcaaaattgttttagctattctagtttctctgccattttatatacatttaggataatcttgtctagatctatgcaataatattgctgggattttgtttgcagttatattgacccatatatcaagatggggagaattgacatctttactgttgagtcttctgattcatgaatttgtaatgcttcttcatgtattttagctcttatttggtttcttttgtaggaattttaagcacacaagtactgcacatattttgttagatttacacctacgtatttcatttctcttgagtgactgcaaatggcattgcatttgtaattttggtgtccacttgttcattgcagtatacagaaatagaattgagttcatgtgtttatctcttattctgtaacattgctgaactcattagttctagggttttttttttggtttgttttatagattctttgggattgtctatgttcacaatcatagggatggttttatttcttcctttccaaactatctgcttttattttattttcttattttattgcactggcagaacttccagtaggaagttgaataggagtggtagagtggtcattcttgcctctccttgatcttatgtggaaagcattcagcctttcatcatcaagtataatgttagctatagggttttatagatgctttttagtaagttgaggaagtccccctctattcctatttttctgagaggttttctaatgaatgggtgttgaattttgtcaaatggggcaagagggtggtaattcttcattattccttactgtaattagtctgtcaatgttaatgagcatgctattattaagcacctattggatgttcagtgttgtgctaggccctgtgagacatataggaacctaaaaatttgagccttgccctcaagcactaaggaaacacactttctaaaccacaatttagcatataccataagtgctgcagaaggccccaggcagcggaggccagtgttgccctggctagaaggtgtcacttaggttggcctttgggctggagtagaacctagatacacaagagaggggagtgaattagagaaaattcaacggcctaaaattctattttctaacaaggacaatggtaagttgataattagtaggatagagatagcttttgattaatgaagttggattatctctattctgtggattatccctgacaaatgcttaatcctgaacttcctccctttttgagcatttgggctctcttttctgccatccgtcaacatgttcaggggaatgcaaactaatattactattagctaaagaaaaacataattaaggagggcaatctgctgtccctaaattgtatcatcttttccaaactaaatatgagtgatattggtactatcttttgtttggagagatccacaccacttctctccctcttaaggctcaagaagaattgactgtgaccatgatatacacaatacatttattaagctgtctctctaacaaggtagctaaacacttgggaagtaagagtaatgccttagagaatttggaacccatgacatctgattcattggtattgtccatatttgtacatgtttactctaatataaagtaataatataatagtgctgtcatttgcaaaattaaaaatcctggcacattactcatgggtcatgctttgggttgtcattctaacgggtttggtggatttgtatagatctggtcctctatctcactttgtcctgctggtgaccagtggctcctcttggaggcagacggccagggttaagggtggaatctgaggccgtgagggagagtgaaattaactgctcccttcacaagggaattgaacccctgaccttcacctcattagcacagcactccaatgcagcaattcctaacctcaattttatatcaccccagggtgtctccacttatctcaagcgggagctgcagaattcctccaacaaaattaattttaattcaccttaatttaaacattaaatacggactatgaggcagcaacttgcaggagtggggaagaatggctgttgttaataaatcccaccaccacaatgcactgttatccaaacaccccaaaacaccctctcgaacccactgagccaaacagtgtggggaggaagaagtctataagtaagcagcaggcatggaaggcttttaaattgcgggggaagcaacacccaaccctaccaaacatctgcatttcatagagactgtttcatgtggtcagctggggtgcactctgacattcactgggccagatggacatatttcagctcccgtccagccagcccatccctttttcctcctagggactgtgatgctttgcatagtcccaggagtttgctgcaggaacattttgtgatttactaagaaaataaattggtctttgttgctggggctttctcctgggtcaatacaaaagatttatcacctccatgccggcccacggagaggttggctcaaaggattctctggccactggcttattctggagacaagcagagtcccagcagaacctttgcagggcaggccagcagcctgagtgtaaggcaggggaagtaaccgtaggaatcagttattgatgaacatccttaaaactctgtttgtttgtttgtttgtttgttttgagatggagtctcactctgtcgcccaggctggagtgcagtgacgcgatctcggctcactgcaagctcctccttccaggttcacaccattctgccacctcagcctcccgagtagctgggactacaggcgcccgccaccatggccagctaattcttttttgtgtttttagtagagactgggtttcaccgtgttagccaggatggtcttgatctcctgacctcatgatccaccggccttggcctcccaaagtgctgggattacaggcgtgggccaccgcgcccggccgaacatccttaaaactcttcatggtcttttactgataacaacatccacatgcattttttaaaggagaataagcatagttccttaccctggcagtgcactttatataatttgtcaaagagtttcacatgcattgtatctcaattgttttctacctacccagaattaccaacttcattttattgaagagcaaatagacttggaaaagttaaatgccttgcccaaggtcgcatagctagtaaatcatggttgtagcaccagatcccatgtcttctcatatactgcactcttttctctatactaatcttatcttggtttattatcaacatccatttgcttttggcagggaagggtccagaatcttcattttacagaacaacgaattgaggtaagtaagcgttttgggtcctgcctctttttctgctggcaccatgtgcctttcttgctgaagggcaaggagttcttttgcaggcacactcatttctgctctcagaggccaggctctcaaccatcatcatcagtgccatcctgctcattgggccccaccctgccctctgtgtccagtgggggcttacatctgtgatttctgggcagtgagggggtcatacgtgaacagttccttcgcatcctcttaaaattgctctttcagctccataagtttcaactagtcaaaacactctccttcacacttcttcaaagatgagcatttgttctacatatttttttgtagtcatattctgcgagtgcacactttccctcttgggtccttagacacacccttttccaggcatgattcacttcctcaagctccgttctggacacatacatctggtgccacctggaagagggcttatcaggtcctcccacctggaatacagcttaaccagagttgatttctaaggcatgcaaccaagaaaccagactgatataaatgggatattattgattttatctgcctaaccgagtctataaatttctgaaagccatggaaggaactctattttgttgcattcctcataacatctagaacggtgctttgcatatactgagtgctcaaggcatatttgcagatggtgacgaggatgatttgatgtcgttttaaaggccggacatccaagaggaggtctgttctctacatgtgcatgcacgtacacttacacacactctctgacttgtaagatgccctttgcaagagtccatttgggaaatgcagtgggcccactggaagaaattcaaggccatgggccagctacaccacggaagccctacacccagccaaacgtgctcactggcaagtcaaacccaaaaactgtcatcaaattctgcttcctggcagcccggatccaacaatactctgaaagacaaaagaagcagaaactcaagtgaagatcaccaacgtgtctttttgggcaactagcagattgagcagagggtcagcacagacaccagcagagaagaacattctcctggcaggactctgcctccaaattcggcaccacttcacaggatctcagcctcacaccttatgggatttatttttttaaaaaagatccaacatttgttcctaattattcttagtaaaactgcctttcttgatgtggcacccattacctcattcattcagtcactcattcattcattcaatgaaacccctgtcatccacgctctgggctctttctacagccccacgagatgatcaagaactctggaaaacaggtaagccattatcatcagtgtatatgaaattatcatcagtgtatacgaaatatgaagaaacccaattagatggagatatctcctaccacacattgaaatcagaactcagacaagactcagatgttctaactccaaattctgagcagtggcccctggataaaggattatggagaaatactgaccagaaaaaatactcttaaatggcatattgtggtgttttaaggcaaggttattggtagtgcttgtaactctcaaaatactgttttggaagtttgtagtgattttgcagaacggctttgagttacctctgggtgttatcaatcattggatagttttcagaagaaatccaccttaatttgagttaaataatatgtcatttagccagatttcctcctgcccccaatccccataggagtgagaagccatggcttggggcattatctcagcatcatgggaattgcagagagggtaccacagctttagagtttgaggtgttgagcctgaacaaaaggaaagggtaagaaacttggggtggatagaacgtggaactactatgaagagcttattgcatagaaaaagagaaatttgagtttaaaaaaaaaatggaagaaagtaaagggagcccaaatgggaacagttaccagaggagattccctggaatttgaaggaaccaggttgaaggatggtttcccaatttgaataattataagaatcacctggtactctttttaaaactataagttcctagagccccagtcttagacattgcatttagtgtgtctgggttgaggcccagaaatctgtatttttaacagaaacccaggtgatttttataatcaggaaagatttgggcaatgtctgcatttgaagatgctgtctctcaaaatgaagaaatacctggacaaagccaagtccaagacaggggctctaagtcaaaaaggcaagagcaaaaacaacatgagcctttacaaaatgtgaattggcaaaaaagcagctgtagctcatatttaataacctcccatggcttccaaagaagcagctgggtctgcagagtcctgtttgtgcacaggatgaatggagtctgtgtgccactcgggatgcccccacaatacccacattatcactgaggtgctccagcgaggcattcattatgcactcccctgccacccaaagcctcaggtcaggtttgccttggacactctcccttctcccttctctgaggctgaggggctgcaggggcgggtgcctgaactccctccctctctcagggatgcctcagctctatgggacttcctctggttcacatgattgcattttcctgccttggggcaccctaaaggcctgcctctgggaagcagggtctagaggcatgagcttgtctggacaacagaagctcaatctcagcatcctaaaggcctacctctgggaaggggggggtcacagaggcatgaacttgtctggacaacagaagctcaatctccatctccaagcagttcgatcccccaacactcttggtattaggaggggagcctctgcaagtgtgaggaccgggggcctctaaacagggtttttttctttttctttttttcttgagatggagtcttgctctgttgtccaagctggagtgcagtggtaccatctccactcactgcaacctctgcctcctgggttcaagagatttctggctaatttttgtatttttagtagagacggggtttcaccatgttggccaggctggtctcaaactcctgacctcaagtgatctgcccacctcggtctcccaaagtgctagtattaaaggcgtgagccaccacaccaagccctaaacacagcctgaggctggtatcccaggaggccttgaaaaatctcaggtttgctgctgacaggtgtgccaggaagagacctggctgctgtctgcaagtggccaaaccctgataatcccggaaataaacaataaaataaactcctcaatggtgattataaagtactattgtttatcagccaggacctgtgctaagcttttcacctacattatttcatttatatttcagagcagtcctttgaagcagtcatgtttatatcagttttatggatgaggtcagagacttctgctggttaagtaccttgccactatcacacagctagctagtaaataaactttaaaaaattgaagtattatgtacataaagacaggcatagtgtacaactaagtgggttatcataaaagtgaacatacctgtgtaaccatccacccaaatcaagagctagactattaccagcctcagaaaaatcccagaccctctccaataacctcctcttccccaatggtgaccatttttgtcaccgagtattagatggctagtttgtgaattttataaaaacagaattctacattatatgttctttttgtctgacttttttctccactcagtatgacatctgtaatgctgatctaatgtcattcatgtacaagtagtttggtcatttttaatgctataaagatgttcatagtatgaatgtatcacaatttatttatacatttttcattttgctggttatttgagtagattttaattttgccccatgacaaataatgctacttggaatgttcttggatagttgacccttgaacaatgagggtcggagcagtaaaaaattcatgtataacttttggctctcccaaacttaactagtaatagcttactattgaccagaacccttactgatgacataaataattgattaacacatattttgaatgtatatactgtattcttacagtaaagtgagctagaaaatagaaaatacttttaagaaaattataagaatgagaaaatatatttactattcattaagtaaaagtgaatcatcataaaggtcttcatcctcaccgtcttcacattgagtaggctgacgaggaggaggaagaggaggggttggtcttgtctcagggatggcagaggtggaggaaaatctgtgtataagtggacccacgcagttcaaacccatgttgctcaagggtcacctgtacatgtgtcttggtgtacatatttcggcataggatataccaagaaatgtaattgatgggtcataaggtgtgtggattttcagctttagtagatactgtttacatagttttgcaaagtggctgtaccagttcactttcagctatgagagtcctgggggatccacatcctcaccaacacttgatactgttggtctctttttacttttgccatcctgatgaatgtgtttcagtttgcatttccctgatgactaatgaaattgagcagcttttcaaatgctattggccatttggatatctactggcttattcaggtctcttgcctgtttttctactgggttttctgtctttccaggtgatttgtaggagttctttatattttccggttatgaatcatttgtcatttatatggattgtaaacgtcttctctatggcttttcttttcattcttaatagtatcttttggtgaaaagaagactcaaattttaatgtagtccaatttttcaatgttttcttttttgattctgtttttgtttctgttatatataagtacaactgactttgtatattgatatttcaatccaagaaccttgctgaatttacttattaattctgttagtttttctataaattattttgtattttctgcatatgcagtgatatagtctgtcaataatggcagttttttttctttctatttcttaaaattttatttgttttcttgctttactgcaaaggctaggacctccaaaacaataatgaatagaagtggtgatagataggaagcatctttcttttattctcagtattaggggaaaagtatcaatatttgaacatttatatgatatttgctggagggtttttttgtagatactctatcatgttaaggcatttcccttttagtcgtactttcctaaatacttcttttttccttttactatcgccaggggttgaattttatcaaatgccttttctgaatctattgagctgatcaacgattttcttctttattctgttactgtggtaaattacatagactgatttccgaacactgaaataatcttgcatttctggaaaaaaatatcatcttgtttgtgatgtattgtcctgtttatatattgctgaattcagtttgataacattttgtttaggattagcatccatgttcaggagaaagaaatcaccattttctttccttgtcaggtattaaggttataaagctctcaaaaatgagtcaagaagtcatttttattttctagaagagcttttgtaaagactgatgttatttcatctttaaaggttttgaagaattcactgatgaagccatctgggcctggaggtttgtttttgtttttgttttggtggaaaggtttttcattatggattttatttctttaataggtacaaggctattatatcagatattctttttttatttgggtcagttttaataagttgtgttttccaaagaatttgtctatttcacctagatttaaacatttatcatcataaattggttctgaacagctttttgtcttatttaggagccacagattctattgttagggcttcctttccattcctgataatatttgggactcttcttaaaaaaaattaatcttatgggcttatcggttgtattaatctcttttgttgtttgtttgtttgtttgagatggagtttcgctcttgttgcccaggctggagtgcaatggcgtgatcttggttcactgcaacctcagcctcccaggttcaagcgattctcctgcctcagcctcccaggtagctgggattacaggcgcctgccaccatgcctggctacttttttgtttttttagcagatttctccatgtcggtcaggctggtctcaaactcctgacctcaggtgatccgccccaccttggcctcccaaagtgctgggattacaggcatgagccacagcacctgtccctgtatttgtcttttttaaagacttgtttttatttttattttttcactttgttggttttctttgttgtattattgttttctactttattaattcctgctatttattatttccattcttatgctatcttaggatttaatatgctgtttttttattaaaatcttgagatggaaacttagttcattgtttcttcatcttttcttcttttcttgtaaagcattcaaggttttaaatttctcttaagcattctttggctgcatcccttacattttgatatgttttagttttattacctttttattgaaatatttcctaatttccacggtaattcttattttgactcatgggttgtttagatatgtattagttcattttacatcaccttaatccgaccaagaactgagctctttaaagatggttcaggctttctgcaggctgagttcttcctggatcacccctttgtggggagtctcaacagaagaccagtggtatttaacccagctcttcctccttgctgggctctgaattcctttctgtgcctcagccccatgagagtcctggcaactctgctcaacttctcagtttccgagccactgctggggaatccatgcacgccaaggagaaaagtggctggcacctctccgctcacgccttgtttctgggatcttagtgccttagtttctcattgcgttagtagtttttttttttttaaattcttattcatttatttaggagacagaggtcttgctatgttgctcaggctggcctcaaactcctgggctcaagtgaccctcccacctcagcctcctgagtagcagggactacaggctactattagctggtggtttttgatgccttcaaatagatttgaaaaagatgttttgtccacattatccagtgttcttggcacgaagggcgtctgataagccaatctatccttaccaccaggggacatcccctggaaccaggatttaggcacaggtctgtgcacacccagactccagagcccacaccgctgcgtggcagggggagttgccatgttggagtacaggccgccaaatgcggagtagaaaaggaatgtgaagccctcttgctctccagctctcttcttcatcatcttcattattctggatctagtcaagcattgccatttatctaatctcagttctaaaatgtgttgaacacaaattttctagtttcttagtaaaattaatcttttaaatcacttactttctaacggttgttcacagggcatctgggacctctttttcaagttcaccttctcctggtctgaaaccaaaatgaaaacaaatagaatccaagtgtgctgtagctcctgacatccctccgtgggctccgccagcccctgcatggaagcctccacatgggttcaccaggctgttcttcgggctctcccaaagtggctgcttttccgtcaatatgaatggcatgactggccacatctcccttttttcttcgggtgccaggaagcctggactgttgagctaactttacggtccaaccatagcaactatgtcagtgtgcagataactgaaggtgcctttccctccctggcttggcttctccctcttacttctcttcccaagctctcaatttgctttatttttgtatattttaccacgatattgtctctctgtgtgtctttatataaaacttgagttattccagttctgccaatctgtgtaatcacttggcatttttatttgtgttcataattttcagccatggagacatttgaaagacaacaaaatcgatcctggagaaacagagatgtgggcactattgcaatttatagaatttattgtaaaattggactttgatgaatctttgccatacatattctgttgcttaagattttttgtaacaatttatgtgtctattgctttatgtgaaagacgcttttcaaaattaaaatcagtaaacagtgttctgtgattaaccaggaacaaaagtagatggacaactgctcaatgaacatgaaacgatgaagatcaatttttcttctaggtcatggacaaattaaagtagttaagtgttaaaaacagagaccatgatgtcattcctcatgactacaatagaccaatatttaactctaagcgtatttcctttaaaaaaaaaaaaagttaactacaaaaatgtagttaaaggtgctaatctactacttttttggtactgtaatatttactgtattatttatttttctattttatgggcataaccatccacagaagggtcagtaagagagaaatatcactgctttcctcttctatccattatttttgttgtttcgtttcatggctactactaaaaataatgttgtcacagagaagcaaggtgataaaaggattctctctgggggtcaatccatgaagaaagctggagaaatatctgctgaacagagttcatggcttcatgttctatctgagcaagtctcatcctgcagtcagctctcttgaggctgagccaggtctttgcacacctttcctctggctgatgcttttaaattccctctgtcttcgtctctgctattgagttcggtctcctccgtgagtcccccacggggcctggtgaggacaggctctgtgggagcagctttctgttttgagcctgtgatgtctggccaaggagcgcctgtcagctgcttgggctccatctcagcccagagacgtcgtgctgtgtggtcttaaagcaggtcacttcacctctcggtatctctctctgtaaaacccagataataatacttcccaaataaagaaagggttttctttaagccctttgagctcctcagatggagcgcaccacagaaatgccaaatgcggcattgtgatccgcgctgcctccatgtgattaggtaatgtgagattgtggttcattatgctttgtctggaatgaatgcgagccctgccacaaagcactgggaactctcagttacacagaaaccccatggtaagcttggattggcttacacttaaataaagcacaccagaaaagagcagtagttttgacgaacccagctctgaattaacactcatttgatttcttctgctgagtgcgggcgataagtaagagatgacccagttacaggtgcggggggcacaaccaacactgaggtgactgagtcgggggaagggcagcccctctgcaaaatgcttcaggctcccaaggaggcaggcccagagtgggcaggtctggacttactgctgtacagacaagggggaaattcaatagctaccatttattgagtttctgctaggtgccaggaactctgcaatgtatgccattcttctaaaccctccagacaacggtattaaaccatattaatattctgaaaaccaaaacaaacacccactacacttgacacatttttttttgtaccataatgaaagcctatgtgtttgggcccacagtttcagccaggattttgacctggggcctcctcactgatcctgaggctttaagaccacacagcatgggtctgcgaattgcaaatgggaggcttacttttcccattcttatccaagcctccagaagtggctctggagctggatccagcctcctttcttacgaagccttggatacatcccacttagcttgacaaacttttaccggaattctctgatcccatttcacagctgttgcaaaggtagggtcttggttgtgtcttccttcaagctgcttatgaaccaggggtggagactaggaagtaaggaaccctggaatcagagaagtcaggagcaagcatcttgttggcttgaggttctccaggcaccataaaccaagtagtgcgcatactaagaaaacaagctggacaacaagaggagagcaggagggtccttaggattggctgcttgtaccatggcccccagtggctcagtagagacaaggggaatcccaggtaagtagactccttcgctccccagagaggaatctattgtgtcaattgctgggaaacacgctcagttgaactgaccctctatagccgtatgtgcatgtggaatccattgttagggaaaccatggtgagaagggaagtgagatgctctggatgggtgctgagctgagtgctgatggaacagaccttccagaaaaggttgcatattatccaaggaaatatcattgcctggagagtcctaggctgacttgctctcttgggagctgatgtttagggaatgggagaagcagctggtttaaagcatcaaacaatgaaatgaacttcagaatctgccaaatcctaaacatttcttgctaagcaccattttttctgtattgtgaacccatctgtgcttcaaaagcaattttgtttaaatggcttcttccccttactcctaatccttgggaagctgtaatacacaggtggtaaaggggactccccaagagatgctcactaggactgctgtgagccagatactgggctaacactgcatagcaccgagggtgtgggagatcagaagtcaggagcctgcattctcaggggagggactggatccctgcaaggaaacaaagtgtggtgtgtgtggcttcatgatccactggcctaggtctaatagcggatctttttgcaaatttatttatttttcttttcttttcttttcttttcttttttcttttcttttcttttcttttcttttcttttcttttcttttcttttctttcttccttccttccttctttccttccttcccttcttttttctttctttctttccttgcttttttttttttttgatggagttttggtcttgtcacccaggctggagtgcagtggtgtgatcttggctcactgcaacctctgcctcccaggttcaagcgattctcctgtctcagtctcctgagtagtggggactacaggcaggcaacaccaagcctggctaattttgtatatttggtagagacagggtttcaccatgttggccaggctagtctcaaactcctgacttcaggtgatcctgaccttggcttcccaaagtgctaggattccaggcgtgagccaccgcacctggcttgcaaatttctatttctaattgagccagtatttcttcccaaaggttcactggaaaatcactgacatgaagaagattgattaataggaaaaaaggcatacacatttatttaacgtgtatacacaggagccttcagaatgaagacccaaagatagaggggaaattgtccacttttacacttaggttcaagacagtatggatagtcacatagaaatatgactggacaaaaagggtctgatggaatgctagactagactgagtggaaagcgcagcaaggcctgtctgcctagattcttccaggcatccatgcagcattccttccttctgggtatgggacaggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcagcaaactttcagcaaacaattcattgtgatggcaatgagctatctgagaagtaaactgacacaatgatttcatttataatagcacctgtaaggataatatgcctgggaataaatttgttcaagaaggtgcagtacttgtacacagacaactacagaacattgttcgaggagactaaggaagacctaaatcaatggaaagacatcttgtgtccacgggttggaagttgtaacatggttaagataaaaatacaactcaaagcaatccacagactcaatacaatcctatcaaaaagtggctttttttacaggaatgcctgagaagaacttcatgttcctaaaaaacagcaagtgtccccccaaaacaaaagcaatcttgaaatgcaagaaggaacgttctctattccaaaggtctttaactgctctcagtaatacgtggtaatcttcaatatacaggctttcacacctttttttttttcttcttttgtttctagacacgatctcactctttcactcaggctggagtacagtggcaagatcacacagctcactgcagcatggaattctcaggccgatgacatcctagggcctcatccactgagtacctgggactacaggctcacaccaccacagccggataatttttctgattttcagtagagatgaggtctcactatgttgcctaagctagtttcaagcttctgagctcaagcgaccctcctgccacggccttcctaagcgctaggatttgaagctgagcctggctggctttcacatctttgctatgtagtttatatttcttggtgttattgtaaatgtttatgaaaggaatcttttaaaaattttgtattaaaattatatatttaaggaattacatatattatatatatttaaggaatacaacctgaggactacatatacatatacacatacacatacacatacatacacatacacatacacatacacatacacatatacatatacatatacatatacatatacatatacatatacatatacatatacgtatactatacataatgaactaatgcctactaggtgaggggctgccttgtgagcaaacccaaagtccttggctcacaaagccttgtctagaaagatggagggatcagcaaagtgggcacacagcaggttctgtctttagtgcgggcacctgcccactcgggtctctggcaatcctgaccaggcttcatgatgggtgaggtgagctaggaatgggaaagtggatgacctcagatccagagactgcagttgtcacctggggacctggcatgtgcgtggaggagtctcccactgatttggccctggatcaatgcccaaacatgcacaaggacaggactgttggcctcaatgttttaggagccaccagtcttctaaagagggtttgtggtggggaagaatgttcaacaaaacagaagagttatgggtactctagcttggcaacagagaatacttccttgtgctactaaatgacaatatttgacaattatggatgacataattgagcaacagctttcactgtttaacaagcagggtctctggaacactaggttagtgctgtcggaagttgactgaaaagtcggtggtttgagcccatccagtcgcattaatgtttctagctgatgtgaccttccatctgaagagtctcttccttggaccaaatatatcttcaagcttctcctcttcttgtctcttgtctattttccaaggtgcctctttgttgcttgaggcaaaaaaagttcattattaatccacacccagcaaacatctacccttacttatcccggtttttagagttttgagtttgtttgttttctcagcttctcatatttggaatactgggaattcctaaagtggagaacaacagaacctgaatcacacctatggtgaagccacaggccctgggtgaaaaacctaatctgctcgcgtttaaagataaacccattaattttctgtgcttccatttctatctgtctaatgggctaaatcagaacacttaatttgtccaatgtttaaacgagcagtgcaggaaaagcgtggagccaatgcctgtcacgtagcaattggtcaacacgcatgagctcctatcagcgtcacggcctccagcatttccatcaggctttgatctttgaaacgtccttcctgatatgaatgggtcattcttcaaacattctctaaccgatggccatgacattgttccaatgtgtattattacaaatacaactgcagagaccagactgacacatgtatctgtcgtgcatcacttgtctatttctccgtagatacctggagatggaattgtcagaccaaagtatttatacatttctgattttgctaatttctatccaaattactatgaaaagaagctgtaacaagtcatacttttaatattttatgagaattctttttttctccatcttctggccaaaactgggaagtacttgcctaccatttcctctgaacttacttttgccaacatttctgtagtcacacagtgggatcacattgcatgcatgacatcaaactcaaatcctaattgaaaagaggggttcacaggactctataaaaatttatattcaaaatacaaaaatgcaaacatatatgtgtatacaaatacatatatatacacatacatatatgggaaaggaatttttttatttggataccttatcaaagttatatagactggaaaatttgtttagtaaaacagcagtccccttgtgtactcccagagtttcatcacatagaagcaagtatttagttatttatctccttatgtctaaatagatattattcctttttgattttcaagcgtaggcactatctctccttcacatacttgctcatcaccaccacccccaaacatgcctctcactaccttaccctctaacatgtttgtgtcctagtttgagggccaactactacattattataacttgtatatgttattcagagttcagtcacactggatatacatagcaggaaatgaaaggccagtatcttcagggactctctctcaagtggataagcttcagagatttttgtaatctttggtcaccctctccatctttttcctattccgggtaagtactggatctgatgggcccagctcaggtcaggcactctctccttgagaaggggagagcaggacatcttcatgtgtagtaccaagaagacactgtccaaagagggacaggtagttctgagacagaaaagtcaatctggggtatgggtaggcaaaacgaggacacaaaaaaaaacccatgtctgttctgtgaggggagcatgcagtagagggtggattcagagtgggaggggagagttttgagagatatgggccatggatagccctctgtgggctggagccacgcaaggctgttggggtctctcaggggcagggagctgaggagaatctgccctccccaacctgggagactggtgaggggactgtcctggtcaccagacagaaatggggtctgggccagggcagttctggtgggaaagaaagaacaggacatcttctccttaggtaaggctctgagttcaggtcttggtagggagggaggttaccttgggcattggccactgaagatggttggccagatgagcacactgaaatctatgttctataaacttgcagttctagtaaaagaatgactgcagtaaagggtctttaggaagaggaggtggaagacctgatttgggttgggggctccaagaagaatgtctgccttgctgtgcagaagcctgctacacaacctccctggtccccttgctcagtctcccggccagacccccagagtacctgccctgtgcaccctggaagtacacagtgagttcagccaaggcatctccagccgggactcatccctgggcatttctgtggccttgggtgccctggccttctccaggccctgtcttgcaggcaatcgtcctgcaggggaatgggagaaggaggctacttgacagttgactctgagtggctccacaagttcctgacttagctcctagtcacttgcaaacctatatacccccatctcatcccccaaatggtgaaaaagaaactttgccaggactcatgccagacaaatagaacagaaccgttccatagagccaaggtcttaggacatcaataagagatggaaaccacctgctagaaggtgccacagtgggaagcttgttggaagggagcagtcactgaactgtcagggtgaatcctggctcctggccctcacacgccctttctccccttccttccttctctcctccctcctgtctgctctttcccctctctcccctgcatccctcaggtaccttccatgggccctcacccctccttttcagaggctccaaagtgagccctcaaaatacttggtaaccttgggcatttccaaaactggagagatttggccacaccatttttaggagctaggaacgtcctccagagctcttgcctaaatttttctgctgatgagaagagaacaaaagagtttccatctgatctggtcctaaggcaactgctccttggagcagagtctgggcaggaagaagggggttgcccagggccccagacttgcccctcccagctgctgtgctcctctccccttcactgcgggaggctggccagggatcgggaacctctgttctccacagttgctgcgatcccaggcccaaatctaaatattggctgatttaggaggctaagggaggcaattccctggagagaggtgtcaggatctgggacaagagcagcatctggttgccatccacggagaccccaaggacaggaatccagtggtagcctgttggaggggatcccatgacaataaaatgaaacgtgtgcattagaactggagccaagaccaggagctgaaaaaccgcgccgtcctaagggatgaaggaattagggaatcccggaagtaaagtttttcatataggtcatttcttccaaagagacacagggcaatggcccaatgacatgtataaaagaaaactcagggtctaggattgaggggaggcagccttttcagtggaggagacctgtcacctggaggcccagggtcaccctgagaggggaggggtcttgctgggtcgctgggtctaggactccaattgcacacagccagtggcctggacggtgggtgaccatgactggggcaatttcccccattccgcttagggagcaataggaatatcattggcattatacagaaaggtcccactgagacttgaacgctgatcaccgtactcagagtccaaagcgctcaccattacatcatggaacctcacaatagctcgtaactggagggcactgagttcacagagcagccgtagttcccacgcacctctgttcatgtatttcctctgatccctcaagcaacaccgaggaaggtggacctgagatggaggagtcgtcctctttctttctctgccctctcctttgatcaacttttaccatttcctttgcatcttagaaaatgaggcaaaatccagtttgggcttagggccagagaagagcccttgaggcctccctcatggaaaacatactctctcagtttaccagagtttcctgtaccaaggggaaatttctgcaaacagtaatgttatattctttttgccttccctcttttccctttgcccagggaggccagatgattgtcagaacaggacttgggccttcctgggtgcctcgcccccttcctccatgtaataaataatagctgacaccaagcaagtgggattgggaggcagggaagctttcattttctttttgatatacttttatgcatttgcttggttggttatggcaagattttctcaccagaaatggagatttgttggattgaaaataaaaagtaatcagccatgttttacattcaacatttattgaacccctgctgataaagcacttgccagcttcagtgggtctgctagagatgagagtacacaatccctgacttacagataccttgtcccaactaaggcctaggttatctgaaggggagattatcaatggcaaatgcaggctcctcctgtggaaagaaattctgcttcctggagctggtggtctcttctcccaccagttcaaagaagcttctctcgcactgtggatctgccctccctgccccacaaggttagggtatgtgccattggggctcagggcatatgtgggaaattcagacattctgtaacacctgctgtctcttcccacgcaggtgaacccttgctgaagcaggacagcaagcaggtccaggtggacctccacgacctgggctatgagacttgtggtcaaagcaagaatgaggctgaacaggaggaatccaccagtcccggtaagagcacagggtgtggggctcaccttccctccctggagtcagctgtcacatttgggtgctgttggccaattccacacctgacaagtagtggggaagaggaggacaggaggttaataggagaactcttacccaaaatgaggctgagtataagtttgaatttctacaatgagtttgtggcatactgctaataataataataatcatatgaagttctatccaactgattattatagaaatactaaggcctacttagagaccacatgaggttttggaaacatgcaaaccataagttaaaaataattttggtttgcattataaaaggactacaactatagggccacccaccacattcaaaacgagaagagaagaaaaacacagtctctctcattcttgaggaagtgtactgtggcagttaagagaaaagatcctggggtcagacttgttgcttcaaatcccaatttgtaaactttcctatgctccagtttcttcaaatgttaaaatagtaataaaggaactacctaccccatcaggtactaatgtcaattaaatgagtaaattcttataaaatgctttagaacagtgtctggcatcgggtaaaatgctgtggattagttctcattctgactaccactgccccaatacactgatgttaacatgctgatatatttattcaaactcttattttcctttgcctatttttcacacagttataacccaataaacttttaaattatagtaaactttagagagcattaaacttgcagcatgcagaaatagcttgtcctacattcttgtggctatcctaactagataaggccatgttaataatgtcttgagaaacatcagtgtgtgtggaatgaacacaggatgttggaggatttgaattcaggctctgccacgtgctagtttgagtgatctagaacaagctggtttaccacctctctttaagttttggtttccccagtcagtaaaatagagagtggtgaaacctaacttgtgggtataaggaggataagaaatactgtatttgaatgcctagtacagtgtcagggttgaataaagtacgacttcacctttttccctagtaattattatcctcatgaccaaacctgcctcctctcaaaggcagtggccacaacagcacatccaacttttattcaggaagacatctttgtcttttttcagagcatgaggagcacagcagccgcaaggaaatggtcctggtggaggggctgtgctctgagcaggggcgccggggctgaacgctggctagttcctctgagaggaagcccttggagaatgaactagggaagcaggaagagttctgggtatatggaaagtcagaaaacatctgggtcctatgaaaggacatcaaagatctgaaggcccagctgcagaatgccaacaaggtcattcaaaacttcaagagccaggtccagtccctctcagttacaagtgattattcatctagtctggaaagaccctggaagctgagagctcctgacaccctggaggggtcttcacctcatagtgtcactgatgaggatgaggtgtggctgtctgatggcactggggctttctactctccaggacttcaggccaaaaaggacctgaagagtctcatccagagagtatcccagctggaggcccagctcccaaaaaattgactagaagggaagctggctgaggagctgagatcagcctcatggcctgggtaaggatggcactgtctgggcactttctggattgaaaatgtgtaagtttgtgcttggtgtagggtagctcaggcagttggaagaaacaacatgtctgggtattcacaaggacactgatttaaatggtagatataggtctgtggaaaagacaggtaggcaagcaggagggcataggatgatgtcccagtatctgggagataccagatctcagggatttcctcttagggatatatcagtaaagtaatagtacatatggtatagtatagtatagtatagtatagtatagtatagtatagtatagcatagtatagtggtaatactggaatcagactgcctagctctgatgcttactacccatgcaaccttcttaacctttctgagcctttgtcattacctattaaatgaggatgataacagaacccatctcaaagggtggatattaggtttaaatgaattaatacaagtgctggccaggtgtggtggctcatgcctgtaatcccaacattttgggaggctgaggtgggcagaacacccgaggtcaggagttcgagaccaggctacccaacatggtgaaaccctgtctctactaaaaatataaaaattaggtgggcatggtggtgcacccctgtaatcccagctactcaggaggctgaggcaggagaatcgcttgaacctgggaagtggaggatgcagtgagccgagatggtaccactgcaccccagcctgggtgacagagcaagactctgtctcaaaaaaaaaaaaaaattagtacaagtgcttagaatggtgcccagcatacattaagctctcaatgctatttgccatagttatcagtgttattgacactttgtgttgaaaacacagacattcatcttggtatgcgtcctggttatctactgctaagtaagaaccactctaaaacttagtgacttcaaacagtactttattatgcttcatggttctgtggtttgactgggctcagctgggtggctctcacttagggtctcttgttttgggtctcatcagttgatggcatgagagtttatgtgatggccatgattgcaaaatacagtcagccacagtatcacaacacagaagaaattcagacatcaggtggtggttaaaacagaagacatgaaaggtcctatctagacttaggatgagatgagtctaattattcattgagtatctgctgtgaatctctgtgatgctggtgctgtaagggatgtgaaacgcagaactatcttcattctcacagaccttacgatttatctagggacatataattaacatatatagaacagttgaagaacagtggcatggtaaattttttgttttgttttgttttgatacagagtctcactctgtcacccaggctggagtgcagtggtgccatctcggctcactgcaacctctccctcccaggttcaagcaattctcctccctcagcctcccaagtagctgggattacaggcatgtgccaccatgcccagctagtttttttgtgtgtttttagtagaggagggggtttcaccatattggccaggctggtctcgaacttctgaccttgtgatctgcctgcctcagcctcccaaagtgctgggattacaggcgtcagtcaccacgcccggcccatactaaatttttagtgcaataatttatcagggtagaatttactcttaaatacctcctatggcttacgtgccagaattcagtttgggggagttccttagagatgttctcatagaaatctctacagaagccccataacttatcatccaccctttcctcttctgtcctgcattaggaaatatgattccctgattcaggatcagccccgggaactgtcttacctacggcaaaaaatacgagaagggagaggtgtttgttatcttctcacccagcatgcaaaagatacagtaaaatcttttgaggatctcttaaggagcaatgacattgactactacctgggacagagcttccgggagcaactggcccggggaagccagctgacagagaggctcaccagcacactcagcaccagtaggttggccacagggctttggatactctcagtcaccccacagttccagcccctggtggccaccacatctccactgcaactttttaacgtagggtcctgtttctatttcatttcctggggctaatacaggatcaagactgctcaatggggagcatggagaggaacacacagggctggagatgccatggttacaactctagaaacttcaccactcatggaatgtgacctgtggggcaggggcggcatctctctggtgctaagagggagtaggggacatgacatggaagggccttgttataggaggaagagccgtgagctaacaattgcaagacgtcgaggcgctgaggccaaagggtccgtgaggaaacaggcgcagctcgcgcccctcggcctacgggagggagggcaaggagagtcctacggttcctgggaggacgagaagagccaagagccccgacggccggcgccggggaaaaggccccgaggcggggtccgcatccctggaagggcggcgtccaccctcctgagaggcacggggcgcccagggctcggacgctcaaagcccgccggctcctgcagcttctgggagccgaagagtgtcagccgggaggatcccgcacacggcgcttagttctggaactgcatacccaggggaggatgcgggagcccgaagcccgggtatgtgtccccgaagcccgggtgtgggtccccatggttttcgtgttgggggtgggcgcggaacgctaagcctgggcctattgggagccatagtcttcttgatggctggtgcttattgggcttttttcagtcgaatttcgaaatgcagttgaatttcttactttggaaacgataatagaaatggctgacctaagattttcatgatgatattttgccttttttggtgtatatgcagtttctgtggtgtagtggttattatgttcgcttcacatatgaaaggtctctggttcgagactgcgtgggaacatcgtgttttgttttgtttttttgtccctaaatttagtgagtttaatcgaggttgggaaacaaacagaaaagtagttgaacctgtggctacactttagacctcctcaatctagacagatcgttgaccaggctacagtttccactggtctgccagcaagaggcctgcttaatattagctttggttccagaaattccttcaggttctcttcattctcttctatcgcctgtattttcacaggctgacactgaaagtggatgacatcttagtgcatttcctaagggtcccgcttggcttcgctttactctggtaagttgcagatctggctgatttgcaagacaacaaaaacaaaatattttttaaaaaggttctaaatctgcatctggaagtcatagagtcaatattcctaaatcacatgaattatgtgtatacatttgcatgcataccccttccccaaataatcctcagaaaaccggttaagttttagcatctgtgactctgagatgcatatgaggcctttgtaaatttagaagttaagagtagaaagtacaggtttgtattttagaaggagatttgggaataaatatagctctggtggatatagatcatatgttaaggtttgttggccagagctggtttgtgtcttgggtgttgggcaaagaacagagaacagccaaagctctgcgaggtcaatgtgaagggtgatttccttggtgggctcaagtttatgacgcagcctggacctagcttggcttctcagctagagaagaagcatgattccatgtcacagctcctgtctttgaaaaagtcataatgactcccagacccaacatatggagaaaactctggatttgtctcttcagttgaatgtttccagagaaaattgaggaaagaaatctctctactatttgaacttcatcaaaagactaatatgctaatatttgaccgtcaatatttccttaaactagtctactccttacatagctaatacatcaaagcatattaacttaggaaatgggattctcccaaacaatgaaacattgacggcaagcgttcttcatcttttcatatcacatttccttcaaatgctttatacatcttcaagcagacaaataatagtattataatgattacgagactgatcgttactcttttgccaaaaaaaccagcgacaaaagactaacttagtggaccaacctttatttcttcattttctctaccttggttctgtccttttatttcctctttcttctaattctgcttctgctactgatttcctccctggatttgaactttacttacctaaactaccagttaggttaccttcttagaacctctaaggcagcagtttgaggttgacgatggaagatttaggattagaaaaaagaaacgtgaatgaatttctgatgttttattataggggtttgtaatgcaggtagaaagaaggacctttttcagagttaagagtttgatccgacaaatgagctattttgatatttataacgttgtctagtaaaagtttcctgtaaaaacacatttggtttggatgtctttgttagcttttagtcgacacttgaaaaaaccgcttggaacggtttctaagtctttgtggatactcttttctgttatcctccaggcggtagttacgcagaggcattggtggttcagtggtagaattctcgcctcccacgcgggagacccgggttcaattcccggccaatgcaaaagggtctttttcaccccgctgttgctctttatctgtcttttacgctgaaaatcatactgcataacctaatagtgcatttaggggcttggccaccacaaggtaaagtgacgacaacactcacgaaagtagcggcaggagacattcaggagactaactcaggaccccatgcagttgttggactcaaacagcttagcaagctgacaagcatgaagtgtttccggtgagtcactgcagttttcatactggtacctgtgactttcatctattcactggaaggatccctgcaaacccgaagaaccatcaggttcctgattcgcgtgctggaccttgggcttaccgttgagccactatggagaggatcaagaaatgacgctcttggaaggagagaagctgcgggcaggacagtcacctcagaggtccaagaggcgtcagcggcccaaagaaaggggtggtgtgtgggcaagagtctgcgtggagatgaggggagcggcggagactggtccttgcgcagaggtggccagtagaccctcagggctgtaccccagacaccgtgaaccgaatttgctaacatcgtcagcgaccgcggcctccgcgtgttttgtgggcccatcggtgttccccgagaaattccgtgtgtctggcaatgtgtgtcaacaggtgttggcctgaaatttggccgggcacggtggctcacgcctgtaatcccagcgctttgtgaggccgaggcggatggatcgcttgaggtcaagagttcaagaccagcctggctaacatggagaaatcccgtctctactaaaaatacaaaaattagccaaatgtggtggcatgcacctgctattccggctacttgggaggctgaggcaggagaatcgcttgaactcaggaggcggaggttgcagtgagccaagatcgcgctactgcagtccagcctgggcgacagagcgagactccgtcaaaaaaaaaaagaaaaaaaaaaaggagcgaaagaaggcagagatgtcaatgggacaaagagacctcccaggaggcttgttgtagaggcagtggccggatcctgagagatgagattttttatttaattatgtagcagaatggggagagaaagggagaagcgcatgaaagacagaaaagcacgaaaatctgcggacgtccaagaataaagcagataaaatagtgtgagtgtttttacattcaaaaaatagaagaagtgcaatgcttgtcagcaggctttgtggtcgtgtagtggttaatacttgtagttgtggttgccacaacctgggttctaatctgagtcacagtagtgttttctagcctgcgattgtggctaatagacctgtcgtttgctttgcctttaatcctagcagcctccagagagcagagtaaacctctggccccgaagggcgccagcttctggagtttagcccacagcgcagaaactagggggcggcctggccgataggaaaacttggacatgctctttgtctcacaattgagcaggaaaaattcccgtaggtgaagatgctgcctctcaagggccctttgtctgtagcttccactgatgaaataatgcggttatagtcttttctggtagagaaaacggctgtatcagtggaattttttaaaaacacaaaacgagaacgagtttttaatgagctgacaataaaatctaaactagttgtcatggtctgcaccggcttgcctccattccccatctgctaatttttatgagaacagtaaattattactattatcattatttttgagacgtagtcttgttctgtcacccaggctggagtgtcatggctcaatctcggctcactgcaacctctgtctcccaggttcaagcaatgagaacagtaaagaaactacagttcacataaagtgcacaaatctttagtgcaatttgtttagttttgatcaatgttatcaccacccagctcaagttatagaaaattgccatcatctgagaaaggcctgttagagcccctgtccaggtgattcccaccctgtgtcctcttagttatcactattctgatgtctattcccacaggttacaattgcctgttcttaaagttcacatgagtgaatgtacatgttttgtgtctggccttttttctgcagttacattcattatactcatgagatatatccatgtagtttcatagatcacttctcaattttggggttattgatttcttgtgctgaatattcttataacagtctttgtgtgcacttgagattcatggaagtccttcaattgctgggtcatgacctgagtataagtttaacatcagtataaattgccagtcttctagaatgttttttcaccagcgatgacagttgaagtggcaccaaattcttgtcagcatttggtgtacgaactttgttaaatgtagctatgctctcagaccaatctggccaacatggcgaaaccctgtctctactcaaaatacaaaaattagccgggcatggtggcatgcacctgtagtcccagctactccggagggggatgttgcagtgagtcaagatcacagcattgcactccagcttgggtgacagaatgagaccctgtctcagaaaaaaaaaaaaaaaaagtagccatacactggtgagtagttagtgctatctcagtgtggaattaatttgtatttgcctaatgagcaatcctatgaagcatactttcttgtggcttccagcatataagaaactctcctttgcaaaggcctattcaaatattttgccctattttatttggcttagctctatattactgatttacaaaagttctcttgtatattcaagaattgagtctttttttttgactttttttattatactttaagttttagggtacatgtgcacaacgtgcaggtttgttacatatgtatacatgtgccatgttgatgtgctgcacccattaactcgtcacttacattaggtatatctcctgatgctatccctcccccctccccccaccccacaacaggccctggtgtgtgatgttccccttcctgtgtccaagtgttctcattgttcaattcccacctatgagtgagaacatgcagttcttggttttttgtccttgcgatagtttgctgagaacgatggtttccagcttcatccatgtccctacaaaggacatgaactcatcaatttttatggctgcatagtattccatggtgtatatgtgccacattttcttcatctagtctatcattgttggacatttgggttggttccaagtctatgctattgtgaatagtgccgcaataaacatacgtgtgcatgtgtctttatagcagcatgatttataatcctttggcatttataatcatttataataatcatttatttataatcatataaatcaaataaatatataatttatttataatcatttggcttttagcagcatgatttatatacccagtaatgggatggctgggtcaaatggtatttctagttctagatccctgaggaatcaccatactgacttccacaacggttgaactagtttacagtcccaccaacagtgtaaaagtgttcctatttctccacatcctctccagcacctgttgcttcctgactttttgatgatcgccattctaactggtgtgagatggtatctcattgtggttttgatttgcatttccctgatggccgctgatgatgaggattttttcatgtgtcttttggctgcataaatgtcttctgagaagtgtctgttcatatccttcgcccacttgttgatggggttctttgttgttttcttgcaaatttgtttgtgttctttgtagattctgatgaatctacagatgagtagattgcaaaaattttctcccattctgtaggttgcctgttcactgtgatgatagtttcttttgctgcacagaagctcttaagtttaattagatcccatttgtcaattttggcttttgttgccattgcttttgctcttttagacatgaagtccttgcccatgcctatgtcctgaatggtattgcctaggttttcttctaggctttttatggttttaggtctgacatttaagtctttaatccatcttgaattaatttttgtataaggtgtaaggaaaggatccagtttcagctttcaacatatggctagccagttttcccagcaccatttattaaatagggaatcctttccccatttcttgtttttgtcaggtttgtcaaagatcagatagttgtagatgtgtggcattatttctgagggctctgttctcctccattggtctatatctctgttttggtaccagtaccatgctgttttggttactgtagccttgtagtatagtttgaagtcaggtagcgtgatgcctccagctttgttcttttggcttaggattgacatggcaatgcgggctcttttttggttccatatgaactttaaagtagttttttccaattctgtgaagaaagtcattggtagcttgatggggatggcatggaatctataaattaccttgggcagtatgaccattttcctgatagtgattcttcctacccatgagcgtggaatgttcttccatttgtttgtatcctcttttattttgttgagcagtgttttgtagttctccttgaagaggtccttcacatcccttgtaagttggattcctaggtattttattctctttgaagcaattgtgaatgggagttccctcatgatttggctctctgtttgtctgttattggtgtataagaatgcttgtgatctttgcacaagaattttgtatgctgaggagtcatttttaaaataaatatattgcaaatgaattttcccagtcagtgaaaagtctgactgaaagctgtcaactgaaaaatcacacaatttataaatttagaagggagattttattttttataaatggttacagcctgcaaggtggccattcccacagactgggaggcataccctcctgctgaaaccgaaaagtaggtttccagggaggggaggggggaacagggatttatgttgatctggtgggccacatatgcatattcaacagggaataggaggagctctgaatattcatgaagggatcgtgctgcatgcatgctgagtaaacaagcctgttacatgcaacccatgttcactttggggtggagatgacatttaaatacattataattagtccctatgcttcaaaaggggaagcagggacacaaaggcagtcaagtgcacagcctctgtaaaacgtccagaacccgtccacagccagtgctctcttatcaaggggaagttactgaaatcagtctcttgtccaatcaaagctgtagttatggcttgtgtagggagggctcagtcagtttatggtaatgggtgagctgcaagtgcttcagcattgcttatctcaaggccagtgcttgtttagctagagaaaaaaaggaagaagaaaaaaacctgtggcaattggaacatagtttattctttaagttgaggggtgcatgactccaccttgcctggcgtggccttaggtctcgtttatcataccatatcttactactgcaaggagtctgttctgtcagtcttaggatctctattttaacaataatgctggtcagttgtgtctaaaccacaaagggagagagtataaggagaggtgtctgagcttccaagtactggccaggaactcagtatttaagacttctctggggtctccttggcaaagaagccatctgtccagctagttgggtggcttcagattttaattttagttctgaaagcatttaatttgatgaaattttgccatattttttctttatttttaaagcccgtcatgttctataaaaatctttctactcaggatgtgaatggattctcttaattttatctctctatgagttccagagtttcagttttaatttttaaattgatgacatctaaaattctactcctaaccaaaacatttttgggggtgactaaggacaactccaaaaatcttccataaatggaagtaagacttactccttaaagaactttctgggatcctgagctgcggggcacagtggctttagtgcacctctgctcttaagactattcagaaattgtctttgtgaacccatcaggctgtttcaaaatcagcaatttagggcttgcttgcaacacgcagttaagcagcagctgttttttggatctcatgagtgcctgcatgcatacttccctgggaattttctaaatttgaattctcatggtatttcaagtggcatagttgtctctttcttttgcctacagccacatacataccaccaaatcctgcactccaagcttctccttcctcaccctgaactcccaacctccagttagacaatccacatcttcccacacctgcctcaggctccatcaggccactgtgcctcccgcagcaaccaggccagggggaatctggattcctattacacttctgaggaaggtgatcagggggcgtggaggatgtgggtgggaaggggtgagattgagggcaggagtacactgtggtcttctgtcttctacctcattggcccaggtgctgctcttcctccggttgtctgctttcagccctgtgtagggaatcaggtctgcgccctcatcttcctgactctcattttctgaggaacctgaatggatgagccgtcgctcttgtcccacacattgtgtccaaaggtgccctcctctctacttgctccggtgcctgctctctgagctctgacactcaggctgggatgccgcccagtacagaagctctgcagccctgcagggctctgactgttccacaccagcaggataaaggccacagggcatgctgtggtcgaaaagcattcagaggtgtgggctgaaggcctctctttccacagtccctttgaacaccccatggaagtcagcacccctttgaggaacgaggtggcccaaggcctggcttcacatgcaggccgttgggtcccagtgggtcctctctgtgcctggtatagccaacggcttcatgcatcttacccggtttcctctcctccaccacccaagctcctccttgacccccttgctcagctgttctcaggacagcaagatccccagcccttggaaaagcccatctccagtgcttggggagggagttgggttcaggtcgtctaaccacagaaggacagagaacttgaggcaggaggaaatcccttcccttgctgggtctcttggcacagcccatccaggggtctgggtcagggtccaggtatactctaccctcctataggacctggatttttaggcccccgaggttggtcaacgtggagtctttcccactgttcacctgggaactgaaggaatatcccatggggccctctcttactcattagagacacccagaaaatactccattcagcagaaactgcgtgcagtgtaccagaccactataattataactgcagggtgtggaggtcagacacgttttgtggctattttctctctgtctgtgacttgcttgccttttcactttcttagtggtatcttttgatgagaaggtgtggctaatgttgatgaagtctcatttatcatgtctttcttatatatgtattttttgtgtcctgcttgttggtagggtgatctttgcctaccaacaagtcacaaactatccttgaaatgctttatatctttaacttttacgttttggtgtgtaatgtacctgaaattacttttgtgtgtagtgtgagggagaataacattgttggtctccccacattcatataaaagtccattaattgaaatgatttattttcttttattgaactgcttttattgaaaacccatttattgaccgtatagctgtggatcagtttcaagtctcttaactcagtctgtttatctatttgtcactcctgatgcctcgtctgtaatagcttatagtaaaccttaaagtcagatagtacaagtccttgttcttttttacacattgcaataatttttgaaataggtaataactcataaaaccatcacacacatcaggatatgctgtcacttcatccctttctgacatggtttggccgtgccctcacccaaatctcaacttgaattgtatctcccagaattcccatgtgttgtgggagggacctaggaggaggtaattgaatcatgggggcgggtctttcctgtgctattctcctgatagtgaataagtctcactatctgctgggtttctcaggggtttctgctttggcttcttcctcattttctcttgctgctgccttgtaagaagtgccttttgcctcccgccatgattctgaggcctccccagtcatatggaaatgtaagtccaattaaacctctttttcgtcccggactatgttatgtatttgtcagcagcgtgaaaacggactaatacactctcatttctgagtgggacacatgctgtcactcacatatgctggttgctgacttgtgacggaagattctctattgtaccctctggggacaatacatctccagttgcctgcggggaggatgaacatgcaaaaaatccacaacactcagcacagagtctggatttagtcccattagtctgaatgggactaatgcccttataaaagggacctcggggagctctctcgccctctttctgccccctgaggatacaatgaggaggtggcagtctacaaccagaacaaaaggccctcaccataaacctaccatgtcggcaccttgatctcggacttccaacctccggaactgtgagaaatcaatttctgttgtgaatcagccacccagtttatgtatggtacagtgttagagaagcccgaactaagacacagatggaatcccatggagagtctctaatttgctaagctggtcatcaggcgggatgttgccagttagaaacaggaagagctgacattttgtgtatatgaaagaagatagtggacaggcccattgtgtcggctttgtctgccttggcaaactggagacggaaactcgattcaccatcgccagccacgggaggactgggaggacctccagaggaggttaggttgacttcatggtaactttagatcctgaaacctcccaggatatttcttgtcttccctttgatcgctcttccgcctacccaacaggacaggactcgacgcctttctttcctggcagcaagaggtccgttgcggacaagaccaaagtgagcagctggtttcccctacgtgtccttccgggcctgggcgtctctggagctcaggctgacccgagacctgactcccggccagtgggaccagcaggagcctggaagagcgcgcccaccggggtggaggttggtcgccgggggtcgagaaccgcagtcaaaccctcttcttccccgggcaccgcgcacctgcccccggggatgccgaaggaagtggcccataaagcttctctgcaaccgaaagaggcctgaagctccaggagggccgagaggagcctcgttgagcgaacccagccctctgcctggctggccctggtcaacaggctcggaagaggctgatttggaggacagaacggaagaaaagacctaaaggtttcgaatctcatgatgtagagatgttaaaagcctccaatcctaaggtctgactgtgcgggggagcgagggggtctcaagctggatggacccctgagccttcatctggagagtcctctgcacaagctcagacagcaggacaacgcgcatcagtggttctcaagagggggcaacttcgcccttacacgcctctcacctccacgctgggacactaggtcacgaatgggggaagcggggagggagaatgctaaccccctggcatgtatctagtcagcagaggcgacggctgctgctaaacaccttacaatccacgggagggcccctcccctaccccgaagtagccattccgcagaggtggagagactctcgtgtagctcaatgcccacgcacttagccgatgggaaattacgaattgatgaccagttggctcttggatctgaggaaaaaactccagagtcagagggaactctcgaagttttgcccggagcaaacggaagggtggctttgccatcgcctaagatgggaaaatggcaggtgtcacaggttgcaggggaaggtcggagaccagctgagggccccggagccttcctggaaagagtttcccatccagcccgtctcggtttccgcatccgtctgattccttatgatgttgagggtgctggcgtctgggtcctttatgatgcagagggtgcccccgtctcaccctgggcgcctccgcgctcccgcctcctcctggcaacctggtgcgcggctccggacctggcgacccacgaccggctggtcacttgctgccacctcgcaaaggcgcatctctagttcagtggtgagctgcggccgggtcgctgcaactcgctccaggcctccggactcgtggcctcggtgtccctcgcggagccctcggtgtgtcgcttgcaggctctttttttgaagaaagcagggagggaatggccttgtgagagactccaggagcaaagagcgaccctcacaaggcccaagtcctcccagagctcagggaagctgtcgcttctgacagaagaagggagacaaagctccctcctgtgtgtccctggtggtctagtggctaggattcggcgctttcaccgccgcggcccgggttcgattcccggccagggaattgttttacactggccgccctcccgcaggaatcttccttcactacgctgtcagccggcctgctccaagggccagaagcagaacagtctccgcagcggggttaaagccgggcgaaggagggcaagtgctggtggaccacctctcacgacacaccgttcctgtttatctcagtgtccgtcatccgcgggagcagctttagagagcgactgagcgtctcgctccggtgtacacagcccggcaaagatgccagcccccgtggagctgcacccaataagcccaccttctttcccgtcgccaccccggagacgcccatcgggctgagctgcgaataactaagagagaggccaagccaagtcgtggcgtttgtggcagccccggacacgggcaccagccagtcagcggagcctcctcacctccgttgccagcgaaggcgctcgttaggccttgggaagaggcgaccggaggcgatgcccgcgaatttgttaggggggtaagcggcgggtgaggtcctcgagggcggtcccgtttgctgattgagcggtagacggaggcgatgttcgctgacccaacaaggacagcaggtggagtaggcacagatggaaaactgctgccggtgccctaagcagaaggcaggtggaaaaatcagcactaggacgtcgaagcgatggtaccacagtcaaatcccacgacgtctacactctaccaagcacttgcgcacgctcccccttttccattcagtactcccaagaggggttcggaagaaccccgagtccattgtaagctcaggggagagcgggagccagggaggtgaagtgcgcagactcggcagcggcggcgggcagaaccgcgggggggtgagagggcgcggtggctgcggggcgggagccgctgctgagaggcggcctgggttgtcttgtggggtgactgtcggtggaatctttggtggagagtggtttggaagaatggcgaggggcggcagtggggagggtggtgaccctgagcgaccggccagggcgaggaggctgtgctgtccctgcaggccatgtgctcatttccacttacctggcaggggagagaccgtggtcacgaagggggttctcccagagtgaagcttcttcatctcactctagagttgctgatccctgtgatttcctccatgtgggaaacggtgtttgtgctagaagaggctgcgctctttacctgacataacggggttcaagactgacaacgcctcacgcccacccgaaaacgtttacatggcttccttgtctctttttttttctgtcctaaagtcgcctcatcttcacatcccctcttttttttcttccacactcgagagtgtctctctctctcagtaaaagctccaccaaatatttgaaatatctcaaccagaaagactgcaataaatacattatttcattcgtggaaggtacagaccagctagattgagagttgcttgatattttctgctaaacggtgaggcatagagcacttggaaggtttctctttgggccactgtttgtgtactcttgggtttccttcttttccccagacagtatggcgctgtggggccaggggtaaaccctgctttccggctttctggctgcagataaaggcctcagctggtgcaggaatcaaaagcaaaccaaaagacacgtgggttcgccccagtgggtccaagatagagtctgactgtaccaggattccgattagaacagaggttgctgcaggcacaacgcagactactaaccactagagaatcccaaggcgccccacacctactgcccgtcgttttgcttccccacccctctattatttatttgtatatttttttgagagacagaatttcgctttgtcgcccaggctggagggcagcggcacgatctcggctcactgctacctccgcctcttaggttcaagcgattctcctgcctcagcctcctaagtagctgagactacaaacgtgcaccaccacgcccagctaatttttgtatttgtggtagagacgagctttcaccatgttggcccggctggtctcgaactcctgacttcaagtgagtgatccacccacctcggcctcccaaagtgctgggattacaggcgtgagccaccgcccctggtcccccgattttttttattaatgtaaaaacattatgcgatttttacttctttattcttgggcagctacaggttcttgtgattttctctcacatcttctccccatttccccctctccattctgatacatgtcccatcttctctgcatccagccggtgccctctgcacgggcatcctgggctgtcccattgtctagtcctggtctcccctgcttctccctcctccttgtcacgttttcccttttgactcccctgcctctttcccgctcccgccccaccgaccccatctactgaagccgagttgagtgaagggagagcaagcggaacagatgattgcctgaaggcggcgcaaaagaacagaaagagctaccgtgagagccgtcggggagttcagcttcccttgggccctacttggctcaggctggggtcgcagatccaggcatttccagaggcactggcttctgaagcaggcgagggtgaacgcagggtgaaggccattcggccgcccttctggcttcagagtcacgcaatgcacgcgtttctaacgtgcagcaagacgattagtcgactcagcctctccggttttctgaagctttgtagtctgcacagttgtcccgcagaaagcgaatggcaactcctagggtttagtgattgcttaatctatatagagatgaaagcaagcgattgaggttgtctctgtggtgcaatcggttagcgcgttcggctgttaaccataaggttggtggttagagaccacccagggacgtgattttaaatgttggttgtgaccaggcgcagtgcctcacgtctattaatcccaacgctttgataggctgaagtaggggaagcctccacggagctcagaagttcaagaccagtgagaatcccacctcatttaaaaaaaaaaaaatgcagttgtatctatctcctcagacccttcaatgtatttaaaagtgaaagactgttcccttgtgtcttgtgcatcccatgaggacagacagcagaaggtccccctccaagcctcctagaaaatgagatctctgcagaacaaactagcttgtatgtacgggaaacggaaagtatttgaaggaacaaacttcaaaaattctgccttgctttccacaaaaattaacccatcacagtctgccttcaagtggcatcatacctcttcccatgactcctccccctgcctttatgctattgtcatgcattttactttacacctgttataaaccttacaatccatctctattacttttgtttcaagagtcagatgtgtttttgtttgtttgtttatttttgtttttttgttgctggtggtggtgtttttaagacgagtctcactctatcggacaggctggagtgcagtggcacagtcttggctcactgcaacctctgctttccgggttcaagcgattctcctgactcagactcctgagtagcagagactacaggcttgggccaccatatcggactaatttctgaatttttagtagagaggaaggttcaccatattggccaggatggtctcaaactcctgacctcaagtgatccaccttccttgaatcccaaagtgctgggattccaggcgtgagccatcgtgcccggctaaacagtcagatgttaaaattatatatttgcctatgtacatgtcatttctagtgtcttttttttttcatccagattttcatctggtgtcagtttccttctgcctggaggactcctttaacttgtctattaggtgtcttaaacttgcactgtcattcactgatgctctgttcatttaaaaaaaaacttgttggccgggtgcggtggctcacgcctgtaatgccagcactttgcgaggccgaggtggtagatcaggaggtcaggagatcgagaccatcctggctaacacggtgaaaccccgtctctactaaaaatacaaaaaaattagctggctgtggtggcgggcgcctgtagtcccagctactcaggaggctgaggcgggagaatggtgtgaacccaggaggcggagcttggaacctgtcaaaaggcattcttagccttaaaagaaaagccagggacatcccttgcctcaggactctcgaacttagaaaaacctttcaccctctatgtggatgaataacaagggacagcttcaaatgttctaattcaaaggctgaggaattgctttggaccagtggcttatttctctaaacagctagaccaggtggcagctaggtgactaggaagcttgagatctgtggctaccatcactttattgttagaagaaaccagtaagtttaccttgggacaaaaattacatgccataccaccccacccccaccccctgccaccccatgaagtacagtacagagggtcctagaggcaaaagtacaccaatggctaacagggagccagttacttaaatatcagacccttctgcttgacaccccagatgttaccctgaaagtatcctgattttgaaaccctgctactctgttgctgcacctcacatctcaagaaacagatcccaaactcattgactcctgtgtggaaaccacggaagagctctactctagaaggcccaaccttgaagacaagctgttgtctaacccaaatgttgagtggtttagagatggaaatagctatattcatgagggagtaagaaaggaagcttagccaacaagaagtcattgaggccaagggtttaccttctcagacttctgttcaaaaagcagaattagctgctctaattagggccttccaaccatgaaaagacttaagctggacacggtggctcacgcctgtaatcccagcactttgggaggccaaggtgggtggatcacctgaggttgggagttcgagaccggcctagccaacatggcgaaaccccgtctctactaaaaatacaaaaattagccgggtgtggtggggtgcgcctgtaatcccagctacttgggaggctggggcatgagaatccctgagtttgcagtgagctgagattgcagtgagctgagatcatgccactgcactccagcctgggcgacacagcaagactccgtttcaaaaaaagaagaagaaaaccaaaacctcaagagtcaatgtgttgactgactctaaatatgggttcctggtgctccatgctcatgcagccatagggaaggaaaggggactatcaagagccaagggatcccccacacaactttactcagatcttggaacttttagatgctgtccaactcccaaagaaataacaattactcactgcaggggacaccagaagggagacacttttattattagaggaaattccctggtggaaagagcagctaaggccacagctaaggaaaccctggtatttcaggctgctgcgctactaccaggtactgcatccgtgtcagtgacaccatactatacccctaaggaaattaaagggactgagtaaaaggcttccagggagacccctctggatggttgctagaaaagaacaaactctattcctgaggctgacaaatgggaaataattaaacattttcatgattcctcacatttgggacaggattttccatttaaattagtttcctaaatattcttgcggaagggactgttccaaactataaaaagggttaccactcaggaagccaccccataccccgatccctgcttaaacctgtacaacaccaaggaacataccatggtgaagactggcagacagacttaacccagatgccaccttacaggggagtacaagatttgctagtatttatagacactttcaccaggtggatagaagctttccccacaaggacaggaaaagtactggaagtgtctaaattcttaaagaaatcattccaagatttggattaccaaaaggtttgcaaggtgacaactgacctcacttcacagctaaggtgacccagtgaggtcatgcctcagccttaggcattacctatcttcactcctcatggagatctcagtcttcaaataacatagaaagccaatcgcgacattagcaaaactctttcagtttgggggcttgcctgccctgcgtcactatcattgtttccttgggtttcccaggaatgtacatgtgtcagactgccgccctgcttatagatctgtttccctgcaaggaaacaggaatatgttgcctgtggcttccagagttggagatacatgtagttgcacccctgagggctaacatttaattttggaatcaagtgatgcattcagactggttgttatcattctgtggtatatatttagtgaacacattctgattgagtttcctgcttttagctggagcaagaaagtttaataattgtgatttgtatgaaaaaaatcataggcaagggaatgggtgtaaaataaactttattgtcagaggtttctaaaggctcatccttcaaggaaaacggacatatgctgaagagctgataaaccgtctacagcagtgttattctaagctaatcttgattccaagttcttgccattttcctccagctgctgttgactccagttatatataggatgggggaaaggggattatctatgaatgtaggcatcactctctcttgggcagttatcacattggcagactgaagggatgtgatttctacagtcaaactatccatttggagtacaaatctggagtggctgtaaaattcggttctcagagatgaacttgcagattcagactttcaattgttctgttgttttagtttttctcatcaactggggaactgtttgtgactaagctttgttaaaagtagagaagagtttttcatagttccaacattagttgttacccgaaacaaacaaaaacacacacacatacaattaaacaataatctttggtgaggtcttgctgatacctgaggctggagtgagagctgactggtgatacaggccaggtgcaaactgagtgcaactaagtggataatctccagtagtgaactacagtctagaagaagatagtaataatagattaaaaaaaagtctcctgaagtgaaccagctggcgtgtggtgtaggacacaggaccccacccaccttatgattctaagagccttgctcaaagccactgcagttgagttcgctaggtctctaccacctcctcagcatcaattgactctccataatactcctctggagagaaataagggtctttcaacctcccaggaagggatttgcttagcctcaaatatgcacattcaggaatagcttgtcgtaagaaagagaggatagtttgcagagaaataaccctcctaagtccacatcctattccttttaaataagagagtggtgacaagggaagagccctagaatgtcaaagccaacagggtgctcagataccacccaagtacagttccatctttggccataaggagacaatggtgtcaagaggttaaggccgtatgatctgtaggtgaaaaatctgggatgggaatcaagtcctcaaaccttttccactacatcacagagtttaggagcagttagagggaaggcttcaatctggagaacactaacaggctctagagattattgggtcatggtggctgggacagaaataaggattcacagaaagatgtttatagtaaatgttcttttgggattttgcttgataaaaaggctgagcaaaagtaaaaatttatttcttttcttttcttttttttttttttttttgtttagacagtttcactcttgtttcccaggctggagtgcaatggtgcaacctcagctcaccacaacctccaccccctggggttcaagcaattctcctgcctcagcctcccaagtaggtgtgattacaggcatgcaccaccacgcccagctaattttttttttttttttttttttttttagtagagacagggttcctccatgttggtcaggctggtctcaaactcccaacctcaagtgatcctcccaaagtgctgggattacaggctccagccaccacacccggccaaaagtaaaaattttctaattgcaattctgaaccacttaggggttgtgaaatcaatatagtggactgcttattactacaggctttatttaaattctaggtagggtggattacacatagtaaaagattttttaaaaactgatcacaggacaggcgcggtggctcatgcctgtaatcccagcactttgggaggctgaggcaggtggatcacgcggtcaggagattgagaccatcctggctaacacggtgaaaccccgtctctactaaaaataaaaaaaaaaaaaattagctgggcatggtggtgggtgcctgtagtcccagctactcaggacgctaaggcaggagaatggtgtaaacccgggagggcggagcttgcagtaagccaaggtcacgccaatgcactccaacctgggcaacagagcaagactccatctcaaaaaaagaaaaaaaaaaactgatcacaaagaattgtatatttctcactgcgtcttgtggtcagaaaagtttgagaaactactctacataggcaaattacaggtccaatctctccatctacctctttatctcttctctatttccacgctatgcagacaagaccacggagagaggaaggcaaattccatcaatgggtgctgttaagccttttctatgaggtagctgcacatttggggcacttcaatactggttacttgagattctagtagacagattgtccttttcatctctagccacatggtaaaattacttgggagctttttaagactactagtggcttccacccacctggaagcatttaaatcagaatctctatgtgtagagtccaggcacttgtgttagttaaaacctcaccaggctttataatatgacagagtggtttaaagctacggagtagacccaccctatttcctacctttctctttgtttctctttcaccataggcttctttcccatgagaaagtaaagattttagtctctgttttcagagtctcaagtaaatcactctctttctcaactggacttccaaggcaaagatttctttctatttatctatctgcatttttacaaagttggcctctggattcccttttcccaaacctaattcaccacaaaggtgcccctcaagtcaaggagctgggctttcatacacctgcacctgtcaatcatggtaaatattttgcaggcagggttgctgggtgctgtgggattgacgtaaactcccaggtattgccagctctgagcctcaggcaagcttgtgactaaatgactccagtagtctgaggatagtccttactcagaagggtctttggaagcaaaagcaaacataggcatgagagggtaaaaaaaaaaaaaaaaaaaaaaaaaaaaatctcatgtcatcttggcttatacctaacagaacttgtgcaagaatggatattaaggtgggtattgtacagagcagaacttaataaataccaagtctggagtttaagggataggctgaagagattttgcaggcttgtaaacatttttgccaacttgaacacacttttgtttgggtttggtttttctcctcattggtaagagctacgcacaatagggtagctaagatattataatttgaatcgatacatttgtattttgccaaggatcaagatgaactatgatgatttccattttttagtactttattttcatcagtttgaaaattaggacttttgctccttttttggcttgtggcacctttttggttttcacactttctcaaagaccagtaacttagaatctaaattatgattgcttattctttcagtactctaggggaaagttgatttaatcttgacaaaatgtattcagttaaaataattgttctcttaaatctttctttctttctttctttcttttttctttttttggagatggagtcttgctctgtcacccaggctagtgtgcagtggcacaatcttggctcactgcaacctccgcctcctgggttcaaatgactctcctgcctcggcctcccgagtagctgggcctataggcgcatgccatcacgcccggctaatttttgtatttttagtagagatggggtttcaccatgttgttctcttaaatcttttcaccttttaagtttgtccttcctttctccaatttgcaataggggagtgtggctcgcagctaaatagtagacttctcagagctacttattcctggagcctggcagtctgcaggcctggagggggagcatctagaaagcagccctctctaagttgagaataactatgagaattgtgggttataaggctttgagcagctctggcctccccgtcctcttttgtttctactgtgggatgtgacaagagaaggaactcatctgagagagacttcatattgtggcctttcaccgattacttctggaaatttgattcaggcaagccagggagagtgtctggtattcttctctgagaagaagaattcattatacagctggacaatggaatctatgatctgcctgtagaggttagaggtgcatcctgttccgggaaataattacaatttaggcaagttatacatgtttgcttaagagaatgctttctgcacatttcatgttcttcctttctatcttagcctagggagaaaaccgtggggactcagggctggaactttagtgtgatggggcagaagcttaattttcacatgattctcaacaaatggcagcatatcccatgtattatcatgtccaatggctgcaatatgaaggaggcttttccgaaatagttgctgctttggtaaaaaattaactagatggattcaaagtcaaatttgaagaaagctgagcaggcagaagaaacaatcagtgaacctgaagataaggcaatggaaatcatccagtttgaggaacagaaataaaaaaagattgaagaaaagtgaacagagcctaagtgaccatcaagtggaccaccatgtacattgtggaagttcttttttgttgttgttgttttggggggtgggaggggggaaggagtttcatttttgctgcccagactggaatgcaatggcgctatctcagctcaccgcaacctctgcctcctggtttcaagcaattctcccacctcagcctcccaagaggctgagattgcaggcatgcaccaccatgcctggctaattttgtatttttagtagagacggcatttctccatgttggtcacgctggtctcaaactcctgacctcaggtgatcctcccgcctcggcctcccaaaatgctgggattacaggcatgagctactgctcccagccttgcattgtggaatttctaaagaagagggagagaagggcaatagagaatatttgaagaaatcatggctgaaaacttcccaaatttgatgaaagacatgaatacaaacacagtagcctaacaaactccaagtaagataaacctaaagagacctacaccaaaacgcattataatcaaactttcaaaagtcaaagagaatctttaaattggtaagagaaaagcaactggtcacatgcaagaaatctttaataagattatcaacagatttctcatcagaaactttggaagctggaaggacaggaaatcaaaagctgccaacaaccaggaggggtggctcatatctataatcccaacactttgggtggctgaggcaggcagatcacttgaggtcaggagctcaagaccagcctggccaacatgacaaaaccctgtctctattaaaaatacaaaaattagccaggcgtggtggtgggtgactgtaatcccagcgacttgagagaccaaggtgggagaatcacttgaacctgggaggcggaggttgcagtaagccaagatctcgccactgcactccagcctgggtgatagggtgagactctgtattaataaacaaacaaacaaacaaaagctgcccgtgaaagggaaaaggatcaataaatgggtattccaaaaagtcaaaagtcacacaaatatcaagccaaaataaactggtttcctgactggaaatcgaccccaggctatggcagcaaaacacagaactttaagcactgaactgcaaggtagagcagactttattgtgcatcctggaagggatccagagcaggcagtttgagcttatgaagaattttaactttgtttcgggtcaaattttgctctttaatttagttaagagaattttttttccctacacaacacacataatattgtcaagagaatttttaagggtagccatgacactattatgtgtgtttgttttaatttgatcttcctatgaactgttaaaataagagatctctaaaatcttttttttttttaattcaggtgtctaatttaagggatccatcttcaggccattggcaagtagaatttccaatggtgtaattattgcaatagcaattcaaccaaatagcccctttgtggaaagcccaggatgtcattttccaggttaacctcctgggaagggcaaagaagaagcaatcccaaagattcccctgcaagaaaaaagttcaatgcaaggagtagaccacagatgggtaaggatgatgttggcctccagtaacccagatatttatgggggcttccagtcacagacctctgaatctataataccaggtaggccctcttgggattgagctttcctaggactaaccaggcaacaagaattgagatgacaaaagcctcaaagggatgggacttcttaagacaaaccccaagagcttgacatggtcagaacaaaaagtgtgctggggttcccagccattttcagacaggccacctagtatgacctgatagttactgcctctttccagatagtggaaaccaagagaaagcgctcccacttgctcacaagtcaagctctcaaggacataaaataagatgagaaggaacctcaaccggtacccccttttatgacagaataacacatagagacaaagacaaaggaacagacaatttctgggaacaaagggattaaacaataggaattggtaccacaaagtaccaaaaagcacaccagagtcactacacccaagactagtcacacaaatccttttctccaattaatcaagattttggagagggaaaagaaagaaacagtgatttttactgtccacttgatgagattccacacagagaaggaggccaggagcctggctggtaaaaaaattcttacccttatgacagctgatcagatcctgggttcttcactgcagcttccagaagagcagagctttcctatcctgcttacagctccaaaactgtaggggccaatggaaaccctccctcttaaccctctgaagtttcactcaaaaatcaagtcgcaaaaggcagattaattggaaaaaaggcataaaatgtactaacatgtgcatggggagagtcacagagtgattaccctcccctacccacaatgggatgcagaagcttatataccatcttgaggtaacagaatgaatgagggctcaaagcatggccaaaaccaggtgcaatcagagtcagaggtatatccaattattgtggacaagataagtgatggtagggagagaagaggaggcttggctagcaaaggtggtcttaatatgtaaatgaaaccctacagttagcagctctcagagagaataaaccctaaaaatttctttcagacctttacatgtgtcagactctcagttaatctttcctagatctgggcaaggaaagacttggctgtatcaatgcagattccctacagatgcaaatctccccaacaaaagacaactttgcagggctacttctgcagctggctttctgaacagacatctcaaaatatgtcaaagaaatgtagtttggggtcaaatatttttaattccttcacatctacagcctgatgcatcggccgtttcaatgcaacattgttggtggcaactccattcttccctatactcaagccaaaaaaccaggttctccttgaggctagtctttttctcacagcacacatccaatttgtcagaaaacttatgtttcctgtttggttaattacagattttgatctgcccaatctttctctttcttggtctctgaattttggcaaaggagtctcctgatacaggcaggatagattctactgacgattctcaaaaccgtcagacacttaagagccttaatctcggggtaggggtttgggccgccctcgaaccttttctttgggcctccccatcaaaatcagtctggccaggcctgtcttcaaggcccaggggcagggccaggtcctcccgatgcttcttgaagcttctcctgccgggtcagcagccaccctccccttccctctgacctgcagagaagcttcagggggcatttattcaatttgctaggagctcacggatgcaggtgcgcggtgactctgtggttcccaccgcacccaccgccctccttggtcctctcactgtctgaagcgggcagtaatgttcagggtgagcttgggctccgaagacacccagtcaaggagggaccagtagggaagggcactggccccttaggtccttcccagctagggatccgaaaaagttcttgaagaaatagaaagggagagttggaagtagatcaaagggaaagaaagaaaatcctagatttcctatctgaaggcaccatgaagagaaagtccgcctcctctgggccgcgtcctcacgtcgctggtgaaccaagttctgttctccattggagaccaaatcagttgactttggcttgactcctagtgaaggagccccgctttgtcctcccctgtttagctcttgatcctgaagcacttgattgtctctcccgggcttttgatggatttcagggatgcaactgagaaatttgtttttaatgcacttaattgaagtaagaatattttaaagtattttggcaaagaaaaacgtttccttttgcaatgaagacattcagatgtaaggaaaatcactaggctctcacaaacacaaattccatgtcagcaagtagatttgaccctcaggttgggcacactttaagtgtactgttggaacttaagatgaatctaggacattcatgattaatatttttagttttttagtacaatttaatattttaaatttaaatacacattctgaaaattgtataaccagcacaagaaaccggctttacgccatatttacaaacataggaaagaaagatgatattttaaatgacaatgcttcataaatggcaacatttttaaagtacctagagaaaaaaagttaatctagaattctatgcaaaaataaaatttcataactgtgagtgaaataaggacattgaaaaaatacaaaagctaaaagaattcaccaacccatgctgcaagaaatcttaagagtcctccaggcagaagcaaaaggataccagataaaaatgcgggcctacacaaagaaacgaatattggaaatggcatttagaaaacatgtactacacgttttcttataatttaaatctttcaaaaaatatttgacgtaataaataaaagtaataatgaatcacaaagcttatagtgcataaagtaaaactacataacactaggataaaggccagaaagggaggcataatgacactagaaagcagactatgataaattaaagatgtatcccggaaaccctaaagcagcctcttaaataagaaaagggttatagctaataaagcaacaaaggaaagaaaacggaatgaaataaaagctatgtaaacactatgctggaacaactactctccaggcctccaccctatagaaatacaccagtggccaatgagagtgtacaagaatgatgactgcagcattacttgtaatcataaaatgataaaaccaacgtaagtttaaagatatatgaaaagggttttatttatttaacagacagacaatggaacaagcaaacaatgggagcaagtcctttgccaaaaggaacacagagggtcatgatgatgctactcctccaaggatttcagagttcccagacgcctagttttctgtctagttcttctggaagatgttattcttggggagcaataggtcctcgagtttggggctctttcaggttctctctccatttccccattctgctacaataaacaaacaaaaacaattctcacttccagaagatcccgcctgtgcctctgcatgcgcctttcaggaggtctggatgtctggtccaccgctcccgggcttctttcccagcttttgcttttccctttacctgctctcgccctacggccccagggccggaccacggcccagctgagccccgcggctccaccgcgcagaaggtgcgccggaggccctgccagtttcccgccctgcagggtactgagaaatcaacgatttgtaaaaagaacttccccatggaaaaaaatctgttgatttccgctctcagggctcttcaaaggactaaaagctaaaggcgacaatgaattcattcgacaagtcctagtcgtgagccctggtgagtgccagaccctgctccccccgaggggacccacgagcgaccctcaccaccatccctgccctggtggagcccccgtgcggaacacaggatccgaagatggcagcggaagctcctccgcggccccgagagcgactgggcagggtgggcacaggctcttcaatgggtgaaggcggcgcaaagaacgggaagaaccatcccaggagcccacagggcgttcagcttcccttggggccccaggcggctcgggctgggtcgccgacccgggagttcctggaagcttctgaagcaggcgaggggcagggcgggcgaaggcaattccgctgttctggctccagaatctcctaacgcgcaggcgtccaacgtgaccggcgcgactcaccgctctaatctctctggttttccaaggccttgctcggtggtcctgccgggcgggctctgggagtagagggaagggagttagttcagtgagtgggcccttcccatatcaccagtagaagcggaagcgcttgtctctgtggcgcaatcggttagcgcgttcggctgttaaccgaaagattggtggttcgagcccacccagggacgcttattggaacttttgaagcattcatgcattgtcaatcactaggtaaatggggaagattttatcttcccgaagtcccaagccactcatttatgactgatccatgtcaagggccgcccacctccccgaccagattcttaaccggctatctcctgaaatgccgggtttacacctgtgtaacttaggaatcctgaaacagagacctaggaacccacttctggtgtgataaaattctaattcagtcccttatacgcttaaacaagtaattcacgtgcctccattttttcatattttagtaataggagtccagtattacctccaggatgtgcctgggtttcctgattgctctatcaataatgtgaccagtggaatctttcatcatgatagtgatcctctccatcatttttgaaaacagtatttttcctcagtctgtgcatgatttatttaacccttttcaaaatgtttttgttagccaggcatggtggcacacacctgtaatcccagctactcaggaggctgaggcaggagaatcgtttgaacttgggaggtggaggctgcagtgagctgagattgcaccactacactccagcctgggtatcagagtgagactcccatctcaaaaaaaaaaaaatgtttttgagatgatgttggtttcatggttttaggattacaaagaatgctgcagtcaccattcttgtacagatatctttggtcattgtggaaatgtctacactgcagacatttctatagtgtagagagctggatgcgccattgctacattatagtgcttatataatgcttctaatttgagtccattctgcaaatgtgtctttcacgggagcagtaccaaataatattccaatatgaatatttataaaatgaaaatgtgcagatgtgcagttgagctgcatgcctctccatggggcccatgttcataaaatggtggcgttagcaatcatctgagagtggagtttgtggccctctgacgtcaaaatctgaggcaatggacatgaaaaccctcactgtacatcctccgtagtctggccagaatcattcctgggtcggtggtctcttatcaggagggaatgctgcttgctttttttgtcaaaaccacaaaagggagggaaagcatcaggctgttggttgataacagtagtgaagcaagtctctccaaaggcttggtttgttaacccttaggaaaaaaatcctaattcttgccagatggtgccatgcatttccaggctcttggtgtcccaaacaaagaactgtacatgacacacacaaagcagcaaagcaaagcaaaagtttattaagcatagtaacactctcagagtggggagagtggactgacctctgggatgtaagataagtattagtttggtgtactttgggtcgttttatgtgtgtttttttttcttctcttcacaaggatgcctaatcgttagccagtgtttgccttttgattgataggtgggttgcttagttactttggcccttgtgtgcttgcacattggctccatcccataattttaagtacatgcatgatgtgcagtccatatgcatgagttttaatgagctgattatcatacggagtcatgttaaggatactttttttctctcatgcacatgcctatctctgaggagctgcccctttactggtttggatctcgctggccatggggtccttgcttgcttttcttttttttttttttttttttttttgagacagagtctcgctctgttgcacagtctggagtgcagtgatgcaatctcggctcactgcaacctccgcctcccgggttcaagcgatgcacctgtctcagcctcccaagtagctgggagtacaggagtgcaccaccacgcccagctaattttttgtatttttagtagagatggggtttcaccatgttggccaggctggtctgaaactcctgacctcaggtgatctgcctgccttggcctcccaaagtgctgggattacaggcatgagccaccgtgcccggccttgcttgcttttttaaatcttactttttgttttggctgctcaacttctgccttttatcttgcttcttgctctcccaccccatcaccttgcttctgtttctgcttttactcgttctgccttttatccaacttccaattccctctgctgttctcctgcctcataatggcagttagtgagcgggggttttgaggtggcatgtccaacctcctagcctgccacatccagaaactgctttcaaggtttctctgtggtcctgtcagccaagagggagtccgcagttgactgtagggactagggcttattttcatttctcaatcctgacaaggtaaggctggattaacgcagattctctgcaggtgtaaatttcccctacagaagacagttttgcagagttccttctgtttgctggttctctgacagccatcttaaaatatgccaaagaaatacattctggggtaaaatattttgattctcttcatctatctacagcttcaccatgctggcagcctccaatccaagcatacctgaaaccttcttttttttttttttttttttttggtttgagacagagtctcgctctgtcacccaggctggagtgcagtggcattatctcggctcactgcaagcttcgcctcccaggttcacgccattctcctgcctcagcctctggagtagctggtactacaggtgcctgccaccgcaccagactaattgtttgtatattttttagtagagatggggtttcaccatgttagttagggtggtcttgatctcctgacctcgtgaccacccacctgggcctcccaaagtgagccaccacgcccggcccctgaaacctttctttttaaaaagctttcccacctttatgactgccttcaagtctctgccaaaacacaagtaacagtgactgactccctgctataccaagctcacagtaaatagcctttgctgtttttcatttggttggtctttgtttatttgcagaagcttcaatgtagagttgacaaggactccaatctttgaccaaaccttagtagtttcctctgagcccttttctctgttacttcttggcctgccaagtccagctttaggaaagaatcctgttgagtctagtttagcaagagtcctcgcaaccacctttgatagctaatcaagttcctcttagtaattttccatccactgactttcttatcttgccaattggctataatcctcaactcctcctgctgtatttgaggttgagcccagttctctgggctcaacctcaaatacacgtgtccagtgcagcccctcagaaactacctttgcaaaattatgacaatcagagaaagctgacatggctgactccatcttggttctagcctcacaggcttgctgtctttgctcattcctgtgcaatttctcccaagctatctttgggaaaaattgagtttatagtttaaatcagggctccccaatccccagggccataagacaggtactggtccatggcctgttaggaacccagctgaacagcaggaggtgagctgcaggctttcgagcattaccgcctgagctctgcctcttgtcagatcagcatgagcattagctgctcatcggagctcggaccctattgggaactgctcatgtgagtgatccagattgcgcactccttatgagactgtaactgatgccactgatgcctgatgacctgaggtggaacagtttcatctggaaaccatccaccacccccttccatggaaaaattgtcttccatgaaaccagtccctggtgacaaaaaggttggggacagccaaaaatctggtttaaatgataaccttccccaaaactaaattacccctgtaaaatgaatgaaaggccaccaagttagaaggatgaaagcggcctgatttctagtaagatgtatgcctccttaaataattaccagccattattccagaagtcacaagattggcagcttccccagttactgctgtgaagaacatcactattgtagaacctaagattggcctcttgagatgtcttttcaggctttggcatttctgactgctggatggcaccatttggcccgaaaatcaaccagtcccttagcccccacccagaagctgactccatgcaggagggccattttccatgcccctgtgatttcatccccaacgatcagcaccacgcaagccctagccccctccccaccaaactatctttgaaaaaccccttacctccaagccttcagtgagattgctttgagtaataactcttgtctcccacatgtcgtggctggcctgtgtcagtgaaactctttcctgcagtgccatggtctccatgaattgattttgtgtgtacattgggcaggaagaacccatcaggtagttacatctgcaggatggtgccagttctttccacaaaggctggtcagatacccagaaaacatttctccactactacctggacaatgtgtctccctgtcaatctccagggaatggggcctggatcaagtatttagtattcagcagttactacactgtcacctaatccctcattttcaatatcttgccatgccttccagtggcctaactggccaccatgccacagaatctttatggtctccaaggagaactctctacttgatgttttgtgatttgagcaatggaatagaatctgatactggtgggctgggggaggtacccggacactggtgggatctcgaccccagccgtggtgtccaggctcttgacaccatcgcgagaacaaagtcaaagatgagtcagcagatagtgaaagaagagatttattgcaaagcaaaaagtacacactcaagaaaggggagttcaggcatacccaagagagaacaatggattctggggtttcatcttgatgggtttctttaaccaaggagtggaatgttcatgaaaattcctgggtaaaggtggagatttctcggaactgtggtgccatccatttttacatcaaatattggtctcagaactgtcatggcactggcgggtgtgtgatttagtatgttaatgagcatataatgagggcctaggtaaaacctccgtcaaatccagcaccacattgggtccactcagccttagccagcttggtccacaccctggtttttcagcgtcttaacagcccacagcctcaagtcatgtaaatctgctgcctagaatttgttatcctgtgaccaccctgtagtattcctgtctgaaatctacttgtaaatattcaaatggtctttcacttgggcattccaactttgcttacttcacagtgtttcctgcgtaatatataagaaaagatgatccagacattgttaaacatctcaaataagatgtagcccaggtatttgtgtcaaatttggattattttgatttcgtctttgcagaatataaaaaactaacatgaggtaagcactaaggtgtggagatggctgtgcaagagatgacaaagtccagcaccacgcttgagagtgtccaatcatctcttctggggcagcatagttttctacaatactgattttggaaaaaaaatcaaaaaaaaaaaacctacaagattcatgaaactggacaactgtctttataacattaccagtgataaaaccagtaaggaaggctggtttgcagtcatctgagcagcctctttactttcataaacatggtttctctcggcttccaattgcaagtggaatgctgcatcacagggataaagatgtgaagagaaccggtttcttctgtaatccgaaacattctagtctgcgaattaaaagccattatttgaagaaggatgccccggctccatctggccaccgaaaggttgctccttaacacaggctaaggaccagcttttttgggagagaacagacgcaggggcgggagggaaaaagggagaggcagacgtcacttcctcttggcggctctggcagcagattggtcagttgagtggcagaaaagcagacggggactgggcaaggcactgtcggtgacatcacggacagggcgacttctatgtagatgaggcagcgcagaggctgctgcttcgccacttgctgcttcgccacgaaggagttcccctgccctgggagcgggttcaggaccgcggatcggaagagagaatcccagctgtgtgtcagggctggaaagggctcgggagtgcgcggggcaagtgaccgtgtgtgtaaagagtgaggcgtatgaggctgtgtcggggcagagcccgaagatctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttctaaaagtagactgtacgctaagggtcatatctttttttgttttggtttgtgtcttggttggcgtcttaaatgttaatcctacagtggagggctggcgaataggaagtaacatgtcgcctgcacgccataggagaaaaagcgagcatcagccgtatcggctttgtaacacaaattagctatcgtgaagtccgctcagctcttccctttctaccctggctgctttttgcagggattggtccgtggtctccagtctcttgggttctcaccctgtgtgaaaatcttcctgtttttccctaccccccaagtcacctcttacacagcctctgcttccaagcgcagcccccacaggagtttgtaggatttctgtgctagcggggagtgtgttctcacctcatagagccaggtagaaactacgcagatgggtgctgttctccaggaagaaagcagggcctttggggctctcagtgtccccgttgggttgtagacataacacgcttactttgcgtaggggaacggctctgccggcccccaggtgccctcgcgcatattcatggaggcccgtaggtcagaaccgcagtctcacctgtcttggcggaaatgccctgcgatcctcccggagatagaaggcgggaagttttatgaggagccaggtacagtttccctactatctccggcagttcatatatctagtgtttcttcagactttatttaagcgacagcttcttgtttgatgtctcgctcccacatcctacatccattgccaggcaactttctagatagcacccagacccatccttcccacccccaagcagccgtttcctatttctggtgccagtgtcctccccagtccctctttcttcaggccctcgcttatcaccttcatggacagaaaatacttagctctctctcaacctgcggtttatacctgacacgcgtcagtaccctgacaaattccttaataccctttctcaaatggcactgaaaatgcatttctttttaactcccagaagtatctaattggttttgtccctgaactacatgaatactagtattccactacagaggaaaaccccaggcctagcgatggcggttctgggcattgtgccagcctctcccagggtatgttttctgacatcacctacttttgatcaactgaggtcaggagttcgagaccaccctgaccaacatggcgaaactccgtctctactaaaaataaaaataaaaataaattgccgggcatggtggtgtgggtctgtaatcccaactactcgggaggctgaggcaggagaatcgcttgaacccggcaggcggaggttacagtgagccgagatcgtgccattgcaccccagcctgggcaatagagtgagactctgtctcaaaaaaaaaaaaaaaaaaattagtccatctgagacattgttgttggagacagtagaatcctgcatccaacaggcacttggtgcagatctgaacccattgagctattggctcatgttccctatgttctattaagtatcatgagcagaaattgagctctttggcttttacccactgagtatggctataggacaggtctctctctctctctctctctctctctctctctctttctcattatttgcatcattattttttgccatcagtgtgggtttttggttttgaggctatgaagtgaatttctggggacaatctctgttgggtcgtgttgacaaggatccagtccctgtttggtgatacatgacagctaatctggtctgtgagtcttctttattgtctatttattgtcctgagaataatggtatttcctgaaatttgagactgcagcaatgataagttgttcagatcttgtctttccaatgtttggtaaaaattttataggcccaattgttgtcaatatctgcaagagtggcatctctattacaagagtgatcttactactcaatgtcccccctcccacccaacttcatttcctaggggctcttggctttaacgaatttactgtatctaaaagacatcttagtacaggaagaaaactaaatctgtagcatgtaaggagcagttttctttgattggtatattcaggtttctaaccagctgaaaaattcaaatacatgtcctttaaggattaagtttaaactacactacagaaagaagagaaaagatttatatgatcacatataagcaatggaatcagcaatatgagcacttttcacaactatataaatcaaatttagtaatctccagaacattaaggaagttcagcccttaatgaaaatgaatgaaaagaaattattcacccactgttacatgccctggaaagagaatgccctgcaggactcaaaagggtaccacaatattactcagattttcagcaatgaaggccctccaaggatctaatgatactcatattttcagtttatttccttcactgataaacattgttaatagataccattgcctctgttttcactttaagtgatgttacttagcacaattcatttctttagaatgccccctagtttagtgaaaggaattttcctgctttataaatataggatattttctcatgaaacaagttggcgtactctttcagtgaagggactagaccgattaggtctctaaaatgttaaaggagtcactgcctccattatcttaggaacaataataatcacttatataaaattaaaataagaaaattaagccaggaatggtggctcatatctacaatcccagcacttaaagagttggagaccagcctgggcaacatagtgaaactcctgtctctacaaatttttaagtattagctaattttttaaagttggcagggcatgataatgcatgactgtaatctcagctactagggagactgaggcaggctccagtgaactatgattgtgccactgccctccagcctgggtgacagagtgagactcccaactcaaaaaaaaaaaaagaaaagaaaatatagaatttgttgaaaattgttttactacaatgctaggctgcatgtcttgcacctgtactcccagcaactcaacaggctgaggcggaaggattgctttaggccagcggttggagaccagcctggggaacagggcaagacctcatctctaaaaaaacacaaggcaagctgagccaggaggattgcctgagcccagaagttccaagttggtcagctatgattgccctgctgcactctagcctggataacacagcaagaccctgtgtcttattttttattttatttttactacttatgcttatttatttatttatttttgagacagagtcttgctctgtagcccaggctagagtgcagtggtgccatctcagctcactgcaagctctgccttccaggttgaagctatttccctgcctcagcctccagagtagctgggattacaggcacacgccaccacatccagctaatttttatgtttttagtagagacagggtttcatcatgtttcccaggctagtctcaaactcctgacctcaagtgatgcacctgtctcggactccgaaagtgctgggattacaggtgtgagccacctcgcccaggctccttatgcttgaaatgtgaggtttcattagggaaaaattttcttgttgaatttctaacatgaaaaaataatagatttagctgtagattaaattaatggtcttgatagtttggtacaataaaataaatgaaatgaagttgatagcagagaggaatttttgatgcttttggacaatttaaataatgtaatatttaatatataaagacatgaaaaagttcattacattattatatttatttatttatttatttatttatttattttgagacatagtctcactctgttgcctaagctagagtgcagtggtacaatctcggctcactgcaacctctgcctcccgggttcaagcaattctcctgcctcagcctcgtgagtagctggaattacagacgtgcgccaccccacccagctaatttttgtatttttagtagacacagggtttcaccatgttggtcaggctggtctcgaactcctgacctcatgattcacctgctacggcttcccaaagtgctggggttacaggcgtgagccgctgcatctggtctattatgttattttttaaaagtcagtgtgactcttttgacaaattagaatggtttaataatcttggttaggctgggcatggtggctcacacctgtaatcccagcactttgggagcctgaggtcaggagttcgagaccagcctggcaaacaaggtgaaaccctgtctctactaaaaatacaaaaattagccgggtatggtggggggctcctgtaatcccagctactcagaaggctgagtcaggagaattgcttgaacccgggaggcagaggtttcactgagccaagatcgcgacattgcactccagcctgggggggcaacaaagtgagattcggtctcaaaaaataaataaataaataaaaataaagtataaaaaattaaaattatgtgttcaagtaaattaaatatatggcaatgaaaaggaggcccagcatgactgactgcattttgctcctaacccttcctaccctgtggtgatgtctttcaggctaactgctttttcttctttctgcacataggccaagctatctatgggagggatttagcttacagtttaactttaaagcacagatgataataatcctttccccaaactaactcctgagaagataggcaggttgttgaagatttataagagcagtgtgacctgacaaaggacaaagaattttcaccatccccttgggctctcactgcagcccatatgtctgtcattgtcagacctcttcacctcaaccgcctccttcttcctcccttccctaacgtacaaggaacctgaaaatcatattaatttaagatggttctttaggatgttagttcaccatctgttcagtttggtggctctctggaataaagtcaccttccctgcccctacaccttatccctggacttattggccgtcatgcagcaagcggtgagtgcagtaagccgagatcacaccactgcactccagtctgggtgacatagtgagaccttgtctcaaaaaaataaaaataaaaacagagaaatttggttttagaaccagacaaattaaatgggagattacttccagtgagacctagaaatttctaaatttctaaaatttctaaaaaaactgagaaaattgcctccattgaggaagtaagctgaaggaggtaaactgtcatgttttctgaattgagaaatattgaggaggctttgtctctttcacctccagctgctccttctcctcctgcccctgcacctgcatagtctttcttacctgagccttcctgtcctgccttgcttcttcttccatcaccaccacctggggaaagtccccagggctctggccacttccccaaaacttctgttctgacagcccctttaaaggtaaaacccaaacccacaggaagaggggagcctaccattgtgtataccacttcaccaaaacgtgaattaagaatattataaaggacttccctgatctaaacttaaatacatttcactcttctgtttctaaagcaggctccgagattctataggctctggcagaaaatttgacttaactgttgaaacctttgagcccaaatattctgacctttatcaatcaattcacatgctggtgaagaaggcaaggccactaactggttgcaaaggcaaattggaaggattttcaaaaagggactgaagcagaacatgaaaggttcacattttcaccaaatatctccatgttgccactccccaggtccttcctaaaaatatagattggaggataattcagcattgtactaaaaagccagacaaatctgtctttgcttaattaaaatggtttgagagccaggtgtggtagctcatgtctttaatcccagcactataggaggccaaggcgggcggatcactcgaggtcaggagttcgagaccagcctgccaacatggtgaaaccctgtctctactaaaaatacaaaaatcagccaggtggctactcaggaggctgaaggaaaagaatcgcttgaacccaggaggcagaggttgcagtgagctaagatcctgccagtgcaatacagcctgggtgacagagaaagactgtctcaaaaataaaaattaaaaaaaaaaagaaaaaatcagcagcgtagtagaagtataatgcacacaagaatgataatcatgaagacaatctgattctagaagagtaagggaacctattccattagagagccaactgaaaacatcaaatcccagttcacaccccagggtgtgggggcacgtgcctgtagtcccagctactcgggaggattagtaaggaggtttgcttgaatatgtgaggtcaaagcagaagtaaaccctgatcatgccactgcactccagcctgggtgacagtgagaccttgtctcaaaaacaaacaaacaaaaaacccacaaaaccaaacaacaacaaattgtcacctcactctgaaatgacagtggcaaacatcactttgctattggaaaattaaaagaaaaacactccctcttgctatcaacctgccctcttgctctaacatgtctgacccatggtttaaaatgcccaaaagctgatgtactcaaattataatacacttacctgttctgcaccagcatttatttttgtctggaggagatcaccatccatggtcctgtaaatgtctaacggcatggaatgatgaagggcagtgtcttttaggatatttggttatatctatatatatggctctgaagaaacccaacattgggcgagttccctcaaacttttcactaggcatgaccactgctctattttagatagagattctgtggggcaaaacctgagaattatctgcctggctatcaagaagatagctccttgcatttttttggggagaacacttgcttcaagggagtgtttcctcccaggattacaaatctttttgtaacctcaggaaacattgctgatgaaaaccaggcatggtggctctggcctgtaatcccagtgactcaggggctgagacaggagaatcacttaagccaaagagtttgaggctgcagtgagctatgatggcgccactgcactccagcctgagccacagagccagacactgtctctgaaagaaaaagaaaaagaaagaaaaacattgctgatgaaactgcggcctcttttgcagctctataaaaaggtatttagtcactggctaaggttgtactagataatcacatcactttaggtgatacatttagctgagcagggagatgtgtggtggcaaataccttttgttgcatatacatatacatttcccatgtagtagaaccttctctagaaaaaatcagaaaagaagccacttggctgcaagaaatcactaaagaagaaatggggtttgatgttttccctgatgttttcagttggctgaaacatcaaatcccagttccctggttcccttactgttccaggatacagattctctttgtgatgatcattcttgtatgcattatatttctactactcaaattattaatgttatgtatttctcattgttttacttcttttgagaaactaaattcatggtactctgaaaactagagatgattcaacaagtgacagcaactatagaattggccgagatatctctctctctctctctctctctttttttttttttttttccatgttgtgatgccacaccagttcagcttttggacgctgttaaaaagagaggtctccttccctcccctgacccccgtgtgggacaggactatctgggaatgagccattctggcaaggagggacacagcttttgatcgacaatgctttcaagaaatactttttttttttttaaacggagtctcgctctgtcgcccaggctggagtgcagtgggcgatctcagctcactgcaagctccgcctcccgggttcacgccattctcctgcctcagcctctgcgagtagctgagactacaggcgcccgccaccacgccaggctaattttttttttttatttttagtagagacggggtttcaccgtggtctcgatctcctgacctcgtgatcggcccgcctcagcctcccaaagtgctgggcttacaagcgtcagccaccgcgcccggccaagaaagacttttcatctaaagggagaatggggaaagaagagaacttttttattttcaaattctcaggcccagcgaggcattacattgagacagcaaccacattctgcttcctttttgtacactactgtatttgaaaaacaaaaaaacaaacctacaagactcataaaactggacaactttctttataacactactactcgtaaaaccagtaaggatggctggtttgcagttatctgagcagcttctctagtttcatagacatgatttctctctgttattaaagggctcccaattttaagtggaatgctacttcacaaagataaccaggtttgaaagggtccggtttgctttgtaatccgaaacgttccagtctgctattaaaagccattatttgaagacgggtgcacaggcttccagctgcccgccagaagggtcctccgcaggacacaggttaagtaatcacttcttcgggggagactagatgcagggtctcggcgcacctccccaaaagacaagggcgagacagaaaggagggacaggcggacgtcacttcccccgccggctgcggcaccgggttggtgggctgagtggaggagggtggggcggaagaacagaaggggactgggaaaggcactgttggtgacatcaccgatagggcgtttctatgtagatgaggcagcgcaggggctgctgcttcgccatgaaggatttcccgtgctgtaggagcaagtccgggaccgctggctggacgtgagcgtcctagctgtgcgttagggctaggagggctcagggtgattggggattggctggggtggtgctcggggcaagtgaccgtgcgtgtaaagggtgaggcgtatggagctgtggcggggcggaagttcacatgtgtggtatgtagagcacatgttatggttatcaaagtggtttactgtaaggctgagggctatgcattctatggctatgttgttgtctcttatttttccaaacgtggaaacctctgttttgtaacttgtagtaataaggtagaaattaaaaagaaaaagtattttcctgtacttgcttggctgcaaggtcaggaacagatagtttctgaaaaaccacatcgctgagaaatgagttctggagactctcttaacagtctgttatccctaggaaggataagagcaagaaacagcaaatgcttttattaccttctcttttccctttaccatttctcactattcaagttttgttaagttcttgatttcccttcagtgcagctgcaaggtcaccagctattcttgcctcgtgagacctgtcacagtttgactagctgcctttgttctgcttctgtaagccctcttgcctgccccgcgagtttggtgccatcatagtcccaccatgccattcaaactagccaaccccctttttgaagtgtgtataaaagtcaaaccctgtctttgttcggggctcagcctttggattttaatcctctgggcctgagggcactcaataaaatcctcctgttccacccattggtctctctgttctcctgattcccacaacagtagtaggggactgtgtctgcactttcccctggtctttcacggtatgaataatagccttttttttttcgcctatagtcgcaggctcggtctcagtgattttatggtgtggtcagctgtttttgtttttgtgagaccttgtttactgtcctgggacagatgtctgtagtcacttgtttccttgggaggcaaatttcagtctctgtggcagaggtctctcatgttagctgtggtggtacttggcaggcggagctcagggatctaggcttccctgctttgtagactgctcaatggtccccaaggcctactggcttttaccaccacttgaaaaccttagtgtttttccactgtccccagagtcacctcttacacagacttattttgtttgtctttttccccgagacagagtctcactctatctggtagcatcttggtttaagcgatcctcccacctcagcctctggagtagcagaggcacgagtcaccacagccagctaatttctgttcttggttttgttgtggtggtggttgttttgttttttaagagttgaagtttcaccatgttgcccaggttggtctccaactcctggactcaaataatccgccctgccttggccttctaaagtcctgggattacaggtgtgatccatcacacctggccagcccctgcttttcactatagcattcatgggagtttgcaggatttctgtgctggggggaacgtgtactcagctcatacagccaagtagaaattgtacttggaactggtgccgttgggttgtagacataacatgcttgctgtttgtatgggaagggctttgccagtgctctgtgcccctgtgcagggcatccaggcctgcaggtcagaacggcagtctcacctatgagtttgtgtaatacgcagcaattctccctggaatataagatgggtggtcttgtgaggttcctacaagtaagaagacaaatttcccttcagtttgtattgacaaaattcaaaattaataataacagcccaacctcttgaatgataaatgtcctttacattgacagaccagaactgccctgcttgcctcagctcctctgtgcaggtgcagctcacaattccccccacacaggtcatttcctccctgctttctccaaaagagggagacagcagttctgcaggaccacagggctcaaggccttccagggccaaaaatctcagaagaagttgcccgttctgcctgtacctcacgactgacctagaaatggcctttgctaggagcaaagtagggggaaatggtcgccagagctggggcctgggtactgggccaggttaccccacaggaggggaagtactcagggttagagggggccaagcaccaagacctcagcatcctcaacctccaaaaggactcagagagatgcagaaaccgagacagggttcctctttcaaggaaagagacttttgaggaagaccccagggctctgaaccaaaatccagatttttccccatctgcagcttaattccaccttagttggtgcaacttcatccttcccctatgctcaggacaaaaaacagttcttctataggctggtcattctctggccccatacatcctattggtcagaaaattatgttttttctttggttaactgcagactttggtctgcacagtctttttctttcttggtctgaaaaccacccagtagtcccatatgtagcttttttggataaacctagaaattgaccctgctggtcttaaagcttgaaacttaatatttgtttcgtctgagttccttcctcaggaaacaaccttcaggcctctcaaaaaagccatcaaagaactgaaattcatccagacaatgagatgctgggacccctcattcatcatgattgcttccttgctcctccctagttcctgttttcttacacattgttacatttcttccctgccatataaacctctggttttgttggtcagggagatggatttgagactgagttctcatctcccccactgcagcaccctattaaagcgccttccttggcaataatcatctcggtgattggctttctctgtggcaaccagcaggaatcccagatctctgaattttggcaaaggagtctcctgataaaggtgggatggattctactgaccaacatcaaaacgatcagacatttgaaagccttaatctcagggtcggggtttgggccgcccttgggccttttccttgggcctaaccattaaaatcagcctagccaggtctgtcttccaggcacaggggtagggccagatactcctgatgctttttgacgcttctcccactgggtgggcaacaaccctccccttccctgtgacctgcagagaagcttcagggggcgtttattcaatttgctaggagcctacaaagcacaggtacacggtgactctgtggttcccactgcacctgccactctccttggtcccctcactgtctctggcaggcagtaatgttctgggtgagcttgggtgctgaagacacccaggcagggagggtagggaaaggcaccagccccttaggtcctgcgcattagggatccaaaaaacatctgaagaaacagaaagggagcgttggaagtagatcaaagggaaagaaagaaatcctaggagatttcctatctgaaggcaccatgaagagaaagtccgcctcctctgggccgcgtcctcctgttgcaggtgaaccgagttccggtctccattggaaaccaaagcaggtaactttgccctgactcctagttaggaagccatgctttgtcctcccctgtttagcacttgatcctgtagcacttgattgtctctccctggctttctatggattccagagatgcaactgagaagtttgtttttaatgcacttttccttaaagtaagagtatttcaggccgggcacggtggcttacacctgtaatcccaacactttgggaggcagaggtgggcattttacttgaggtcaggagttcgagaccagcctggccaacatggcgaaactctgtctctacgaaaaatacaaaaattagccaggtatgttggcaccggcctgtagtcccagctactcgagaggctgaggcaagagaaacctgtgaacatgggaaggggaagttgcagtgaactgatatcaaaaaaaaaaaaagtatcttttggcaaaggaaatgatttctgacaggttttgcacttaagacactcaggtgtgaggaaaacatgaaaaccactatgctagggaaagcaaatgctgttgagaatgtctcataaacacaaattacatgtcagcaggtaggtttgaccctcaggttgggcacattttactttaagttcactgtcggtggaacttaagatgaatctaagacattcacgatgtatgtatgtatgtgtgtgggtgtgtatacatatacatatatgtatacatatatatacacacacacatatatatatatacacacatatatatatgtctctcatatatatatgagagacagagtcttgcaatcttgcccatattggtctccaactctgggcctcaagcgatcctcctatctccccatcccaaagtgctgggactataggcatgcaccacctcgtccagcccattttaatgtttttaatttaaatacacattcccaaaattatataacaagtacaggaagcccactttcagccagttttacaaaaacaaagtggcaacatcctaaagtactgaaagaaataaagttttcctagaattctatgtcaaagtgaaaaatctttcaagaatatgactgaaataaggacatttaaaaacatataaaaaatgaaagaattcagcaacccacactacaagaaatgcaaaaggagtcctccaggcctaaagataaggataccagacagaaatctggatctacacaaagaaatggagactactgcaaatcggtatgtacatagttaaatatatatgttcttattatttaaatcttttttaataatttatttattttaaattatttatgatttaagtctttttttaataattaaaaaaagcaataataatggattctgggatttataacatgtctgaaatcaagttacatgacaacactagcataatggccagaagaggaggtataatgccactagatggcactgataaaggtgtattcaggaaaccctgaagccctcactgaaaaggcaaaagcagggaaagaagtcggggagcggtagaccagaagaaagaaagagttatagctaataagccaacaaaggaaagaaaatggaatgatataaaaaccatgtaatcattatgctggaacaactgctcttcatgcactccagcctgggcgacagtgaaaccctgtctcaaaaaaaaagcccacccctagggctgggcatggtggctcacgcctgtagtcctaccacttggggaggccaaggcaggttgatcacctgaggtcaggagttcaagaccagcctggccaacatggtgaaaccccgtctctactaaaaatacaaaacaattagccaggcatggtggtgggtgcctgtaatcccaggtactcaggaggctgacgtaggagaattgctagaaccctaggaggggaggttgcagtgagccgaggtcatgccactgcactccagcctgggcaacagagcgagactcatctcaaaaaaaaaaatcgtacacttaaaaggtcacggaggcaagcaaaaatcacctggtggctgcaaagcagaccatcgagaggcaaaactctttatctggggaatttagaggcaattagacttccttattatttaaagcaagaatctagttccaggcttctttcccaaaaatttataactaactagaatttctggggttttttttttgttgttgtttgtttgtttgtttgagacggagtctcactctgttgcccaggctggagtgcagtggcgcaatctcggctcactgctacctccgtctcccgggttcaagcaattctctgcctcagcctcccgagtagctggaattacaggtgcccgccaccacacccggctaatttttgtatttttagtagaaacggcgtttcaccatcttggccaggctggtcctgaactcctgacctcgtgatccacccgactcgccctcccaaagtgctgggattacaggcgtgagccaccgtgcccggccagtaactagaatttctatacatctctggaatacgtgcttatcaaaacttgtgcaacccttgctgacattaaggcaccaaaatgtctacaaatgtagtattctgtgagccaccgcacccggcctacaaaatgtttttttaaaaaattattgtgttgggagtgaattattgggctggtggctcatgcctgtaatcccagcacttcaggaggccgagatgggtggatcacttgaagtcaggagttccagaccagcctggccaacatggtgaaaccccatctctactaaaaatacaaaaattagctaggcgtggtggcgggcacctgtaatcccagctacttgggaggctgaggcaagagaattgcttgaacccaggaggcagaggttgcagtgagccgagatcgtgccattgtactccagcctgggtgacaagagccaaaaaaaaaaaaaaaaaagaaagaaatcattattatttctacaatatgggcttatccctgtattactcttctgaacttttcacttaatatatcgtaaccatctctccagtcattgaatgttcttctataacatttggaatgatatcatagtatcccattatatgaataacccatggtttattatacaagtcccctactgctgaacgtttaggtctttctaactttttgctattaaagtctggcatgatagactctgcaagttagccttcagatgcccagcaaatccagttaaccagagcactgtcctctaagcctcctggtgaatgtggttttgctgatggtgggcagagtccaccccagccgagccgctggatttggcaggcacttggccttagcaacctgagggtggtaactccaatcagttacttgtttccctgttacctgagttgcagatttagagccctctgcagtgagcaggtgagcacctggcatgattcttttctggtgagtggtcctgggggtcactgggccagtcaccacctggtgacaggacagggtgaccggtgggtggcagcactggggattcaaatgaccgcagcccggtcaggctgagctgagcagagccaaggactcagcacagcaaggaacctaggctcttcacagagaagggagctggaggaccccccaaggagatgagtatgtgccaccctgcggcagggtcctgtgggctttgggagtgagagggtcaaggggagaggagctgtgtttgccaccccctgttaaaaacctcaagtgaagcagcatggtagagaggaaagagcatgggattggaagccattgaacttcctgctgtgtgtccttgggcaagtgactacatgtctctgatcctcaatctccccttctataaaatggagatgatcctagaacctgcttcacgggagtgttcagaggggactgtagacagagcgggaacatagaagaggaagtaggcggcagtgtggttcacagccagcgcaggctgcctgcagggtgcaggtactgtcaccaagggagacccaaggtgccctggagggagtggcaaggacacaggcctgagcccagccctggtgatatgaacactggagtgggcttcacagggacaggcagcatcagaactggactagtgaggtcatgagcccaccagggcctgggtagggacatagcaagtctggggactccagacagggtcacacagacctgggccatgctgggcatccagggactggctgtgcatactggcagatgtcagtcagccctcctgcagttgggccagggacacctcagggaaactgtgaccttccttccaatcttggtaacatcacccttccaccccaaatcccagggaatggcccgaatctctcctgacaaacagctctcagccctggtccaggccacagtcttgcttgcaccgggccgggtttcagagcccgaagggcacactggcagcctttagtgcagtgtttcagatgtcacagacaggttcctctttgacgaagatggaacttccactgcttccctcctaccacgcaggaaacacagaagcaaccatcagccgagggcctgctggccgttctctctgggtactgtgtttggaaaaagcacaaaatcattaacttaaacatgctttttcaaaccaaacacatccctctcttagccctggagattcagagctgcctctccctttgaaaatgaatgatctcgcccgggtgcagtggctcacgcctgtactcccagtactttgggaagctgaggcgggtggatcgcgaggtcagcagtttgagaccagcctggccaatatggtgaaaccccgtctctactgaaaatacaaaaattagccgagcgtggcggcgggcgcctgtagtccaagctactcaggaggctggggcagaggttgcgtttagccaagatcatgccactgcactccagcctgggcaatagagcaagactccctcaaaaaaaaaaaaaagcatgatttcatccaatgccttcaataacagaaggaggtccaagtccagtgagagggtggaacgaacatactgtcacagtggaaaggacacgagacaggcgcgccaccgggttgagtctcgcgaacaaactgaggccagagtgccttccccagggctgcacgtcagtcaggaaaaaaaaaagcattctctccgacaggtcaaatcaccgaagcctcgggatcgtcgctgggggctgtgacggggctggcatgaaacgtccctctgtctggctgggcgatgggtcagtgctcaggagtttcaggcctttaaggcccggccagaccgcagggggactctgcagccgggtcggggtttcgatcctgcgctgcggccttgcaactgcgaggacttgggggtcgtgcttcgttcgcctggtatcctcgttcgtgcgtgtaggaggcgcctggcttgccgggcggtgccaggcggcaagagggagggcgcacggagcgtgtccgcccagggcggcccctgtaagcgctgcagaagcgctgctcccggcgcccggccccgccccagcctccgccccactaccgcgcagcgcaggctccgcccccagttttccccgccccgtggcggggacgccccgcccggtccggcccgctcggcctcggcagcagcggctgcggcgaaggcgcgcgaaggtaggtggccgggggcgcgcgcgtgcgcgggggcgggacggacgcgctcccggcggaggaggccgcgcgcctgggggcgggctggagccacgtaccggggctgggggcgctgtgtgttccgcgactgccgcggcccggcaccggaggccaggagagcgttcccaacaggctccgcggatgccccgccgcgtcctgccgcccatcctgcccggattgtcgcgggccgggggcacgacaggagactggggcctgcagggcgcagccgtccctccgccggccggggtcccctcgctccgcgggcggccgtgggaggccctcgcgacggcctctgccccccgcagatgccctctgcagctcctgcgtgcgggccccgccctgcactgccctcctcgtgtgggatccggtttcgtcttcattgcagccctgccgagtcggaagcatctccattgtgcggatggggaaactgaggcccagagcgcatagttgggctggccacggaggcagggccgccggatgctgtgcggggatggggccctgcaccccttgcgcctctcaccatgcggcctcaggcctctgtgcccggcagcgtctctggagtgggcattttgaacgagctccctcctgattttcacacagacttaagcctgacgaccatgctggggcggatgtctgcccctctggtgaccaggtcacagctcccttgggaagacgattgactggggaatggggaccctggggaggaggacttcagggtgccatctgtctgtttacgccagaaaacagagatttctgttttctttcgctgggctcacagcaggtgcttaataaacagatcttgtggcgggagcagacgacagcgaggttcaggcaagactccaggagtcaacccctggatctcggaggctccccacccgcgcacatttccctgacttaaccctcccctccccaagtctttcagccctttccacccaagtggcccctgtgggggtcactgcctggttttcaccctgatcttctgggatgcggcagatgctggctggatatgtgttcgctggtgtccttccgtgatccccgtctgtggctgacaccatctgtggcccaacatgaccccagccagagccaaggggaatcatttctttttccatttaacatcctatgttattacttggctcttagcattcattaattcattcagcagctcttcatggagctttggccttagcccatgcactgtggaagtgacagtgagctaagccaacctggcactttgggaggctgaggtgggaggaccgcttgagcccaggagttggagactagcctgggcaacatctcatctctacaacaagtaaaaaattagccagacgtggtggcacgcacctgtggtcccagctactcaggaggctgaggtgggaggatcccttaagcccaggaggtcaacgctgcagtgagccatgattttgccactgcactccagcctggaaaacagagcaagaccttgtctcaaagaaaaaaaaaaaaaaggaggagacagacaacatacatgttggagaaaatggaacagccactggagggacctctttagctgagagtcggggtagctccctcagaaagtgatatttttgagccaaaatctggccgacaagcgggagtcagctgtgcaaaagaagggggaagtgcgtcccaggcagagaaagtggcagtgcaaaggcccagaggtgggtgcctgcctggtgtttgaggaatcaagaaggccatgagcagccaggtgtggtggctcatgcctgtaattccagcactttgggaggctaaggtgggtggatcacttgaggtcaggagtttaagaccagcctggccaatacagtgaaacctcatctctactaatacaaaaattagctgggcgtggtggtgcatgcctgtaatcccagctactcgggaggctgaggtaggagaattgcttgaacccaggaggtggaggttgcagtgagctgagattgtgcaccactgcactccagctcaggcctgggcaacagatcaagactctgcctcaaaaaaaaaggccatgagagaaggggagagaggagatgaggtgggaaaagtggagtggggccagatctggtgggccctgtgggccatggaaggactttgaacttcattttaggtgtggtaagggctagtagagggccttgggtaggggaggggtatgacctttactgtgtgaaacttgagtgggtgaggggatgagcagggaagcatagagaccctcggggagccatctcagcagtccaggcagtggcttatataatacacatcggcgtcctggggtggtgccaggtacacagcaggcgctgcaggatggaagtcattgctgttactgtttttgtttatttgagacagggtcttgctctgtcacccaggctagagtgcagtgacacaaccacggctcattgcagcctcaaccttccaggctcaagcaatcctcctgcctcagcctctcaaggaactgggactacaggaggtgcatgccaccatgccaggccaattttttttatttttttggcagagatggagtctcactgtgttgccagggctggtctcaaacgcctgggctcaggcagtcctcctaccttggcctcccaaagtgttgggatcacaggtgtgagtcagtgcacccggcttgctgttattatttaaaactctgggctgggcgcagtggctcatgcctataatcccagcactttgagaggccgaggcgggtagatcacttgaggtcaggagtttgagaccagcctggccaacatggtgaaaccctgtctctactaaaaatacaaaaataagctgggcgcggtggcgcatacctgtaatcccagctactcaggaggctgaggcaggagaattgcttgagcccaggaggcggaggttgcagtcagccgagatcgtgccattgcactccagactgggtgacagagccagactccatctcaaaaacaaaacaaaacaaaaaacaaaaaccctttggaatcaggcacacctaggtcgcggctgtgacttgagctctttgtggctgggtgcattggagccaattatttaacttcgctgagacttcacgctgtcatctgtaaagtgagtagggtggtgccaggagtgttaaagcaggtaagggacagatgtaacgttttgggcacagggcctggctcgtggttggttcaatatttttgtcataatttctagtcagcagcaggaggataacgaaggggtaagcggataagagcagctgctatgtttgaaacgagtaatctttgaggggctttttggctagttcctgccgctagccctggcaaaaggcaagtttggagggtggtagtggggagggaagggtacaaagggtgtctcctctgtatttggtcaccaaataatgtctcagcatctagaacaaggcacagggttctagcttggggactagaaagagccaataatactcatgatagtaatgataacagtagtaatagccaacacttacccgctgttgaactgcaggtagtaattaaggtaacactagctaatgtgatagtgaaaccctgaattctcagaggcttagcgcaatagaagtttatttctcattcatgaaaagccctgttgggtgtttggcaggtggctttctatgtggcgacccagggaccgagatcccttctgtcttgtggttgcggcatcccctaggaccttggagttatttccttctagctgatggaccaggaaggagagaaataattttatggaccaagcctaaagtggcacgctgtctttctgtcttaattctatggaccagaacttgaccacatggccgtatctgactgcaagggagtctgggaaatggcttttagccatattcctaagaggaatcggaaatgctttgtggtgagcacattgcagtttctgccacaccatatccaggcatatagcttagcacggagtattttatttaatgctcatgctagaaacaggcaccattattatcccattttgcagatgaggaaactgaagctcagagaagtgaagacactggtgcagggtcacacagctggtgaggggctggtgagccaagattggagtccaggtggccagatgctgaagctgttagcatccagatttctaagaggaattcagtctttttttttttttttttttttttggagaattgggtggaagcagtggacacatacacgaggttcagatatgacttcctgggacccacagaacccagcaggactctgggggagaactttggggatggagccaagggtgaatgtcacctggtgccaggggctgacatcctgtccccttcctccaacccttagggccgtggtcaggagaaggcacagaataatccagttcagtccctcaaggacatctggggccccctctgctgagctgggcatgcagggctggacatgctggtccaggggtatttttggcttcccccctgttctggtgggcaggtgtgcagcctgtagaggggattttttggaggctgcctagaggtagaagagtgggcgtccctggggtttgtagtggcagctctatctgctggccggtttagttttttgtttttgttttttttttgagacagagtctctctctgtcacccaggctggagtacagtggtgcgatctcagctcactgcaacctctgcctcccagtttcaagtgattcttgtgcctcagcctcccgagtagctgggactacaggcacccaccaccatgcccagctaatttctgtatttttagtagagacggggtttcaccacgttggccaggctggtctagaattcctgacctcaagtgatcgacctgcctcggcatcccagtgttgggattacaggcatgagccactgcacctggccagtagctggtttagttttgcccaaatctggcttgcttgccattgcaacttggcaacatttatcttttcagacctgtttcttggttttccatttgcagggcagtttccttagttgggcgtgagcggtccagcctggactgatgagcatttatacagcaccgtggcattctgggtctgacctggatacagaagtagagcctcaaagcgcaaatgcctcggccttgcccttcagtcactcattgggaggctgctggtctaagtggaatgagctttgggctcaccacttccctgaagcatgtcgccttgaataggtgagagcccaatgtctctgagcctcagttttctcatctggaaataggttgaagtaaggatttaatgagataatgtgaatatgccccctttggggcacagcatggagcagagggcacccagggacggagggctgaggcatagcagtgtagcaggacaagccgcaggcaaaactcttcagtcaccaggttaaagaaggaaggaactttattcggctgggaacttcaggagacttgtgtcttaaaagccgagctcctcgagtgagcaattcctgtccttttttagggcttacaactctaagggcaggagcccagacacgtgatgctaatgacaataggaacagtggcccccattggctaatagctcaccacctgccaggtgtggtaggtactatcagtcgcatttttttgttgtttttggtaggacagagtctcgctatgttgcccaggctggtctcaaactcctgggctcaagcgattctcccattttggcctcccaaagtgctgggattatagacctgaatcaccacactcggtctagtctcattttattttattttatttttttgagacagactcttgccctgtcacccaggctggagtgctgtggcacaatctcggctcactgcaacctcctcctcctgggttcaagtgattcccctgcctcagcctcctgagtagctaggattatatgcacatgccaccacgccccagctaattttttttatatttatttatttatttatttatatttttgagacggagtcttactgtgtcgccaggctggagtgcagtggcatgatctcgcctcactgcaacctctgcctcccaggttcaagcgattctcctgactcagcctcccaggtagctgggactacaggtgtgcaccaccatgcctagctaatttttgtatttttaatagagacggggtttcaccatgtaggccaggatggtcttaatctcttgacctcctgatccgcctgcctcagcatcccaaagtgctgggattacaggccaattcttgtatttttagtagagatggggtttcactatgttggccaggctggtctcaaactcctgacctcaagtgatctgcccgcctcagcctcccaaagtgctggaattagaggcttgagccactgcacctggcctggtttagtctccttttagagatgagaaaactgaggctcagggaggtaacctgttcaaggtcttactgtcttgaacaccatagttgcaagtgacagagctgagtctcacatgcaacctcagacctgatactgactccagagctgtgcgcctaagcactagagcacatagcctccttgccccagggaaagaacaatgggaggtggtgggtgacctctgggtctcagggccctgggatatagggactgtgccttttttttttttttttttgagacaaagttccactcttgttgcccaggctggagtgcaatggcgcgatcttggctcactgcaacctctgcctcctgagttcaatcgattctcctgcctcagcctcccaagtagctgggattacaggtgtgcaccaccacacccggctaatttttgtatttttggtagagacggggtttcaccatattggtcaggctgatcttgaactcctgacctcaggtgatccacccgctttgtcctcccaaaatgccgagattacaggcatgagtgcctgcgcctggctgggactgtaccttctggattttcaaatgaatgaaatgagtatttcttgagtgttggccacgtgaccccccagcaccatgtcatgtgctgggtatgcacacacgatactgtttcatccccggacggctccgagagatgagtaccaatattatcacatcttacgtaagaggacactgagtctcagagaggcaaagtcagtgtccctggtgcacccagctagtgggggctggggtgggtgtgaaggggccagaagcttcccaataagtgcctgaagggcaaggctagggcatttgtagttcgaggctctaccactgtgtctaggtcagacctaggaatgccgcaggtgttgcataaatgctcatcagtccaggctggaccgctcatgcccaactaagtgccaagcctggcctgggtgatctcacagcctgcattctttgccctacacctgttgtgggaaaacatactcccagcatgctgtaaatcctctcattcttagctaaccatgtgactcccgttctgggccagaaagatggtcacaaatacttaggactctggcctttcccgccgcatggctactgaccccaccccctgggcttggagggctctaggacccagcaacctgcgcagggtgaagagtgtgtgaggtcctgacctccaggtgtctcccctgtttcctcctcccattccctcttctctctcctccctccttttctctcccttctcctcccctctcttcatccttcctcttcctttggctccctgcctctgcttccctcctctcctgtcctttcccatcccctccctcctcagcccacatcctgctcctcccaccgcggtggtcacatgggggcgccgccggatttaagcttaatctgcctggtgctcagcacagcatcctggctgtggcgcgtgctgactgagctagtcttggggtcctggagaagggggctggaggcatgcccacagcctcccccccatgagcttggggctggcgagggcacaggaggtggagctgacactagagacggttatccaggtgggtcctgggggctgtgcccaccctgtctggggcggggcagcgtggacttaacaggagtggtgagaggtgtgtgcgtcttggggatcaaggggtgggagaggtgtggtggtggtggggtatacaggggccccccgcttgcagttcctggcaagatggggggcagaggtacacacagggtgcacctgctgtggctccctcatcccagtgccctgggttgggagaagggggtctctactgccagattttagggcttgggggacctctggcatagccagatcctcatccatctagggtcggaaccggattggggcccccaacactggactgcctccagtggggtttgggagttacccgtagggtttggttctcatctctggccctgggccttcttcctggggcagtgagcacacaagaggctctttgcatggggattttttggattctaactcccaggcttcactccatcttgagggggctcctggggacctgtatcttgggcagtaggattctgtggctctccccacgaggccagggagccccgggtcccatgtcccctgaagaccctctcgcttttcccacagacactggagagcagcgtcctgtgccaggagaaaggcttgggcgcgcgggacctggcccaggacgctcagatcaccagcctgcctgcccttatcagggagattgtcacccgcaacctctcccagcctgagagcccaggtgccacccccatccgctcccctccacaaacaccacccacattttacctcttctcatgtccctttcctgagcagtcaccatgatgatcatgactgtaactcactgtggggcaggcacagctttatgacagaagaacccattttacagatgaggaaacagaggctcagggatgtaatttgtccagacttattccgcatgtggtgcaactagaaggaagggccgagcatctcctgcgtgcttgcctgtagcctgctgcagagatgtgaaccccaaatcccgtattcccacccggggaaggtgtgagctggctgaacccaagatacaggaagagggcagctcagctcagaccagggttttgcggaagtctgagtggatggcgccgtccatccgtttcccacgtgggcaggaaggcggatggtccctgctcctctcagtgggtggcgcacacggtgtagttatgtggcttgaggatctgggaaaggcacactcagttgcagctggtgtgctggcgtgtggcgttttggtgctctaaccattgtctgtgttcaactcccaagctacagacgggccccctccttgggagcgccagggatgttggcgccctggagccccagacagggagagactcagagggccctcaccctgacacctggggtgtatgtccagttctcccagggtagaaggggaacccacaggaggtggacaaccccgcttctcccgctggcctttctttccctcttctctctttctccttctcctcacaacctgacctatgctatgctctcctgagccctagcctttaaagttccatgaagcccttctcttgagcgaggctttgatgcttttctgggaggatctggttactactattctaccttttttttttttttttttttttttgagacagagtctcgctgtgttgcccaggctggagtgcagtggcgcaatctcagctcactgcaacctccacctccccggttcaagtgattctgctgtctcagcctcccaagtagctgggactacaggcatacaccaccatgcccagctaatttttgtatttttagtagagacagggcttcgccgtgttggccaggctagtctcaaactcctgacctcaggtgatcctcctatctcgactcccaaagtgctgggattacaggcgtgagtccgtgcccgccccacccatattacagataagtaaatctgaggccccggagaagaagactaattggaaaaggagggagcaagaactcaggggtctcctggctcctagactgagtgtctctcctgcacctcccaaacctgctgggccacactttagctggagttgtgttcactttacgtccagctttgtatcccctccttgccttcctccctgttctcagctctgtttgcaggcctggtgctgcagccattcccatctggactcctcccaggggcctggatggttttcttgccctccctgttggggggaggatgtcccactggacccagaagccaaccatgtgcccactgtcccttgccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagagggtgggtgccgcccaggtggtggactaggccagggttcccctcgttcaagggcagggaggcatctagaccaggcccacacacggggcaaaagatgggccctggagtcaggttggcctgggcttggattgaggctctgccaccttgagtggcgttgagcaaatcactatgctctttaagcctgttttctgtagtggggattgtaatgggacgtggaattgtaggaatcaaggagataatagaataaagtgcctggcaccaggggtattttgttcccatctgtcccaggcctgttaggggtgtgggacacggagaatgagatccctaaagattcctgccccttgagtttctgggcatctcccattgccacgggccttggggttgaggcggtggctggatgctggctcgaggctggtgtgggcacccgcggtgttctgcagcccatctggggcagccacaagacctgccgccactgcctattggaatgagttccaggcagggaaggaaggagaagcaggcctgtcttcatgtccaggcaggattcacatcacccgtgctgcaggcttgtgggggtcccagggtgtggggcgggagctgggtgtgagccggtgcgaggggtgcgggatgctcttgatgcactgtctgctttgggcctccgggtggccgggaggtggccctgggaagttggtggtggctgaagattggtaagggacactcgcagctgggacagagtgtatgtgtgcagatgagaggcatgcaggtggcaataacgtattaacagtagctactgtttattgagtgcctactatgtgccaggcgcgtgctgagtgtttcacatttaatacaccaaggtcgggaccattatgatgcccatgtaacagaggagaaaacagaggctcagggaggggaagcaccatgctgggggcacacagccagttaaagttagacaccaggtcttccaactcccagcccagggctctgtttggtttctaaactaacccagtctagaaacaaagttctgaagtttcatttcctgtgtatgggaagagacactgggctagggatttcagggcacagctggcccccacaaagttggaagggacccagagaggcaggggctggcccagggtcccctgtgtggtagtggcagagctagggttggcatgggacccctgagctggacttgtccaggctggagcccgcattggcaggagggtgtgtgttcctgtgtatgactgtggggtgtgcccgtgtcctgggatttgcctggctggacaaacccacgactagttgggacttgtagaggagcagagtaggcggcccgcagtggcccctggcatgaggacagtggagagctcgtttccccagggtctgcagcgggtgtgtagggcacgctggccccagtcatgaattgtgggtggtgatggggccctgagccaggcacccctttcttttggtccatgcatggcacagtgccacacccccagggccgcctcttaaatgccaccttctgaagctagccctgcccccaggttggcagggaagggaagaggtgggaggtagcaggttcctcctctgctgggacacagctgctggggctgggactgcagcacagggggtctgggttagtctagaaagctccctcctgtggttagtgggggcccaaatggcacgcagagggcgcccgctgcttcagttgtcctctatccaccatggtttgaatgaggccccacctggaggcaggggtggaacaggaatgacctcaaaggcctttcctggagggtgggtccccagagaacttcagagcctagagatcacctcatcacagatagggaaagtaagtccgggagaggggcatgataggcccaaggtcagtggtggtcctgggatgagacccttggtccagggctctgcagttgggcaacattctctttccctgccacccccttgtccccatggccacaggtggcagtgcctgcccctgtggccctcactggcatgttgggctgggttggtgggcagtcagcgagattgttctgatctttccaaccctgcagcacccctggcatggggagcggagggagggtcaggtctgtgtcctgttaactgcatgtcctgcagggaaactgaggcactcccagaggccacctcccagccgagagagaggacctcagggcccccatgggggtccccccttcttgctgtccctgagaagcagatgtaggcgcagctgggaatggaaaggagggagtggtcacgcctcccttggctccagaggacagaccccctgggctccctcgtgtccatagcaacctggaaagagtaaattgaatggcggtctgagggcagcagttgctaggggagacagtcaacttctttcatctctggcttagtggcagcctccttcccttttgaattgcaagtaaaattgaaaggctgttttgctcacggtgaagtttgtggaaaggggtgaggtgtggccgagagggccctggctctggttctgagcactggagaagggggaggagaacccagcaacggcctgaacccctctgtgtcccagaggcaaacagcacctgcttcacacagatatgcagtgtgtacacgacatgggctacactgggccccacacagacacacagatgcacaaaacattccacaaacaacatagtgagaccctaaaaccaggccacacagaaacactccaattcacagaatatgcacagtgttagccgcacacacagccagatgccacacaaccccacacaggcacagaacagtccccccaccaccggggacctataacaaccatatgcagatgacacagcacgctatctcccacctcatgggtgcacacggacaggaaaagcatacagttcaacacagccaccaatcggcccacaaaggtatgcccagatgcacaaagtgtgtatcacacataccagggagcccaggcacaccccccagacccacccacatgcggttgtacacttgcctcaccgacacacagacatataccctgatacacacagccaggcccaacacccgcgccacaacatagaccttcagccacagatgccgccttagccgttcacgggaaggctcagatgcaccaaacagtcgacgtgaactcagcacccacacactacacacacagtgtcctgcgtggagacaaatgacaaaatacaccccactcgcacctagtgagagccaccaacatcagtgcacagcctgtgtggctgcctcaggccaccgccaccacacacagatgtggacaccgctcaccattgacctcagtgggcttggcacagacgcttgacaggcctgcagccgccatccaggcagaaaccccctacttccacctcccctgcacagccttggactgtgttcctccagactcagggggaagcccccaagtagtcacagttagctcctccctattggtggggctgccatgcacgtgtcccgggggtggggtgggtagagatgtccttgctttgtctgtggctcatagaacatctctcagcatatggggtcaatgcaggcctggagggcaccttccctaccgctaacctggcctggacccaagacccgagatgagcgtgggtgagagcagctgccctcctgttggcttcctgtggctggcgtggccctgcacgggtgggcttttgaatgccctgcctgggctgtagcaggccaggtcctgaggatgcagatggtgagtgcagggctagcatcagagtaagctgggctggggtgttgtcgctgccaggtgcccttgacccactgtgtgctctcccactgccctgctcctccctcacctcccttcccccaacagctggggaagatgaggggccacctggggccagcaggtgccttaagggagttgagagggttctatggctggtagggacagccagagcccacaggggtctgaggatgtgcgggatggaagcttcctgggggtggaggaagggcagcagcaacagaggctttcctgcagtgaggatggaggggacctttttttttttaagatggagtcttgggccggatgctgtggctcacacctgtaatcccagcactttgggaggccgaggcgggtggattacgaggtcaggagttcgagaccagcctggccaacatagtgaaaccccatctctactaaaaatacaaaaaattagccaggtgtggtggcgtgcacctgtagtcccagctacttgggagactgaggcaggagaatcatttgaacccgggaggtgtaggttgcagtgatccgagatcgagccattgcactccagcccaggagacagtgcaagactctgtctcaaaaaaataaataaataaaataaaataaaaaataaataaataaagatggagtcttgctctgtcgcccaggctggagtgcagtggcacgatctcggctcactgcaacctccgcctcccaggttcaagtgattctcctgcgtcagcctcttgagtaactgggattacaggtgcatgacaccacgcccagctaatttttgtatttttagtagagacggggtttcatcacgttagccaggctggtcttgaacccctgacttcaagtgatctacccgccttgacctccaaaagtgctgggatcacaggcatgagccactgcacccagccagaagggggcattaatatgcaggcgccgtatagggcaacacctgtgtgcacctcttacaaatcttaatgctgtgtatatgagggggttccttcgtgtcctccgggaatgtttgaggttgcctgtatgtgttatgtgtgtgcatatctttaaggtcagatatgcatagacagattgacacctctgttttgaatgtattcccatgagctcatcccattaattcactatcgcaacaaatatttactgagcgtgagccatgccattccacagccaccattctagtactaagatacaatgaggaacaaaaaatccaggctttcctgagctcacattggggtcggggcatggtgggaagacacaggcatcaatgtaataaacagaaaccacgacagggctaagtgttctggaggagaggcacatggtgtactgaggcccctgaggttgacccaggtgcacctttgagctttgcctgcgtggtttgggtttgtgggctcacctgcatgtgtccatgcatgccccgtctgcgtgcccgtgcatggctgcatcaccccatacacacgtgcactgcccctgggcttgcccacatgtgctgctccccagggcgccaggctatcagcctacaaggcattgtgggtctgggcccagcctgccacgccctacagaagcctgagcctgccttcccaggaggcccaggactctcacccagggcccttccctgcagctggagcaggctctgcggctggagcctggggagctggagacgcaggagcccagggggctggtacggcagagcgtggagttgcggaggcagctgcaggaggagcaggcctcctaccggcgcaagctgcaggcctaccaggagggccagcagcggcaggcccagcttgtgcagcggctgcagggcaaggtcaggaccacccactcctgctcctgtcctcccacctgttcactttgccccgccccaacccctggggctcaccatcagctccccatccccagattctccagtacaagaagaggtgctcggagctggagcagcagctgctggagagatccggagagctggagcagcagcggctgagggtgggtgccagtgtggggcaggggcaggccctgccctccacctgcccaacctgatgctttaacctctctcccacccaggacacagagcacagccaagacctggaaagcgccctcatccggctggaggaggagcagcagaggtgagggcgcagcagggagggccagggctggcaggatggccccctgcgcgagcgcctactgatcccctgtgccccattcaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggaggtgggcatgggggtgcagggaggccagcctgacccaagaggaaggggcactgcagaggagggaggactcagaagcctggagagggagagggagcactgtccaagggagcctgttagcagaagtaaatagccgtcatcacaatagctggtctttatcagtgtgtagcatgtaccacgtgcacggtgtgcgttgacctttattcctcatgataactgcatgtggtaggtgctatcattctcctcattttaaagagaggttaaggccggtcgcagtggctcacgcctgtaatcccagcactttgggaggctgagagatcgtgccactgcactccatcctgggcaacaaagcaagactctgtctccaaataagtaaataaataaagagagtttaagtaacctgcccacagtcatgcaactggcagctgggatgcaaagctaggtcccttgcatttttgcccttcgttgctgcctcttgcagccaaaagaggacttgaaacccaggtccctgtgcaggagggagccatgaggcttgggaggctgagcatggccgctgcaacacagctctgtgcacagacccacaggaagacccaatccctgaacgacggtgcctcccaggatggtcggagatgagggaagcagtgggagggagtaaacccgctctcacaccaacccttccctcggcatgtcttccctccagtccttcaacgcctacttcagcaacgagcacagtcgcctgctcctcctctggaggcaggtggtggggttccggcggctggtcagcgaggtgaagatgttcactgagaggtgaggcctggccggggacggggcagcagctgagagccagccctgctctttatgtccaactgaactcagttgaatttcagttcaactcaacgcacttactgtgcacaagggccggtgaggacacagaggcaacttgtaataaccattaccacagtcgtggcagtcagcatttattagatgtttactctgggctaggctcattgtatatttcatttcaactaatattcatagcttccctgtgaggtaggaactgtgttcattcacatattacagatgaggacattgtggcgcagagaggttgagtgatcttcctgaggtcacacagtagtacataagtggctgagtcagagtttgaagttcctgattttttttttttctcagacggagtcttgctctgtcaccaggctggagtgaggtggcacgatcttggatcactgcaaccttcacctcctgggttcaagcaattctcctgcctcagcctcctgagttgctgggataacaggcacatgccgccacacccagctaattttttttttttttttgtattttagtagagacggggtttcaccatgttgcccaggatggtctcgaactcctgagctcaagcaatcagccagcctcagcctcccaaagtgctgggattataggcatgagccacagcgccaggccgaagttcctgattttaatccactagaatattcagctttgctaccaaggacctcacagcctcttgtgatgaaaagatgtagatccccaaaattctaggctgggcacggtggctcacgcctgtaatcccagcacttgaggaggccgaggcgggtggatcacctgaggttaggagttcaagaccagcctcaacatggagaaaccctgtctctactaaaaatacaaaattagccgggcatagtggtgcatgcctgtaatcccagctactcgggaggctgaggcaggagaattgcttgaacctgggaggcagaggttgcggtgagccgagatctcgccattgtactccggcctgggcaacaagagcagaactccatccaaaaaaagtaaaataaaattctagactgaggaagcgagtggtcagtgatatgtacgtggaacagagggaatgtcctcgaggctcagaaggatgggaggggtggggaggtcagaaaaaccactttgtggagatggaatttgcacagagcctcaagggatgggtagggttgaagcagagcagcaggcgctccaagcaggagcaaggcatgagcaaaggcatggaggtgggagcccatggcagccaggggggttgcaatgaagagctggtacagggaaaggagagcctgcctcagcgggggagcttgggcctgcctgatccgtgtgagcagtcagctcaacagtagtgtcagggaggctgcggagagagccccaaggcaggaggccaaggtatttcatttagtgcgttaaaaacattttagttagtaatcttttcttttctttatggctcactacagcctcagcctcctcgtctcaagcaatcctcctacctcagatcctgtgcagctgggactacaggtgcatgccaccaggcttgctgatttttttatttcttgtagagtcgaggtctcactttgttgcccaggctggtcttgaactcctgagcccaagtgatcctcctgccttgacctcccaaaatgctgggattacaggcatgagcaaccacacctggtttaataatcttttgttaatatcatcaaatagccagtgtctaaattttccatatgtctcataaatgtcacagatagaccaggtgcagtggctcacgcctataatcccagtacttcaggaggccgaggcgggcggaccacctgaggtcaggagttcgagaccagcctggccaacatggtgagacccctatctctactaaaaatacaaaacttatctaggtgtggtgacacatgcctgtaatcccagctactggggaggctgaggccccagactcgcctgaacccaggaggcggaggtttcagtgagccgagataacaccattgcactccagcctgggtgacagagtgaaactctgtctcgaaaaaaaaagtcacagatagtcttgctttagttttttctttacaatttgtttgaatctcgatccatagacatttacaaaacgtaaatgtttgctttgtcttttttttctttttttttgagatggagtcttgctttgttgcccaggctggagtgaagtggcacgatcttggctcaccacaacctctccctcctgggttcagcaatcctatggcttcagccccctgcgtagctgggattacaggagtgcgccaccacgcccagctaacttttgtatttttagtagagatgggggcttcaccatgttggccaggctggtcttgacctcaggtgatccacctaccttggtctcccaaagtgctgggattacaggcccaagccactgtgcccggcccctgctttgtcttttaagtcccttttaacttatttgttcaggaaactgggctagttgtccttggagattctcatggtctggattttgctggttgcatccttatggtgtcaattaacatgtttctttatcccatgtatttcctgtaaattggatgttggatctaaagctaggtcagattcaggttcttctgcttgcttttttgtttgatcaagactccataagtagaatgtgttcttccagcaggatgcccctatgccagctgtctctcttttcaagatccaacccactcatcaaaggctgcaaaactgtgagcttctcatttagtcactcctgtgtatattaattagaattctggaatgaggcactttctctccttactattagataaccagtggtactgttcattcaggaaaggaaaggatttaacctgtattatggactgaaaatacatttttttttttgagacagtctctctctgttgcccaggctggagtgcagtggcacaatcacaactcacattaggcttgacctcccaggctcaagtgatcctcccacctcagccacccaagtagctgggactacaagtgtgcaccactatatctagctaatttttgtttgtttgtttttagagacagggtcttgccatgttgcccaggctggtcttgaactcctgggctaaagcagtgcacctgccttggcctccgaaagtgctggaattacagaaatggcccaccatgcctggccttaaaatacaaaacaaaaccaaaaattttaagtagcctttaaaatttttatattttacttttgattaagtcacatgttcacaaggttcacatttcaaaagggtacacagtaaaatggctccctctcacctctgaccccagatattcctcttccctccttggaggcaagcagcattatcagcttctttttctttttatatatacagattttttcttttttcttttttgcttcttcttcttctttttttttttggccaccaagttaccatgagaagcattatcagcagtttcttttttttttttttttttcttttttgagatagagtcttgctctgtctcccatgctggagtgcagtggcacgatcttggctcactgcaacctccacctcccaggttcaagcgattctcccacctccgcctcccaagtagctgggattacaggcatgagccaccacaccccgctaagttttgtatttttagtagaggtggggttttgccatgttggccaggctggtcttgaactcctgacctcaggtgatcctcctgcctcagcttcgcaaagtgctgggattacaggcatgagccaccacgcctggcctatcagtttcttaagtgaccttccagggttatcttacataatcaaataaagcagatcacacacacacacagagacacacagacacatgcacacttttttgcatatacgcctggtaaaatttcatcttcacagttcttgaagatgcttccctaacctactagttataactgggaggtggctctgtgtcaggccaggaagaacttctccactggtttttttgttttgttttgttttgttttgagacatagtctcactctgtcgcccaggctggagtgcagtggcccaatctcggctctctgcaagctccgcctcctgggttcacgccattctcctgcctcagcctcccgagtagctgggactacaggcgcctgccacctcacccggctaattttgtttttgtattcttaatagagacggggtttcaccgtgatagccaggatggtctcgatctcccgacctcgtgatccgccctcctcggcctcccaaagtgctgggattacaggcgtgagccaccaagcctggccttccactgctttttcttggccacagagtgttccacagaatggatgtaccatcatgtacttagtagcagtccccttttgatagacatttaggttgtcaccaggatttcttacatgagcaatgctgcagtgaacctccttgtccacaagccatctcctctgtgctggggtatatcgttggatacgttcttagaggaggagccggtggggaaggtcctatgcatgcatagttttcagagctctccctcagtgccctccgttgtggttgtatcaccctcccaccagctgagtaggggagggcctgttacccccagagcccctccttgtgtattatgtatccctttttttttccccaatctgagagtggacaaatggcatcccagtgtagggttttttttttcttcctctttagtttttgagatggagtctcactatgtttcccatgctggcctcaaactcctgggctcaagcaatcctgcctcagcttcccgcatagctgggactgcaggtgtatgccaccgcacccagcctagtatagttttatttttattttattatttattttgagacacagtcttgctgtgtcacccaggctggagtgcagtgtcatgatctcggcttactgcagtctccacttcctgggttcaagcaattctcctacctcagcctcccaagcggctgggactacagaagtgcgccaccatgcctggctaattttttgtatttgtagtagagatagggtttcaccatgttggccaggctggtctcgaactcctgacctcacgtgatctgcccgccttggcctcctgaagtgctgggattataggtgtgagccaccacgccctgcccaagcatagttttaatttgtagttgggagcaagccccatccatccccagcctgtgctctctcccgaagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccaggtgggtacctggtggatgccgcacgaggcaggcgtccctgcagaaggtaaaactggagagttggggagaagggagcatctgttcactaggggaagggccttcctctgtgagctcagccagtcttcccatgcactgaggttccgaaggcacttgcccagtgtttatcataaacagcttagcctcctatggcagaacttgtggccgggtgtggtggctcacacctgtaatcccagcactttgggagaccaaggtgggggattacctgaggtcaggagctcaagaccagcctgtccgacaggcaaaaccctgtctctactaaaaatacaaaaattagctgggcgtggtggcgcgtgcctgtaatcccagctacgagggaggctgagacaggagaatcgcttgaacccaggatgtggaggttgcagtgagccaagatcacatctctgtattccggcctggatgacagagcgaaactccgtctcaaaaaaaaaaaaacaaaaaaaaagaactcgtgccccttactcctgccacctggacaagtcctcaactgctttcccatgagataaagctggtgggaacctcattcccatttcacagatgagaaatgtgagatctggagaggagccgggacttgtctgaggtcacacagccagggaggtggatgttagggtccctgcctcgggtttggagaagcatggtggacacagagctagtggatttgagaagctggggtggtcccgtattcacctctgttgctcccccaactccagagtgacagagctgggcctggcagtgaagcgtcttgagaagcagaatctggagaaggatcaggtcaacaaggacctcactgagaagcttgaggccctggtgagctgcaggtgcccctgagatggggcagggtgagatggggtaccggccagatccatggacgcaggcttagggctgggctgcctgggtcacccccagcgtcccactcacactcaggttcagccctcacaggtgtgcaggctttgtgggaagcacactcacctccatcccatttcttcctcccagcagccctgtagcataatcctcataacacagatggggaaactgaggcccaagaggggtaatgcttgtccagtctcagagccactaagcgggagagtcgggacttgaactcccatccacgctctccaggtccagatgcggcctctggcaacctagctgccccccacccccaccagtgggacactcactcccccagggtacagcctggtttggtcacccctctgtgtggggcctggcctgggttctaggtccggctctcctgcaatcgactgtgtgacctggggcaggacatagctcttctctgggcctggtctgttcagtgagggcctcgggcctgctgtggggtctaccaggtggctggcctatggacatggcttcagaggccacctggtcagtggtgggccaggtagggagggaaaggggaggtttcagataagacagaaccccaaccaccctttgtctccctaaccgcactccaggaatccctgcggctacaggagcaggcggccctggagacagaggatggagaggggctacagcagaccctaagggacctggcacaggtgtgagcccagagaggcgggaagacagcgccctgccaggcagtcccaggctcccccgccacgtctttcggtgacctgggactgaactgcaaatgggtgggggcctgggacccaggctgtagctgctcagcacccctgctagctcacccagcctctgccttggggagcccccagtctcagaggggaggcacgaccctttgggagcccacctgtgagcaaggccaaatgatgtcttcccaataaatgggaggcctcagcggcgagccgaggactgagctagtggaggaggtgaaatcaggaaggcttcttgtaagaggcagcatttggaatgaggcagcccccagcctcacctgggcgtctttgcccagctaaccccgcggttcctaactcagcagcctccttctgcctccctcccccaccctcaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggtaggaaggggcttgagcgttctgggcgcagccagaggcctgggggaggggctcgcgccctccgggtgggggcgggggcgggggcaggtccggggccagggtccgagggaggagtctgagcgccctggggtgcagccagagccctgagaaatagtttctgagggtgtcaggacccccaaggaggtggccgagagctctgcggtgaagccgagcccagaagtgggggtgcttgggcagctgggggtgggtgcttgggcagctggtggagggaggaggctgcggcagtgttagggtcctggtagagagggagacaggtccctggtcatacagagccaggaccctgggaaaaggtctagcaaggggaatcagagcttgggaactaggggcagagccagggtagggaggagtctgagagtggaaccaggatgcaagggggaggagcctaggagccctgggggtgggatcagaacccaggagacgagtgtgcctgggggtttgtctggcatccggggggctttgataggagttgtccgggaccccagggaggtgagggctcagagggtggcgagggcacataggaggggagcggaagcctggctctcaggcctaggcccctatcctgccccaggccaggtccaggccctggaccccgcctagcgtaggctagtgtgtatccctggaaccagaagagagtaggtggctctggaggcctctcaggcccccccagactctgtgaccccccacaccccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcaggtgccggggaggtctgagctggggggtactgaagaataagtcaccgtctgggcataacaccagtcaagccttatgcgtatggctctgcactaatatggtcgccactagctgcatgtgcctattaacgtttatttatttatttatttttaaaatggagtctcgccctgtcgcccaggctggagtgcagtggcgcgatctcggctcactgcaagcgccgcctcctgggttcacgccattctcctgcctcagcctcccgagtatctgggactacaggcccctgccaccatgccgggctaattttttttttttttttgagacggagtttcactgtgtggcccaggctggagtgcagtggcgcgatcttggctcattgcatcctcctcctcccgggtttaagcaattctcacctcagcctctgaagtagctgggattataggtgcccaccaccacgcccggctaattttttttgtatttttagtagagacggggtttcaccatcttggccaggctgatcttgaactcctgacctcatgttctacccgcgtccatctcccaaagtgctgggattacaggcatgagccaccgcgcccggccaacatttattttttagtattcagttttgttttgttttgttttgttttgctttgttttgagtcacactcttgctctgtttcccaggctggggcacaattggtccatcacagctcactgtaacctggaactcccagactcaagcgatcctcccacctctacctcccaactgcccctagttgggggcctgggcctggcctggggaaggatatgggaccgaagcctgagagttaggtttccactcccttcctctgtgccctcaccaccctctgagccctcacctccctgggttcctgggcaactctgatctcagcctcgaggatagtagacaagccgccaacatttctaaattttttgtagagatgggggtctcactatgttgcccatgctggtcttgaactcctagcttcaatcactcctcccacctcagcctcccaaattgctgggattacaggcataagccactgtgcctggctctattaaaatttaattaaaatttttaaaaagtgaaaattcaggctgggtgtggtggctcacacccagcttgctggccaacatggtgaaaccctgtttctactaaaaatacaaaaattaaccaggcatggtggcatgctcctgtaatcccagctattcaggaggctgaggtgggagaatcacttgaaccccggaggcagaggttgcaatgagccaggatcgtgccactgcactccaggctgggagatagagcgagactccatctcaaaaaaaaaataataataataatgctgggcccggtggctcacacctgtaatctcagcactttggaaggccaaggcgggcggatcatgaggtcaggagattgagaccatcctggctaacacagtgaaaccccgtctctactaaaaatacaaaaagtaaattagctgggcgtggtggcaggcacctatagtcccagctacttggaagactgaggcaggagaatggcctgaacccgggaggcggagctggcagcgagccgagatggcgccactgcactccagcctgagcgacagagcaagactccgtctcaaaaaaaaaaaaaaaagaaaaaattcagttctttagttgccctagccacatttcaagcactcatcaaccatacatggccatagaacatttctgtcatctcagcgagttctattgccagcactattttggactgtatttcttggagttttttttagagatggggtcttgctgtgttgcccaggatggtctcaaactcctggcctcaagtgattcccctgcctcggcctccaaaaatgctgggattagaggcataagccaccatgcctagccttgaagattttttttttctcttaatttgagacagggtcttgttatgtcacccagtctggagtgcagtggtgcgatctcatttcactgcaacctccacctcctaggcttaagtgatccttccatctcagcctcctgagtagctggaactacaggcacacaccaccacgcctgcctaatttttctgttttttgtagagatagggtttcgccatgttgcccaggctgatctctaactcctgagcccgtctcggcctcccaaagtactgggattataggtgtgagccatcacgccaggcaccctgaagatttttaagacaagaaattatccacttcttagctgccaggttgtttttgatattttgttgtttggtttttctcttcataaatgtaaccatctaatgaaaagtttgaaaaataggaataaaaagacagcgccttctcacagcctcatctgcccatcctaattcatttagggcactggttttccttcccattgtgttgcctggcagtgagatagcaaacgtttcctgcacacctactgtgtgccaggctcttggccgagtgttttgtatgtactctgtgatttagtcttcctgtcaaactcatgcaattcggaactctgttgttgtaagcttgagagactggctcagactcatacagcgtgtgtggctgggggtggcagggtgggaactggaattcaggtccatgtgagagtaaacccaagctttccatgcctggaaaggagaaggtctttttaagcagttgtgttcacagcaaacatcccattttgcattctgctatttttacttaacagcacattgtcgactgagcgaggtggctcacacctgtaatcccagtattttgggaggccaaggcgggtggatcacttgaggtcaggagtttgagaccagcctggccaacatggcgaaaccccatctctactaaaaataaaaaaaaattggccgggcacagtggctcactcctgtaatcccagcactttgggaggccgaggcaggaggaccacctgaggtcgggagttcgagaccagcctgaccaacatggagaaaccctgtctctactaaaaatacaaaattagccatccgtggtggcacatggctgtaatcccagctacttgggaggctgaggcaggagaatcgcttgaactctggaggtggaggttgcagcaagccgagatcgtgcactgcactccagcctgggcgacagagtgagatgccgtctaaaaaaaaaaaaaaattactgggcgcattggctcatgcctgtaatcccagcactttgggaggccgaggcgggcaggtcatgaggtcagaagattgagaccatcctggctaacacagtgaaacccccatctctactaaaaatacaacaaattacccggacatggtggcgggcgcctgtattcccagctacttgggaggctgaggcaggagaatggcgtgaacccgggaggcggagcttgcagtgagtggagattgcgctactgcactccagcctgggggacagagcgagactccgtctcaaaaaaaaaaaataaaacaaaatcacgctgtgaagttttttcgcacctatggccagtggggaacgtggcagctcatggcaagtctttggggtcccagttgttcccttctcctccctcccctgccgtggccaccatgtgcctgtgtagcaggaagctgtgggatctgcagactcagctctatcaggcttcccagaattgaggggcatggggtgttataggggacatttcctggtcacatggcctagcagagctggtggcacaattgccgtgtgtcccaggagcctagctcggcctcttctacctggtagggtgcttggagatcacaccagcacctccatccactccaagtgggcggactggagagaaggaaagccaggttcttctgctggagtgtgtgagtgaaatgagtcagccatggacagggtggtcagggaaggcttcctggaggcaggtgccttggaagactggaggatgtagctcatggctagaggagcagccagccaccttccctgcagagagcagccccagcatcccctctgctccccctccccttgtcctgaagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcaggtgagcagcatctcgccaccctgccaggacccttcagatgtgcctcgggtcccctgacagtgcccccctggggttaggtgacacccactgggtcctgggcctcctaccgtctggacccctccgatgtcgggttttctaaccagacccatttcaggaaactggggctcagggaggtatagtcacttacctggagtcagagaactagttaaaaggtagaacttggatgataataacaagaataattaaaataacagtagtaatattagcagtagtattttaaaaatttagttagaagaataataatatccttactaatttcactaagtgccagataccattttaagcaattcagttctctcatttaactccatgataactctgtgacatagaagcggttatctccattttgtggatggtaaactgaggcacagagaagccatgtcacttgccccaggtcacacagttagcagaagagccaggatttgaacccagacattctgccttcagagttaacctcttcaccactgcgctgcttacctctcagggacgtgatcgatgatgatgtttagtagactgtggtggagcatgttattcttgtttctgaaggtccttggggagatgtgtcaggcactattttaagcacatgtgaagtttgtatccttaaaacaggccgggcgcagtggctcacgcctgtaatcccagcactttgagaggccaaggcaggcagatcgcctgaggtcaggagttccagaccagcctgaccaacgtggagaaatcccgtctctactaaaactacaaaaattagtcaggcgtggtggtgagcacctgtaatcccagctactcgggaggctgaggcaggagaattgcttgaacctgggaggcagaggttgcagtcagccaggatcgcaccactgtactccagcctgtgtgacagagcaagactgtgtctcaaaaaaacaaacaatgtcacgaggtaagtgttacctcattttgcagatgtgaaaacggaggcccagggtcatggagctaagcggtagtgggcttggttgccctgtggctcaggctgtttctctccaaactcctgcctcaggcctggtccccagcccagcatctcgctggctacaggaggttcggggcaggaaagtgacatgggccacccacccaccctttgtcccacagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggtgggtccctgtctgctgcacaaccacaaacctacctctgacccccagccccaagccttgtcactctggcacagactggtcccagtgtcaggcagacctctgagcctggtcacagactgaccccttccttctggatacaggctgatctttgtcacaggccacagacctctggacctctggtcccagccataagtggactgacctctctttatggccgtatccctgctcttctggatgctcctgggggcaatgcctatagctcagggtcatccagtgcctgagactcagctcctggggtctgagagttgtggccacagcgcagagggtccttggcaggggggcctgcgctgtccgctgcagcctgggctctgagcagtgctatccctagaccctactcaggggatcctctgaactctggccctgccctgcagcttgagctatttttgcacagctctgtggtgtgtggcttttaaatggctcataagcagcaggctttctgcggtgatttttttttttccatctcacactgtgtcccctccttgtctcccctaccctgtctctgagggtccatctctctgggtctcttcttgggcctcctcacctcctcccgacctttctgcctttcctcatttctcggggcctgaccctgcaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccaggtacgctgtgcacctgcgggcccacctgccttgcccacccatcctccccactcagtgaggcaccccgggcccagccctgtacctgtcttggcccctgcctccctttctgtccctggttctctgtctgtctctggttctctgtctgtctgtctatcccctctaggcgtcaaagcacagaagttccatgggccctcctcatctccccctccccagtgtcccatacacccaagggcactgtccctcattccctgggagcctcccctgggctattgttgctggtgggtgggtggaggaggcgtcctggtcctgggagggacgccctgctcacgaggccccactcctacctggcctccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcaggtgggcaaagctgtgtgtgggggtggtgtggagagcatgtggggcaggccgggctcccagccccctgcatccagtcctgggttaagtcacaggcactggagcctgcttctgggttaaatccagccccacttctgctagctggggaccttggacaagctgcccaatctcccatacctcagttgccccatctataacatggggccagccaggcgcagtggctcacgcctataatcccagcactttgggaggccgaggcgggtggatcacctgaggtccggagatcaagaccatcctggctaacacggtgaaaccctatctctacaaaaaattagctgggcgtggtggcacgcgcctgtagtcccagctacttgggaggctgaggcaggagaatcgcttgaacccaggaggcagaggttgcagtgagccaagatcatgccactgcactccagcctgggcaacagagcaagactccgtctcaataataataataataataataataataataatgatacagattaataataggtggagactttttagaattggaatcttagacttttgggaacatcacatctggaagagaccttaatgtttcagggatccagggaccttcatgcaaggtctatcctggagcgcctaggtttctgggaggggcctctagaggatggggtagggggtgcaggaagcagggtgcaggtctccaccttgaggcctgccgagcagctgcacttgggtctggtttatatattcagcttctctgcaagtttagagtaatacaagggttctgttactcccagagctgagtgagggccctcattttttttgtttcattttgttttgtttttgttgttgtttttttttccagacagagtcttgctctgttgcccaggctggaatgcagtggcacgatctgggctcactgcaacctccgcctccagggtttaagctgttcgcctgcctcagcgtcccaagtagcagggactacaggcgtgcaccaccacgcccggctaatttttgtatttttagtagagacagggtttcaccccgttggccaggctggtcttgaactcctgacctcaagtgatccacctgccaaagtgctgggattataggcacgcaccaccgtacctggctgggccctggtttttgtacacacgtgcattgcagatctagagaaggtcatgacttgcccaagtacatgtagcacatcagggcagaccctgggctcaaacccaggccttctgccaggactgggttaggcccagagttggggtgctgcacgatgaacaagctgggggacgctgggagtgctactcagtctctgggtgggggccagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcggtaaggccttgggctctgcccaacccgccctggggggtcctcctggggccacaccatgaccagccacacgcaggcacgggcccccaggggcagttactaaggagtctggcttgccgactcgtcctagctgtggctcaggcttccccagggagtgtgggcctggccaggcaggtagattggcacttggcccatgcctggccactccctgagatccacagtttcctggggccagggaggctgagtcccagggcctcagggactgtatgtgctgcagcttggagaaggaagccctggagggcagcctgtttgaggtgcaacggcagctggcccagcttgaggcccgccgggagcagctggaagccgaggggcaggccctgctgctggccaaggagaccctgactggtacgaggggctggggacttggggggaacaccaggttccagcccagactgcagcctcccaaggtctggggtctcacagaagttgggagcactggagtaggagtctggctggcctgggttccagtcctgtgccaccacttagatctcaccttcccttgagcaagcccctttcctctctgggctgcagattcctcagctgatgattggaggtggcaatgcccaccttctaagcctgttgccaggatgacgtgggaaaagcgtgtaaggccgtggcacggtgcctggctgagtcaacagtaactgccgttcatcggtcatcaggcctgttagtctgagttctctgtgcttttcagatgactctcttggccccagaatcccagccccacttccctgcaccgttcccatccagtctctgaactcagggcttctttctgctcacctaacattaactaagcacctacttgggtcatggaaattaattttcctgtccatgtacacctgagccagacagaaccaggaagggaaatgctggtgggtttccaacccgggagatggtttttagatggtagctataccatttccattccctgtagtcatttccattaatataaatagttaacgtttgacgggtatgttcatgtcagtcattaaaggagatgctttatgtgtagctgtgcagctgtgggaagttgctgctgatctctgagcctccatttcatcatctgttaaatggggatgaggataaactacataggcatgttatgaagacaaaatgaggttatgtctaaaatacttagctgggcgcttgacccatagtaagtgctcagtcaggaatagggttgttttttgtttgtttgttttgagacagagtttcactcttgttgcccaggcgggagtgcaatggcactatctcggctcacctcaacctctgccttctgggttcaagcgattctcctgcctcagcctcccaagtagctgggattacaggcatgcatcaccatgcctggctaattttatatttttagtagagacggggtttcgccatgttggtcaagctggtctcgaactcttgacctcaggtgatccacccgctttggcctcccaaactgctgggattacaggcatgagccatcacgcccagcctgtttgttttttgagacagagtctcactcttgttgcccaggctggagtgcaatggtgcgatctcggctcactgcaacttctgcctcctgcattcaagcgattctcctgcctcagcctcccaagtagctgggactacatatgcccgccaccatgcctggctaatttttgtatttttggtatagacagggtttcgctgtgttggccaggctggtctcaaactcctgacctaaggtgacctacctgacccagcctcccagagtgctggattacaggcatgagccactgcgcccggcctatttgtttttttgaggcagagtctcactcttgttgcccaggctggagtgcagtggtgcaatctcagctcactgcaacttctgcctcttgggttcaagcgattctcctgcctcagcctccctgaggctgggactacatacgcctgccaccacgcctggctaattgttgtatttttagtagagacagggtttcaccatgttggccaggttggtcttgaactcctgacctaaggtgatccacctgccccagcttcccaaagtgctgggattacaggcgtgagccaaggcacctgacctagggttgttatatgtttgacatccgtcccatttgggaggccttctcatcagtcattttatgcctttaatgccattctaggtaggcaggaaaggggtcagggccagtgggcccatgtagcatatagggaaactgaggcccagagagggcaagccacttcaagaggacccaaactagatgccaggcaggccctctgcctctgggattttgcccatgtggctcacctggcctaagtctgctggcccaaggaaaagtttcaacccaaccctgccctttcccccattcctctcgtgcaggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggttcaggcagctggggaggggtgggcaggactctgagccagtgtttcatcatcgttcttgctctgcctcggtctctacatctgtgaaatgggacttcctctctgttgtggaggtcctggggacagctaggaggactggggggatggggaggttgtggttcttattagacatgcagattcccaggtcccaaatctggtccagccctggtaatcctgatgcagagggtccacaaccacatttgggaaatactgacctaatgtacagcaggaaagcactttcatttgctaagaagtactgtttgcatatgaagagccactcagacctcagcatatagaaaggcaaggggccagggaagttactagaacactgactctgggtttgaattgcctgggtttgaatcgaatcttggtcgcttactggtgatgctacccaaggtgtccgtgccttcatttccccacctgtagaaatagggataggatagtgaaaggtattgaagatgagctgagaccatctgcatagagggcttagcatagtgactggtacttagcaaatgctccataagttatgattgctggcactgacatgctctccagagtggccctcgggacaggggccctcagccaccaaatcctagacagggctgcctctgacagaggtgcaggctatgactgcatggctccagggcatgccactcaccctgcagtacccctggccttgggtggttgttaccacgcttctccaggaggtggcggtaaagctcttttttttttttcttttttctttttttgagacggagtcttgctctgttgcttaggctggattgcagtggcgcaatctcggctcactgcaacctccactttctgggttcaagcgattctcctgcctctgcttcctgagtagctgggattataggcgcgccaccacgcctggctaatttttgcatttttagtagagacgggatttcaccatattggtcagggtgtctcgaacttttgacctcgtaatctgcccacctcggcctcccaaagtgctgggattacaggcatgagctacggtgaagatcttaaagaaggggcggtttggccggtcgtgctgactcatgcctgtaatccagcactttgggaggccgaggtgggcagatcaccaggtcggaagatcgagaccatcctggctaacacagtgaaaccccatctctactaaaaatcacaaaaaattagctgggcgtggtggcacgcgcctgtagtcccagatacttgggagggtaaggcagaagaatcgcttcaacctgggaggcagaggttgcagtgagccaaaatctcgccactgcactccagcctgggtgacagagcaagactccgtctaaaaaaaaaaaaaaagaagtggcagctctgtctgcttctcacagagttgctaggggcaagtgctgaggcaggcacctgccctcaggctccccaggtgggctgctatttgcctgtgggctctgcctgcccgcctgtccagtccccagggatctgaactcctgtgacctcccccttgctcttcttgccctttgcattgcctggcttggcctcattaatgtccccaaatctgtgttctctccagctcctctggcaacccctgacccccttcattcctcacagccagtcctaactcccctccatcccaaccccaatccctcttccacagctgtcggaacatcccctaagctaaaaatcagattgctccttgtcaccttggctcgagtcctctctcccactcccctcactgtccttagaatccccatggcccacacggcctgtcctggccccacccctgcctggggctctggccctgtgactcaccatgtcccgttcccctctgcaccctgcatcctctaggcctttccaggggctgtgttcttggcctggggtggtcttttctctccttacctggctgacagttacttgtccctccgcaggggaccatgttcggacccccaggccagcccactgctgctccttggcactttcacggccctggcgtgtccccgtcatagcccttatcactcccttgtatttacctggtcaccctccatctctgagggtatgggggccagatggctcttgctgccctgatgttttggggggtctgcctgggccccctcctggtgtgtcacaggcatccggtcctggccccctaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggttcgtgagccctggcatggcctctgctgctctctgagctgctccagttctggggccgggccctgctctgccacttggcagctaggagccctggggcaggccactgccctcttgggggcctcagtttccttacctgcaggaggggaggattagaagggggttcgtgaggctttgctgtgctccatgcctggcacacagtgagcacttactgagtgacagtgacagtcgtgacaccaggaaagctgttccatattctcccatgcctcgtcccaccccacgctgggcatggatcctcatggctgccttctgagcagtccccacgatgcccacaggcatcagctgacgtgtccccccaaataacaaatccctaactttcctataatgtaacggagacagggcagactgtgcccatctcctctcctcaccagctgtgtacctgggcgagtcactttacctccttgagcctcagtttcctcatctgtaagatgggtagaaagaaagactctgcagtcagggtgctgtggcgggttagtgagctctatgagtggtatccacgtccgggattcttgtgactgccgttgtgcccttttccagggctgcatgtctgccctgggtccacctgcagtggcacactcaggcctctaagcccccagtgggcacatttcctaggcagcaagaagcctgagcatgcccccaggaccagcccatcccccaagccctttgtcccctgcctctgcccaggccttgtctctgaaggagtctgagaagacggcgctgtcagagaagttgatgggtacacggcacagcctggccaccatctccctggagatggagcggcagaaacgagatgcccagagccggcaggagcaggaccgggtagggcaggctgggcagctgggcctctgtctcatagagaggcacatccctggctgaggagcccccaccacggggcggcatggccctgtcctggagaagcttccaggctgtgggaaaggaggtttagcccttcttttgggagcccccatctgagggaggtggctcagccctgccctgatgaatccttttggcgtgagggagaggctggctacacgggcagcactcactatgcatccaggggttggcagagggtccggcaggccagcgggaggggccgtgtttagagctaaaagtggacagtgcactgagcgggttgggagcagcccggggctgggggacacagcaggaccaagtctgaggagcccctctgtcccagagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggtgagcagccgcccccctcttccaagcagcataccctaaatggcactgtgtgcctgggggcctagttccccagggccc

SEQ ID NO: 322 - DNA, 354327 bp, Homo sapiens
  misc_feature (198536)..(248535): n is a, c, g, or t
cctttgtgaatttgtcagggtttgcttttaggctttagcaggttggtctacaataggccttattgaaaagtgtgacacttattcctaaagcacatccattctagtgtctcagttggatacctgggtgctaatgaggtgtgcatgagttcttcccaccatggatggcagaaactccatcatacattccccaaccctcctccacctcaagtacctctggtccaaactcaatttcatagcagccacccctctgttaaatctgttagtcttttccttgtgcaggtagagtccactccttgataagtatgcacatggaaccccacatagactttgagagctgcacctttgatcagctgtctcctcactggtgccctgccctgcagattgcagttgcttcagccgtcttgaactctgatctctgccttctcagctcagtgagctgccctgccctgagtggactctagctcactatgcagctgctgagaaattctccccaaacaactaggaaatcatggggcttcccccttaagttttctcttggactgcctgttgtacactgctgaaaacaattttacgtttgtttatggaggcagggttagtctgatatgatttattctaacagacagaagcagaaatctgttatactcttttaattactgtgtctttataatattatggtagacagaatcctaagatgacccccagtgatctttgctcttatataatcacttcctcctgagtgtagacaaagctactgaggagatgtcactcctgtgattgtgttacaatttatggcaaaaacaagttaacagatgtaatcgagatcccaaatcggtccaatttaagatagacagattatctgatgagcttgacctagtgaacgtgagttccttggagggactgaggacttcctggagagatgtgaagtgcaggagggtttccatgcagggcgatcctcctctgctggctggaggaagcatgcagtgggaacatgggaggcctctaggagcagcgagaggcccctggctgacagccagcaagaaaacagagatctcagtcctacagtcacaaggaactgaactcagctgacaacctgaggaaacttgagaggaagttcttccccagaacctccagaaagaaacccagcctaatttcagcctgtgaggccctgagaagaagacccagagaatccaggcctgaacttctgatctgtggacactgcaagaaaataaatcattcttattttacgccgctaatgcttgcagtaatttagtatgcagcaatagaaaattaatacaaataaaatggagaaggctttggagtggggacaagaaggaaacggtgggagagggatgcctgtatgctgatatggttgatgcctgtatggttgaattgggtctaccgttcctcatctaattagctatggtctattaaggtgcatagctacacacaaatattggtactacgttcaattcagaggaataagatattgcattcttgacagtagacaagaacaccctgaatttggggtcactgtatcataagtcatgttatcaggtccctctaggaaggcttagaggaagatttccaggatacacttgtgacaacattgaaggcttcttttttccccaaagggacccgatctcccctcagtcgagaagctccaagtctctgaactggatgccaggttataaattccccctatactgactccatcaggcttctgtcctcagaactagagtttatcagtaaaagatagactcatgggagtctaggcatttattctcttattttatataaatcagttaatgtgcaggaacaaaacagactttgaagaaagacactcacagttgccacaggaaaacaccttcaacatcctcatgagtcatcatgggtgttctgttgggaggacttgataggaggctttcctcctcacgggctagtgcagatccaggggaaatgtcatcaagtcctccattcggagggtagcagctgaggctgctgattcgttaggcctcctgcagctggagatgcaagtagtgcattttcatggccaccgcagggccctcagtttagcattcttcagagccagcatccaacaagccacagaagctctgagtatttccctttcttcagtcacccacataaatggcttcagggccttctggggaaggcctgaaggaagatttacagcatacacttgtggcagcattgaaggcttcactcttcctcaagggatccaatctcccctcagtcaagaagctccaggtatctgaactggatgccaggtcataaattcccactatggtgactccatcaggtctctgtcctcagaactagagcttttctaagtgtaacgtaagttgatttcttagtagatgtcccatccattacattcccagacacctcacaatgattcgaatgattagtaaccaccacatatccctgcctctcagggaaatccctcccgccttgtctctagatggccaagtcccacggcctgtcctctactcttccagaaccctgttgttctcactgacagcagggagggcaaatccatgcagcagctcccgccatgacctccagcctgcagaggatgggcgccacaggacttttaaacgcatgccgctgttcccctcacctgtgcatttcttaacgccttggtgaggagaatgtctctggatcttccttgatgggagctaaaggaacaaaggtaaataatgctatgggacccactgagaactggggctgtggaagagtggccactgaagtaatagacagatgcagctattgccagatactcagtgccagagcagggagggacagggaagaaatacggacctcaccttcctctcacttccaggatccatcgggggccctccattgctaaacctaactagaagtgtgcacgcacgggagccagggatgcattctaggagggacgagccccgagtggcatgagacaggatggaaatgagtggacagtggatctgtgggaagaaggaggggatgttatgggaaaacaaaaggagaatactagctaagaacgctaggtgacattaatattccgaagtctgtgctcatattcagcaaagaaagttcagcataaagcactaaataaggagtcaagatattgtacttccaactgttgttccaacagctgtattatgaagggccactttatttcatgcctttctaatttgacctaaagtgccaggtggcactggggctggcacagccttgctcaattatgtgttgcagagtacacagagactgccaggctgagggaagatgcaagagaatagaagagatgctctcagggaacaagagaccacatggccccagagtcaggggcagcatcagccactgtcagctgctcattttcccagacagagcccacaagcctcagccatgctttgcttctgcaagacgcttcttcaccttttcaataaacctgcctgaatttaagctgacagggtttatttctccttcatcataaatgaaattcttcaccacaacaatctccaatgaattttgggcacagcaggcaggcccatttctgcttctgttccactatctctcctgtaggttgaaaaggaggaggtactgaattacctccaaatgttcctctggctctgatattctgttattctggttcctttttggctactttgtttttggtagcgtgtatcctaaggcgtccagttgaacaacttttgtctactgtgtccaggcattcctggtggtatttcagataagactctcttgggttgctgaactcacaaccactgaaccaattctatgaccatctgtttcatggccacatgtttgctcattttatatgtacataaagggaggggacagacagcaaacttgcgtgttacaaattgtatcatcttaaaaaggaaacaaggcaacactttgcaataaaaccttaagatgcatgaaatttgagcctaatgcaataaaggatgcccataaaattcttatctaaagaatgtttcgaaaattgttgtacaaggacatcatcatttaaagtgatatgaagaaaccttctcagctaagcatatgggctagattagagagaaaaataaaggacccatctctgccctggaaaaactgctggtagcatctttcaaaaagctctctgtgtttgagtacgcaccttgatccataggctcacatttgatcccaactggcagctgcttcttggcattaacattggattcccaactagtaaatcttaccaagatctgactttctgcagatataatattattttgtttgaccatccttatcttcaagggctaccaagaaggaaccaagaatttatttacctccccaagggaaaaggttttaccaatgagaccctttctcaccatgaccccaggaccccatatgccctgttcacttgagtgccctgtgtggcctgatagaagctcatgctggtcacaggattccttatatgactagcctccttcctgaatcccaatttcatggtggtggtcatgacaggtgtcctgtatcccatgctcatgtccctgaagtcaccagcctatctccagttagaaaaaattacatgtatatagagaggcctctttggaaggagcaaaagctttctcaccttcgtacactaatggttggaaggtacaacagcatatgcactttgggaaaaaatatctggcatattcttacagaaacaaacaactacctattctatgactcagtaattcctaagcatttatccaagagaaactaaaacctatgtccagaaaatgacttatacaagaatgttcatagcagttttattcataatacaaaaaactggaaacattcaagtatctgtcaatacaagaatggatcaataaactgtgatacactcattccatggaatggctaaaggaacaaactggtgacacacagaacaacatggatgaatctcaaaaacatttggagtgcgatagaagccatacccaaaaaagtgtgagaaaaaaagataaataataatggttccaagaaatgcacagcagacagcccagaggcaaagacccacaggacggcgggccggtcccaggctgtcgatcctaattaagaaacttctgctggattttgcccagctccatttccaaactattttgggtcagtgacttctttatcccttccatgttgcctcattttgaactagaatcactgtaagtgttattctatgtctgtcacatcattccacagtaggggcagataagctgtttagaatggctaaaattcaaaaaggtgaacacaccaaatgctgtcaaagatgaggagcaaccagaactttccatcgctagtggaaatcaaaagggtacagtcactttggaaaacttaagttcactcaaaatcctgcacagaagtacttacagcaattttattcatcatcgccaaaacttggaagtgcccaagatgtctttcaccaagcgaaagaataaacaaactgttgtagccatacaaggaaatctgattcactgattttaaaaaacaagttatcaagccatgaaaagacatgaaggaacttaaagtacataatgctagaaagaagccagtctggaaacccacatactgtaccactccaactctaggacattcttggaaagtcaaaaagatagaagtagtaaaatggtgagtggttgtcaggggtggaggagaggaggacgcgtgaaatggtgaagcacagggaattttcagcagtgaaactctttcgcatgatgctgtattggggatttaggacattatgtaattgccaaaacccataatctgtgaaactcaaagaatgacctctaatgtaaactatggactttagttgataatgacgtatcaacagtggttcatcaattgtaatgaatggaccacactaatacaacatactagtagggaaaattgtgtgctggaggacaggggagcctaggagaactctctgtattatccactcaagttttctgtaaacctagaactgttctaaaaaataatgtctattaactgtttttttaattaggatgcagcagccccatatcaaggttttggtggcatcctgtaattgtgtggttagtacttggcattgaagtgcaccaacctggagtcagagcagttggagatttcaaggcctgtgccatttacctctaaccctggggtgcccctggaatacagatagcagatcggttaaggagaagcagcctcagcaatctagacagtgcaggtttctggtgaggacaggtaaaaaccatctgggtgggcagaacttggtgaagaccagaaaccactgagactcagcagctgccgcagtggcacccacaaatcaaaggagggggctgggaagagctaagggctactggatgagctctctgcctgcaagacagaagcagatccagagattttggaaaataatgtaggtttcagtacagtgtgatctcttcaaaaaagtagagagaatgaaaaggaaagaaaaagagagagcatgagagagaaagaagaagaaaagaagaaaggaagaaaggaaagaagggagggaaggagggaaggaggaaggaagggagggatggagggcgggtgggaaggagggaaagaataaaaagagagagaaagagagttggagggaagtagggaaggaaggaaggaaggaaggaaatgaacaaatttacatgaagatgagaacagtggggaaacttacaccaccaatattttccattaacaggaacacgctaagtagttattagagaaagacacgctactgtaaaacaatatactgtttccatggggtacaacaaccccttcctcctcctctgaaacacattctatctctggctcactgttgccagagacactgagtcttgtctttggatacgttctggtgcccacaagaatgagatgagacagtggatcccagaacaccaggccacgaacttccctgttgctccttgtccactccagaagctacccagctgcagttggggacctcagcccctgggtctgatgtcatccatttgcctttctcaatggacttctctccttgcactggctcctactcccccaggacctgtgggtgaccacatgagaagaacacaaacaggccatgcccctttctttctccccctctcaatgcctgcagtagtgggttccatggggtagtgacctgagatttactcattgtggggcctctagcccagagcagggcctactacctcacagtcaccccatgaatgctcagtgaaagaagacgtccaccacaaggtcctggggaaccaagaattccactgtggcccataaattctaagtctacaggattctggaatgggagatgggaaaggccttcaaaagtggccacttttaacccattatactggcaactgagccatgtttccccatcctggacacatccagagggcactgcctaaaaccagacacatctccccacccaggacagtgtaggagccttagcctgggggatgcaggtggacagggagggggtgagccaccaaagctgaagagcagaaagcaggtgaaaggggacagcagggtggaaacagagagaaatgggggcagagaatggggggtgagaggggaagagtgaggagagggatgcagatctagctagtaaggaaaagtcctggagagaacactgtcctctcctgaagtaaaatcacttctacctgaccacggcactgcagctcatgggcagcacatgctgtggatatttgttcattcatttaacaaatatttatttaatatctgttgcatgccaagcaaggccctgcaatgtttagggaccttgacatcttcccttcacatctgagtcataatacaaagaggactctctgaccccactgagctggcaatgcctcgggatttttacctgttggatctggcagctcttgatgtcagcccacaccatgtgaggctgctcttggtgcacccaatggggaagtttctacatcagggcctcggagaatccactggaagccctggacagtgggagtcagcggcatccccagtgtggaggccaagagcacacagtgcttaagctccaggcaccctcaggaggacggcaagggacaattggctggtgagagcccgggtcaccgggaaccttcgcctgggtctaaacaggatttgccttcagattgcctgtgagataaaagagagaaatcaaggttaacgttgagatttagggcttcggtaacttgaaggatggagctgccatttacggagactgggaagacccagggaagagcagattgaaaggtggtgggaactagaggtggttgggtttctgtcatatgtaatcaacagtcctgaccagcctgggcaacatagtaagaccccgtctgggaaaagaaaaaaggaaaaataagctgagcatggtggtgcacacttgtagtctcagctacttgggaggctgaggcaggaggattccttgagccttcagttagcggttagtgagctatgatggcaccactgtactccagcctggggggaaaaaaataaagagtcctgactaaatactagagtagccagggaagttttcacaaagtaagtaatatttgaggcagatcttagtgaacaagaattccattatttctgttagggaattaagagagtgtgggtgtcgttagttaatgcttattaaagtagctttggaatctcatctactggtctagctggtctatctgtacacgtatattgtatatgctgtctctctgagctttcgctaggttatgctacggtaacaaaagccccaaaatcttagcagctacacatacgaaggtttatttttcattgacatgtccttttatggcaggttgactgtgactctactctatacaagctactttatttgttagatggtgaaaactgtgatactcggaggttgttgaatatggtattagtatgttcattcattcattcatttaagaaatatttattcaatatctgtttcatgccaggcaaggtcaagtactgagaatacactggtgaatcaaagagacaaaatctctaattgccaggagcttatattgaaaatcagattaaacacatacaaaatcatcataataacaacaatgaatactatattcataaataatagctgtaagagattttagtacatcttttaaattagaaaaatataaaaattattaaaactaaaatggccaggtgtgatggctcatgcctgtgatcccaacactttgggatgccaaggtgggaggatcatttcagcccaggagtttgaaaccagtctgggcactacaggaaaaccctgtctacaaaaaggagaaaattagccgggcacagtggtgcatgcctgtagacccagctactaaggaggctgaggtgggaggagtgcttgagcctgagagatcaaggctgcagagagccatgatcataccactgcactccagcctgggcgacagagcgagacactgtctcaagaaaaaaaaaaaaattatttgatgtagtcctaaaactattatgtagaatactattgtttatatcacagcacgtgagccccttaaatggcttaacacttatttaggtatgatccataaagcttttctggtaattaagtatacttaagaacaattaagtataaaagagttactgccttgacaggaagattgtaaaaattttaaaaagacaaataaataaaagagtaaaaactgtagctctgtgaggctcaaataacatctaattcaagtcacaatgaacatctagcaatcattctgaacaccatataattcacttaatacgttttgcctgaacacccaacacatctgaattaccaacacccatatgtagccaagaaactggcaatcatttataaattatcacctatgactccatctgctctacgcacttattttttaaattttattcatttatttattatttttatttgttgtagagatgggatctcactatgttacccaagttggtccagaaacagaaacagacccacactaatttcataaatcagatgaccatacagtcattcgatttatgaaaaaaagtgccacatggtgcggaaggaaaaggatggtcttttcaataaatggtgctggatcaagcagacacatccatgtagtaaaaagtgaatcatagccaggtggggtggctcacacctgtaattccagcactctgggaggctgaagcgggcagattacttgagcccaggagttcgagaccaacctgggaaacatgttgaatccccatctctacaaaaaatatgaaaattagccaggcatggtggcacatgcctatagtcgcagctactcaggaggctgaggtgggaggatcacttgagccaggagatggaggttgagtgagctgagatcctgccaccacactctagcctgggcaataatagactgaggccctgtctgaaaaaaaaaaaaagcaaaaactaaaataaaatcgttataaggttaacacagaaaaatgtgttcatactcttaggttaggcattgatttcttaaacaggacacaaaaaacagtaaccataaaggaaaagattaataaagtataatttcattaaaatgaagaatctcaggctgggtgcagtggctcatgcctgtaatcccaaccctttgggaggccgaggcaggtgtatcacttgagcctaggaattccagaccagcctatgcaacgtggcaaaacccatctctactaaaaatacagaaaacagctgagtgtggtggtactcccctgtaggtcccagctacttgggggctgaggcagggggatcacctgagccttgtgaggtcaaggttgcagtgagctgtgattgtgccactgcactccagcctgggcgatggagtgagatcctgtctcaaaaagaaaaaaaaaaaaagagaatctcccttcatgaaaaaacaccataaaagagtgaaaacgcaagctacagattgaaaaaagggaaatgcaatacatataaatcctagaaaggaggcatatccagaataaagtattacaaatcaacaggaaaacaagcatatcaatgaaaactggataaaaagatttaacaggcacgtcacaaaagaggacatataaatggcaataaaagatactcaatctcaatgaaaccacactgatatattactgcacccctactagaatggcaaaataatttttaactgacaggtatcagcgaagatgtggggtaaccagcatatccctgctaaatggtacaactactttgggaaaatgttcaacaatatgtaatactaaagttttatcattcatatacctctaaaaccaacaatgccacccctacaaatataccccagactagtaatgttcaatttcttgatctgtggtggttcacttggtaaaaattcattacttttttttttttttttttgagacagggtctcactctgccatccaggtcggagtgcactgccatgatcacggctcactgcaatctcaacctcccgggctctggtgatcctcccaactcagcctaccgggtagctgggactacaggcacacgccaccacacacagctaacttctgtatttttagtagagaaagggttttgccacattgcccaggctggtctggaaatcctgggctcaagtgatctacccaccttggcgtcccaaagtgctgggattacaggtgtgatcactgcgcccgggccacctgcacatgtaaaattgtgaacttctgtatacttcagtaacttttccaagatttctttgacgcaaagttctcagaaatcttaaagctagcatttcagaatagaaaaagtagcttctggttcactagtgaaattttaccaatagaatttaaaaacaaaaagctactaacgcatatcagctcagaacactaccagcagatcttttctttaacttcctgaagcactgggattcattcttttggcaaagaaaggatgaacaacactgtaacccaaagaaaagataccactgccagaaaagacttcttttcgaaagcagctctaagcaaaagataggaggaaaacaaggaagccaggccaaacgtcttggttaactctccgctgaaaggacgccacatgagatgatctaagaagccagccagccagccagacgcagggaaatcacagcaactctttggagtgcaaacagcaaccccacaatccaatctacccgaaatcctgcggttcatttgaggcttgccccgctagtcaggaggtgattcagtgatggctacaaatgctgctcatgtgcatcctggagctggcacacctggcttgcccatcaccagcctggagacaccgccaggagcagaagcccggaggccagtaaagaccccaactttgcaagtcaggggcgcgagcgcgctcgcctctcaggtccgcagagggaacggatttctggcctggagggtggggtgcggggtcagtgtcctctacaggatataggaggacgtgcccccgaagctgctccgtccctccaccccctgggatgccacagaacacccgccagcgagtttcttccccagcgcccacgagagttgggctgcgggcggcagcggcaggcgaagaatccagcgcggggaactcaggccccggcggtgcacgaccccccacagcccccacccgcccccgcgctcgcgcaacaaaacttgccacggccgcgcctcgacccagctgtgcgcccgcgggtcccggattcaccgcccgcccagcctggcgcggcgccctcacctcagaaacgctgggtggacttcgcgtaacttcccattcacagggcagccggcagccgcgccgccgcgcctcggcccagctcctggcgccgcagatcgcccgtcccgcgttcccaaaagcaccgcgctcgctcagaagctcgggcagcctcgcgaccctcacctacgcctcccagtaccgccgctgtctcaaccgccacccagcccctcgcctgcgcctgcgcctgcagcccactggctcctcaggatcccgatgggcgtgtcaggataacccaaggcgcaggcgcggcggggccttaaagggacccggcggcctcttctgcacaacgggttcgagcaggttaggggccgcgcaggcggaggaaaggagtaacccaggggaaggaccgagtgcagcggggacggggaaatccctctctcccctccgcctgtctttcaaagcaccagccctcgaccctccaaatcgctggtttccccggccacttgaacagcccctgccaggttgaagaggcaggagacacaccccctctggggctggagcgaccccgcgcttaggactgcaggcctcgcgctgccgcaccgccccgaatctgacttccaggcacgggcacgcggtgcagtcgggcaggcttcagaagagcccccagctctcccagaggtggccttaggtcactctcaaaaagaataaccaatgtgtcaatggcacttgtagttattttctaatttaaatttattaacagattttgcagatgggcttccactgaaataagcctttgagaaaaagaaaaactttttttttcaacaggattagaataccaagaaataggaagtaaagccatgccgtccacccagctaaaaactttgaaaacttgatattttatctaaggcaaatgtttgcataactttaggtcatgccattatttaaagtcaatttcagttaacaatttcattgcaactgaatctatcttgtataagaaaactaagatacatccctgataatctacctctcccctcctatactccatccgtcagcaaatcctactggtttttaccttccaaattttccttgaatctgtcctcttctatctcctccgtcaccaccctagtctaggctgccttcacctggggagtgagggtcgagggactactgacctagtcttcttgtggtttacccatatcccctttatcgcctctctaatctcaacacaacaggcagagtggcttttccaaaatataatgtgaccgtgtcacttcccagcctaaagcacttaaacaccttcccattctcttagacaaaacctcctaactaaccaagccccgaatggccaggcgccttgcccacttcttcatctcttctcactactcagaccaattctgttctgctctctctgctccagccaaactggcctcttttattccctatttaccagcttcctggcctccacagagcttttgctcatgctttgctctgtgcctggaaagttcttctaacccctattcttctgagaacagctgtagtctccacctctgaaaagcaccttctgacctccctatggtggtcccttactcctatcacattgcatgaaactgtaatcgggtggttattttggtgaattttttactatcggctacgtaagcccagggtttggttttgtttgcttcatgatttgtatttccacatttgttaaatacatatttgttcataaatgagaatgatggatgctagaagttgaagtaaatttggcataaagtcagagaaagagaaaatgtcacaatctgacagttggagtcagaatgtagaaacttcagttatattaaaactgattttatatcgttttaggctgagttgtcttaggatgctttgggtaacctttaaaactgagttctcaaagagccttgtataaacacctgaattaataatgataagccatggggtggcccacataaaactaataacattggttgctttaagagaggaagactgagccaggcacagtggctcatacctgtaatccaagcactttgggaggccaaggcccgcagatcatttgagctcaggagtttgagactaacctgggcaacttggtgagaccctgtctctacataaaatacaagcaaaattagccaggcgtggtggcgggcacctgtactcccagctatttgggaggctgaggtgggaggattgcttgagctcaggaggttgaggctgcagtgagccatgatcatgccactgcattccagcctggatgacagagcaagatcttgtctcaaagagagagagagagagagagagaaatgaagactggtgactggtggctactggtgggaaggagatttttactaaatgcccaaaaggtttaaaattgtaacttttttatttcaaagtctgtgaagataaatgacacaaaagagcacataccttcccatttatttgaaattctagaaaggggaaaattaatctgtggtgaaaaaatcatagcagtggttccctctggcaggggattgactgggaagttacatgagagaaatttctgggtggtaaaaatggtctctgtcttgatagggatatgagttatataagtgtattcatttgtcaaaaaacatacagttaacatttcaatgaatgtaaattttaccttaaaaactatacgaataaatgcaaatttaaaatctgctagctaacacctagttgagtactcagtgtctatgggcattggccgaggctatacatacacgattttctttagtcctcataccgtcctcatggggtaggtattattatcataacccccttgcatatgaagaagccaaaatgcagtaaataccaaataacttgcctcgatttatacccctggaaaatgcgggaagagctttaaacaccatcagtcaaatgccagaagttgttaaacattagactctatagcacttctctgaaattatagtatttttggtatatgtatatatatatatatatatatcatctactagatcaagagcttcacaatgattgaaatcatagtttgtctttttgtttgaggtttatgtttttattttacttcattattttaaagactgagtctcggccgggcacggtggctcatgcctgtaatcccaacactttgggaggccaaggtgggtggatcacttgaggtcaggagttcgagaccagcctggccaacatggtgaaaccccatctctactaaaaatacaaaattagccaggtgtggtggcacgtgcctgtaatcccagttactcaggaggctaaggcaggagaatcgcttgaacctgggaggtggaggttgcagtgagccaaaattgtgccactgcactccagcctggccgacagagtgagactccatctcagagaaaaaaaaaaaaaagactgagtctcactatgctgcccaggctggacttggactccttcattcaagccatcctcctgcctaggcttcacctgggactacaggcccaatatttttgtcttaagtttctaagcagtcccaagactttgcacagtagctgttcaatgtattttgagtgaatgattaaaaacaagcttgatgtcgattttattggtacaatttatatttacatatgtaatatttatatgcttttatatatttatgtgtgcatgtatataattggtactaacttagcactgctgtgcctaagtgcctgagatgcatctcaaatgaataggcctgaggagagaagcttgtgtcattagctctgaccctgcagcactaatcctggtttacccctttctttcagtctccctgagcacaatttatttgctgaaaggccacatctcactatggagtgaggatcaagaagtaaaggtctgaaagagagaagctgcggggctggggagactgttggtcggagaggcgtcgggggcccaaggaaaagggaggattgtggggaggaatcggcgtagagatgagaggagcagcagagacagagtctcacgcagaggtgtgcccagacaccctgaaccaagttacttaacctcgtccaccaccgtggcacccgtggggtccgtgggcccgtcggtcttccaggagggattctgtgtccctgttattgtgtgtcaacatgtgttagcctgatatttatatttttaatgagagaaaacgaactctggaatttgcgaactgttttttcgttttgctttatacctcttggacactccttccgaaggattgggtctcaagggcagtggggtgtgactacggtagacagggctgattaattttcatccaaaactctttggcggattcccctgctctccgcttctccggtctaacagtagtttaaaatagaagatcagcaacatttggagagtttttttctttgcattttaatgataaacttgatttattccattccaaaagttttcttattctgaggttgtctttctatattttgagtataaaacaatggccatactatgttggaaccaccaaggttcttctcttcacttgttcatttgtaatgtctctttataatctgagaatttcctgagcaaactgggaactgttatacataattccttgtttttcaacattctttgtaaacaggaatcaggattggggatggggagggagggaggagtaggagtcctgatttgtggaacagaaaatcatggattacttatgtgatggagcaaagggtttaaaaactcttagcatccccagatttccccttttactgtttgctgaagaaaattctgtctttgactcccttccttaccctctccgggcctgtgagaagcttcctccctatccagtttatttcctcctctgctccccgacccaccccccacagccccctcctctttttcagtgaagccgctggaggaaagtcgggtttgggagaagacccacacaggcaaggacagcaggagaacactgacatagttacactcttgtcaccagcacttttattaagacgtgaaaagacaaagacaacagaggagagcagagaataatatctctgtttcagctattccaggatgttatgccaattatccagagtccttgatctgatgtagtaaagagctagggacattttccctgaaggctttgattgctggcaaaatctcattaaacgtgtatacattcataggttggccataggatggataaaagaagagcctctggcctacatctgccacgatacatgtgcaaaaatgctctctgcagcattatttttcattgtaaaatagcagaacaaatttattattcaataattataaaatggtcaaatgtatgtgactatatttggacaatgaaaaatgcagctgttaaaagcagacaatactgatgattcagatgatgttactgatgaaaataataacagatgacaattattgagcatttatggcattcttacaggcattaccttatttaaagttcagaactaccaaggaaaagagtaacttgtggcaggcgtgagaggttccgaggcacaaaaggaagataggcattcaaggaacaccaggatagaagacccagagtaggagaagagagaggaagaggagtccgccagatgggatgctggaaaccgcgggatagctcggtggagagagggcgctcctgctccgcaagcctccctacgacggcaggcctacccggtcctgctcctgccggctctgggcatctggtttctgccgctccatctccagggagatggtggccaggctgtgccgtgtacccatcaacttctctgacagcgccatcttctcagactccttcagagacaaggcctgggcagaggcaggggacaaagggcttgggggatgggctggtcctgggggcatgctcaggcttcttgctgcctaggaaatgtgcccactgggggcttagaggcctgagtgtgccactgcaggtggacccagggcagacatgcagccctggaaaagggcacaacggcagtcacaagaatcccggacgtggataccactcatagagctcactaacccgccacagcaccctgactgcagagtctttctttctacccatcttacagatgaggaaactgaggctcaaggaggtaaagtgactcgcccaggtacacagctggtgaggagaggagatgggcacagtctgccctgtctccgttacattataggaaagttagggatttgttatttggggggacacgtcagctgatgcctgtgggcatcgtggggactgctcagaaggcagccatgaggatccatgcccagcgtggggtgggacgaggcatgggagaatatggaacagctttcctggtgtcacgactgtcactgtcactcagtaagtgctcactgtgtgccaggcatggagcacagcaaagcctcacgaacccccttctaatcctcccctcctgcaggtaaggaaactgaggcccccaagagggcagtggcctgccccagggctcctagctgccaagtggcagagcagggcccggccccagaactggagcagctcagagagcagcagaggccacgccagggctcacgaacctgctgcttctcgctctcggccaggaggaggccctcgtcatgctcctgctgcagggcagcaatctcctcactcagctgttccttctcagccttccgccgggccagcagctcctcctgctcacgctgcagctgactctgcagctgggcccgctcggcctccagctcccgccatgctgcctcctagggggccaggactggacgcgtgtgacacaccaggaggggcccaggcagaccccccaaaacatcagggcagcaagagccatctggcccccataccctcagagatggagggtgaccaggtaaatacaagggactgataagggctatgacggggacacgccagggccgtgaaagtgccaaggagcagcagtgggctggcctgggggtccgaacatgatcccctgcggagagacaagtaactgtcagccaggtaaggagagaaaagaccaccccaggccaagagcacagcccctggaaaggactacaggatgcagggtgcagagggaaacagggcacggtgagtcacagggccagagccccaggcagtggctgggccaggacaggccgtgtgggccatggggattctaaggacagtgaggggagtgggagagaggactcgagccaaggtgacaaggagcaatctgatttttagcttaggggatgttccgacagctgtggaagagggattggggttgggatggaggagagttaggactggctgtgaggaatgaagggggtcaggggttgccagaggagctggagagaagaacacagatttggggacattaatgaggccaagccaggcaatgcaaagggcaagaagagcaagggggaggtcacagttcagatccctggggactggacaggcgggcaggcagagcccacaggcaaatagcagcccacccggggagcccgagggcaggtgcctgcctcagcagttgtccctagcaactctgtgagaagcagacagagctgccacttcttttttttttttttttttagacagagtctcgctctgtcacccaggctggagtgcagtggcgtgattttggctcactgcaacctctgcctcccaggttgaagcgattcttctgccttaccctcccaagtatctgggactacaggcgcgtgccaccatgcccagctaattttttgtgattttaggagagatagggtttcactgtgttagctaggatggtctcgatctcctgacctcgtgatccgcccacctcagcctcccaaagtgctgggattacaggcatgagtcagcacgcccggccaagccaccccttctttaagagcttcaccatagctcatgcctggaatcccagcactttcggaaagagctttaccgccccctgatggagaagcgtgataaccaccacccaaggccatggggactgcagggtgagtggcatgccctggagccatgtagtcatagcctgcacctctgtcagaggaagccctgtctaggatttggtggctgagggcccctgttctgagggccactctggagagcatgccagtgccagcaatcataactcatggagcatttgctaagtaccagtcactatgttaagccctctatgcagatggtctcagctcatcctcaataccttccactatcctatccctatttctacaggtggggaaatgaaggcacagacaccttgggtagcatcaccagtaagcgaccaagattagattcaaacccaggcaatataaccccagagtcagtgttctagtaacttccctggccccttgcctttctacatgctcaggtctgcgtggcccttcatatggaaacttcttagcaaatgaaagtgctttcctgctgtgcattaggtcaacatttcccaaatgtggttgtggaccctctgcatcaggattaccagggctggaccagatttgggacctgggtatctgaatgtctaataaggaccacaacctccccaccacccctccagtcctcccagctgtccccagggcctccacaacagagagggagtcccatttcacagatgtacagaccgaggcagagcaagaacgatgatgaaacactggctcagacttctgcccacccctccccagctgcctgaaccttttcacgctggagtcactgtaagtcctcctcctgggctgcccactgctcccgcagagaggcctgggcctcccgctcagcctgcaccagcttctgggccatcagctccttgtctagactggctttctcctgcgtagctattatttgctgccgcaggcccgccaactcccctgcacgagaggaatgggggaaagggcagggttgggttgaaatttttccttgggccagcagacttaggccagttgagccatatgggcaaaatcccagaggcagagggcctgcctggcatccagtttgggtcctcttgaagaagtggcttgtcctctctgggcctcagtttccctatctgctacatgggcccactggccctgacccctttcctgcctacctagaatggcattaaaggcataaaatgactgatgagaaggcctcccaaatgggacggatgtcaaacatataacaaccctaggccaggtgccatggctcactcctgtaatcccagcactttgggaagctggggcaggtggatcaccttaggtaaggagttcaagaccagcctggccaacacggtgaaaccctgtctctactaaaaatacaacaattagctgggcatggtggcggacgtatgtagtcctagctacttgggaggctgaggcaggagaatcgcttgaacccaagaggcagaagttgcagtgagctcagatcgcaccactgcactccaacctgggcgacaagagtgagactctgtctcaaaaaatcaaacaggctgggcgcggtggctcatgcctgtaatcccagcactttgggaggccgaagtgggcagatcacctgaggtcgagagttcgagaccagcttgaccaacatggtgaaaccccgtctctactaaaaatacaaaattagccaggcatggtggcgcgtgcctgtaatcccagctacttggaaggctgaggcaggagaatcgcttgaacctgggaggcggaggttgaggtgagccaaaatcgcgccattgcactccagcctgggcaacaagagtgaaactccatctcaaaacaaacaaacaaaaacaaacaaacaaacaaaaaccctattactgactcagcacttactatgcgtcaagcacccagctaagtattttagacataacctcattttgtcttcataacatgcctatgtagtttatcctcatccccgtttaacagatgatgaaatggaggatcagaggagatcagcagcaacttcccacagctgcacagctacacataaagcatctcctttaatgactgacatgaacatacctgtcaagcattaactatcagcattaatggaaacgactacagggaatggaaatggtatagccatcatctaaaaaccatctcccgggttggaaacccaccagcatttcccttcctggttctgtctggctcaggtgtacatggacaggaaaattaatttccatgacccaagtaggtgcttagttaatgttagatgagcagaaagaagccctgagttcagagattcgatggggaacggtgcagggaagtggggctcggattctggggccaagagagtcatctgaaaaccacagagaactcagactaacaggcctgatgaccgatgaacagcagttactgttgactcagccaggcaccgtgccacggccttacacgcttttcccatgtcatcctggcaacaggcttagaaggtgggcattgccacctccaatcatcagctgaggaatctgcagcccagagaggaaaggggcttgctcaagggaaggtgagatctaagtggtggcacaggactggaacccaggccagccagactcctactccagtgctcccaacttctgtgagactacagacattgggaggttgcagtctgggctggaacctggtgttccccccaagtccccagccactcgtaccagtcagggtctccttggccagcagcagggcctgcccctcggcttccagctgctcccggcgggcctcaagctgggccagctgccattgcacctcaaacaggctgccctccagggcttccttctccaagctgcagcacatacagtgcgtgaggccctgggactcagcctccctggccccaggaaactgtggatctcagggagtggccaggcatgggccaagtgccaatctacctgcctggccaggcccacactccctggggaagcctgagcccacagctaggacgagttggcaagccagactccttagtaactgcccctgggggcccgtgcctgggtgaggctgttcatggcgtggccccaggaggaccgcccagggcgggttgggcagagcccaaggccttactgcaggtgtgtggcctcctctgacacggtcctgccttcacgctccgcaggccgccagctgcacagccaggccagcgtgctccttggctagcgcctccttctcccgggccacttgccccagcgtctccacctgtcactgggcctcccaccgggcctgctccagctcctgctcccgcctgctcagctgccaggagagctggctcccacccagagactgagtagcactcccagcatcccccagcttgttcatcgtgcagtaccccaactctgggcctaacccagtcctggcagaaggcctgggttcgagcccagggtctgccctgatgtgctatatgtacttgggcaagtcatgaccttctctagatctgcaatgcacgtgtgtacaaaaaccagggcccggccggacacggtggctcacgcctataatcccagcactttggcaggtggatcacttgaggtcaagagttcaagaccagcctggccaacgtggtgaaaccctgtctctactaaaaatacaaaaattagccgggcatggtggtgcacgcctgtagtccctgctacttgggacgctgaggcaggcgaacagcttaaaccccggaggcagaggttgcagtgagcccagatcgtgccactgcactccagcctgggcaacagagcaagactgtcaaaaaaaaaaaaaaaaaaaaaaaaaaagaaaagaaaaatgagggtcctcactcagctttggaagtaacagaacccttgtattactctaagcagagaagctgaatatataaaccagacccaaatgcagctgctcagcaggcctcaaggtggagacttgcaccctgcttcctgcactccctaccccatcctctagaggcacctcccagaaacccaggccctccaggatggaccttgcatgaaggtccctggatccctgaaacattaaggtctcttcgagatgtgaagttcccaaaagtctaagattccaattctaaaaagtctccacctattattaatctgtatcattattattattattattgagacggagtcttgctctgttgcccaggctgcagtgcagtggcacgatcttggctcactgcaacctctgcctcctgggttcaagcgattctcctgcctcagcctcctgagtagctgggactacaggcgcgtgccaccacacccagctaattttttgtagagatagggtttcaccgtgttagccaggatggtcttgatctccggacctcaggtgatccacccgcctcggcttccccaactgctgggattataggcgtgagccactgcacccggctagccccatgttataaatggggcaactgaggtatgggaggttgggcagcttgtccaaggtccccagctaggagaagtgggactggatttaacccagaagcaggctccagtgcctgtgacttaacccaggactggatgcaggaggctgcgagcctggcctgccccacatgctctccagaccaccccacacacagtttggcctacctgtgctagctgctcctgcagccaactgagctcatggtgcagtgtggggagctgttgctccagcgcctcctgggcctgctccgccactcatagggagccctccaggccctgccgtgccacctcctgctccaaccacagctcctccagccactcctgctctgccggcgccactgtggcctcctgctccgcctgccgctgccggccctgcagcatggccttttcttcctccagctgtgggccggaaaggagtggggcctcatgagcagggcgtccctcccaggaccaggacgcctcctccacccacccaccagccacgatagcccaggggaggctcccagggaatgagggacagtgcccttgggtgtgtgggacactggggagggggagatgaggagggcccatggagcgtcggtgctttgactcctagagaggacagacagacagacggagatagacagagaaccagagacagaaagggaggcaggggccaagacaggtgcagggccgggcccagggtgcctcactgagtggggaggacgggtgggcaaggtaggtgggcccgcaggtgcacagtgtacctgggtgacaaggcagttcagatccaacttgtcctgagcaaggctctcgttgagggcgctcagcttggacagggagtcctgcagggaggcctcctctgccctcagcttggtcacggagagctcgagctccatgcggccagcctcaccctgcagggtcaggccccaagagatgaggaagggcagaaaggtcgggaggaggtgaggagagacaagaagagacccagagagatggaccctcggagacaggggaggggagacaaggaggggatacggcgtgagatggaaaaaaaaatcaccgcagaaagcctgctgcttatggagccatttaaaagccatgcaccgcaaagctgtgcaaaaatagctcaagctgcagggcagggccagagttcagaggatcccctgagtaaggtctagggatagcactgctcagagcccaggctgcagcggacagcgcaggcccccccgccaaggaccctctgcgctgtggccacaactctcagactccaggagctgaatctcaggatgaccctgagctataggcactgcccccaggagcatccagaacagcagggatacggccataaagagaggtcagtccacttatggctgggaccagaggtccagaggtctgtggcctgtgacaaagatcagcctgtatccagaaggaaggggtcagtctgtgaccaggctcagaggtctgcctgacactgggaccagtctgtgccagagtgacaaggcttggggctgggggtcagaggtaggtttgtggttgtgcagcagacagggacccaccttggtcagcgcctcggccacctcggtcttctcggcctgcagcatgtcccgttgcagcgtggcgcggctcagcgcctccctcacctccaccagctccttggccaggactgagcgcttcccttccagctgctctagttgtctatggctgtgggacaaagggtgggtgggtggcccatgtcactttcctgcccgaacctcctgtagccagcaagatgctgggccggggaccaggcctgaggcacgagtttggagagaaacagcctgagccacagggcaaccaagcccactaccgcttagctccatgaccctgggcctccgttttcacatctgcaaaatgaggtaacacttgcctcgtgacattgtttgtttttttgagacagagtcttgctctgtcgcccagtctggagtacagtggtgcgatcctggctgactgcaacctctgcctcccaggttcaagcaattctcctgcctcagcctccctagtagctgggattacaggtgctcaccaccacacctgactaatttttgtagttttagtagagacggggtttccccatgttggtcaggctggtcttgaactcctgacctcaggcgattcgcctgcctcggcctcccaaagtgctgggattacaggcgtgagccaccgtgcccagcctgttttaaggatacaaacttcacatgtgcttaaaatagtgcctgacacatctccccaaggaccttcagaaacaagaataacatgctccaccacagtctactaaacatcatcagcgatcacgtccctgagaggtaagcagcgcagtggtgaagaggttaactctgaaggcagaatgtctgggttcaaatcctggctcttctgctaactgtgtgacctggggcaagtgacatggcttctctgtgcctcagtttaccatccacaaaatggagataacagcttctatgtcacagagttatcatggagttaaatgagagaactgaattgcttaaaatggtatctggcacttagtgaaattagtaaggatattattattcttctaactaaatttttaaaatactactactaatattactagtgttattttaattattcttgttattatcatccaagttctaccttttaactagttctctgactccaggtaagtgactatacctccctgagccccagtttcctgaaatgggtctggttagaaaacccgacatcagaggggtccagacggtaggaggcccaggacccagtgggtgtcacctaaccccatgggggcactgtcaggggacccgaggcacatttgaagggtcctggcagggaggtgagatgctgctaacctgcgctcaagctcccggcgaacccgtgcgccattctgcaccgcctcttcctgctcttcctccagccggtcccgctggcgctgcagctcctcctgggcaacctgcagcttctcccgctcctgcggcagctcctcggcctgctgctgggccacctgcaggctgtggaccaggttgctcttctcccttcaggacaaggggagcgggagcagaggggatgctggggctgctctctccagggaaggtggctggctgctcctctagccatgagctacatcctcccgtcttccaaggcacctgcctccaggaagccttccctgaccctgcccatagcagactcatttcactcacacactccagcagaagaacctggctttccttctccccagcccgcccacttagagtggatggaggtgctggcgtgatctctaagcactctaccacgtagaagaggccaggctaggctcctgggacacacaggcaattgtgccaccagttctgctaggccatgtgaccaggaaatgtcccctagaacaccccatgcccctcaattctgggaagcctgatagagctgagtctgcagatcccacagcttcctgctacacaggcacatggtggccacggcaggggagggaggagaagggaacaactaggaccccaaagacttgctgtgagctgccactttccccactggtggtaggtgcaaaaaacttcaagacgtgatttttttttttttttttttttgagatggagtctcgctctgttgcccaggctggagtgcagtggcacgatctctcctcactgcaagctccgccttctgggttcacgccattctcttgcctcagcctcccgagtatctgggaatacaggcgcccgccaccacgcctggctaatttttttttttttttttgagacggagtctcgctttgtcacgcaggctggagtgcagtggtgccatctcggctcactgcaacctctgcctcccgagttcatgccattctcctgcctcagcctcccgagtagccggaactacaggcactcgccacgatgcccggctaattttttatatttttagtacagatggggtttcaccgtgttagccaggttggtctcaatctcctgacctcgtgatccacccgcctcggcctcccaaagtgttgggattacaggcgtgggccaccgcgtccagcaatttttttgtttttacacacagtctcactcttgcctaggctggagtgcagtgacacaatctcactgcactccacacagcttgctgcaatctccacctccagagttcaagcgattctcctgcctcagcctcccgagtagctgggattacaagcgcctatcaccacgcccagctaatttttgcatttttatttagaagtggggtttcaccatgttggccaggctggtctcaaattcctgacctcaagtgatctgcacgcctcggcctcccaaagtgctgggattacaggcgttagccactgtgcctgggcaattttttaaatttttagtagagatggggtttcgccatgttggccagtgcctgcgggacaagaccgacggcgccacgcaggtgttcctctagggcccgccgctcactctcgctgtcgctaagctgcttccgcagggtgcccagcaggtcctggcttgcctcatagcgcccacgcatgttctggggcgtggggatcacagagtctagcgggggtcctttgaggcctccagagcccacctactctcttctggttccagggatacacactagcctacgctaggcggggtccagggcctggacctgccctggggcaggataggggcctaggcctgagagccaggcttccactcccctcctatgtgccctcaccaccctctgaaccctcatctccctggggtcccggacaactcctatcaaagcccccgggatgccagacaaactcccaggcacactcgtctcctgggttctgatcccacccccagggctcccaggctcctcccccttgcatcctggttccactctcacactcctccctaccctggctctgcccctagttcccaagctctcatcctaggctgtgatttcccttgctagaccttttcccagggtcctggctctgtatgaccagggacctgtctccctctctaccaggaccctaacactgtcgcagcctcctccctccaccggctgcccaagcacccacccccagctgcccaagcacccccacttctgggctggcttcagcgcagagccctcgaccacctccttgggggtcctgacaccctcagacactatttctcagggctctggctgcaccccagggcgctcagactcctcccccagacacgcccccacccccacctggagggcgcgagcccctccccctgggcctctggctgcgcccagaaaactcaagccccttcctacctggaccttcagctggcaaaagtgcagggcggagagaatcagggcaagcgagcgtggagtcttctgagcaggccggggaggggcctctgcggggcgaacggcctcggcccggcgaggagcgccgcggtggagacggggtccgctggcccgagagcccccgcaggctgcggtcggacgctgttggacgcaggctgccgctctcagcgtcagacaggacggcctgagggtaagggagggaagcaggaggccgcagagttaggaacttcggggttagctggcaaaaacgaccaggggaggctgggggccgcctcatcccaaatgctcccgcttacaagaagccttctgatttcacctcctccactagctcagtcctcagctcgccgctgaggcatcccatttattgcgaagacatcatttggcattgctcacaggtgggctccgagagggccgtgcctcccctctgagactgggggctccccagggcagaggccgggtgagctagcaggggtgctgagcagctacagcctgggtcccagggccccacccatctgcagttcaatccgaagccaccgaaaggcgaggcgggggagcccaggaccgcctggcagggccctgtcttcccgcctttctgggctcacacctgtgccaggtcccttaggctccgctgtagcccctctccatcctctgtctccagggccgcctgctcctgtagccgcagggattcctggagtgcggtgagggagacaaagagtggtcggggttctgtcttacctgaaacctcccctttccctccctccctggcccaccactgatcaggtggcctctgaagccatgtccataggccagccacctggtagaccccacagcaggcccgaggccctcaatgaacagaccaggcccagagaagagctgggttctgccccaggtcacacagtcgattgcaggagagctggacctagaacccaggccaggccccacacagaggggtgactaaaccaggctggaccctgggggagtgagtgtcccactggtgggggtggacagttgggattccaaaggcagcatctggacctggagagcgtggatgggagttcaagtcccaactctcctgcttactggctctgagactggacaagcatttcccctcttgggcctcagtttcccatccgtgtcattaggattactctacagggctgctgggagggagaaatgggatggaggaagtgagtgtgcttcccacaaagcctgcacacctgtgtgggctgaacctgagtgtgagtgggatgctgggggtggcccaggcagcccagccctaagcctgtgtccatggatctggccggtaccccatcccaccctgccccatctcaggggcagctgaagctcaccagggcctcaagcttctcggtgaggtccttgtcgacctgatccttctccagattctgcttctgtagacgcttcactgccaggcccagctctgtcactctggagttgggggagcaacagaggtgaatacgggaccaccccagcctctcaaatccactagctctgtgtccaccatgcttctccaaacccgaggcagggaccctaacatccacctccctggctgtgtgaccttaaacaagttgtggctcctctccagacctcacacttctcatctgtgaaatgggaatgaggttcccaccagctttatctcatgggaaagcactggaggacttacccaggtggcaggagtaaggggcacaagttgtttttttgtggttttcttttgagacagagtttcgctgtgtcgtccaggccggaatacagtgatgtgatcttggctcactgcaacctccacatcctgggttcaagcgattctcctgtctcagcctccctcgtagctgggattagaggcacacaccaccacacccgactaagttttgtatttttagtagagacagggtttcgcctattgggcaggctggtcttgagctcctgacctcaggtaatctcccaccttggcctcccaaagtgctgggattacaggtgtgagccacagcacccggccacaagttctgtcataggaggctaagctgtttatgataaacactgggcaactgccttcggaacctcagtggggtgcctgggaaggctggctgagctcacagaggaaggccctgctcctagtgaacagatgctcccttctccccaactctccagttttaccttctgcagtgacgcctgcctcatgcagcacccaccagggaccctcctggcactgaggtcagccttgtccaggtcgctttgcatctgctgctgggacaggtccttctcgtggagcaccttgtcccgcagctgctcctccagctgggcctgcttctccagggctggctcgacccggctctctgccagccgcaggcctgtgctcattcccaggccggcctcctggacagctcccctcccagctgcagcgggtcccttgggaagagaacacaggatggggatgggatggggctcactcccaactacaaattaaaactagtctggggctgggtatggcggcccacacctataatcccagcactttgggaggccgaggcgggcagatcacctgaggtcaggagttcgagaccagcctggccaacatggtgaaaccccatctctaccaaaaatacaaaaaattagccaggtgtggtggtgcactcctgtattcccagctacttgggaggctgaggcaggagaattgcttgaacctaggaggaggaggttgcagtaagctgagatcatgccactgcactccagtctgggcgacacagccagactgcgtctcaaaaaaataaataaataaaaaataaataaaactacactgggctgggtgcggtggcatgcacctgcagtcccagctatgcgggaagctgaggcaggattgcttgagcccaggaatttgaggccagcatgggaaacatagtgagactccatctcaaaaactaaagaggaagaagaaaaaaacaacaaccctacactgggatgccatttgtccactatcagattgggaaaaaaaaaaagggacacataatacacaaagagaggctctggggcaacaggccttcccctacacagctggtgggagggtgagtacaatcacaatggagggcactgagggagatcttcgaaaactatgcaggcataggaccttccccaccggctcctcctctaagaatggatcctacagatataccccagcacagaggagatggcttgtggacaaggaggttcactgcagcattgctcatgtaagatatcctggtgacaacctaaatgtctatcaaaaggggactgctactaagtacatgatggtacatcctttaagtggagaactgtggccaagaaaaaccagtggagaagttcttcctggcctgatccagagccacctcccagttataactagtaggtgaaaaaagcatcttcaagaactgtgaagatgaaattttaccaggcgtatatacaaaaaagtgtgtgtgtgtgtgtgtgtgtgtgtgtgtgtgtgtgcgcgtgtgtgatctcatttgctcatataaaataaccctggaaggtcacttaagaaactgataggccaggcacggtggctcatgcctgtaatcccagcactgtgggagaccgaggcgggagggtcacctgaggtcaggagttcaagaccagcctggccaatatggcgaaatcccgcctctattaaaaatacaaaaattagccaggtgtggtggctcattcctgtaatcccagctacttgggaggcggaggtgggagaatcacttgaacccgggaggcagaggttgcagtgagccaagatcgtgccactgcactccagcctggagactcgcagcacagcgagactccatctcaaaaaaaaaaaaaagaaaaaagaaaaagaaactgacaatgcttcttacggtaacttggtggccaaaaaaaaaaaaaaagaaagaaaataattgtatatataaaaagaaaaagaagctgatgatgctgcttgcctccaaggaaggaatgggaatatctggggtcagaggtgggagggagccattttactgtgtacccttttgaaatgtgaataggtgacttcatcaaaagtaaaatataaaaatttgaaaggctacttacaaaatttttttttctttttgtttctttttcagatggagtctcgctctgttgcccaggctggagtgcactggtttgacctcggctcactgcaacgtccgcctctccggttcaagcgattctcctgcctcagcctcccgagtaactggaattacagatgtacgtcacaacacccagctaatttttgtatttttagaagagacggggattcaccatgctggccaggttggtcttgaactcctgacctcaggtgatccacccgcctcagcctcccaaagtgctgggattacaggcatgagccatgacgcctggccttaaaatacattaaaaattatttgtattttaaaaaattaaaatgtattttaaggccaggcgtggtggcccatttcttgagacatagcaagaccctgtctcaaaaaaaaaaaaaaaaattagctgggtatagtggtgaacacttatagtcccagctatttgggaggctgaggtgggaggatcacttgagcctgggaggtcaagcctaacatgagttgtgattgtgccactgcactccagcctgggcgacagagagagactggctcaaaaaaaaagtattttaagtccataatacaggttaaatcctttcctttcctttcctgaatgacctgtaccactggttatccaatagtaaggagggaaagtgcctcattatagaattctaattaatatacacaggagtgactaaatgagaagctcacagttttgcagcctctaatgagtgggttggatcttgaaaagagagacagctggcatagggacatcctgatggaagaacacattctacttatggagtcttgatcaaacgaaaaagcaagcagaagagcctgaatctgacctagctttacatccaacatccaatttacaggaaatacatgggataaagaaatatgttaattgacaccataaggatgcaaccagcaaaatccagaccatgagaatctccaaggacaactagcccagtttcctgaacaaataagttaaaaaggacttcaaagacaaagcatgggccgggcacggtggctcactcttgtaatcccagcactttgggagaccaaggtaggtggatcacctgaggtcaagaccagcctggccaacatggtgaagctcccatgtctactaaaaatacaaaagttagctgggcgtggtggcgcactcctgtaatcccagctactcaagaggctgaagccatagaattgctgaacccaggaggcagaggttgtagtgagccaagatcctgccactgcactccagcctgggcaacaaagcgagactccatctcaaacaaacaaacaaacaaacaaccaaacaaacaaacaaaacaaagcaaccattcgcactttgtgaatgtctatggatccggattcaaacaaattgtaaagaaaaaactaaagcaagactatctgtgactttttatttatttatttattttgagacagagtttcactctgtcacccaggctggagtgcagtggtgtgatctcgactcactgaaacctccgcctcctgggttcaagcgagtctggtgcctcagcctccccagtagctgggattacaggcatgtgtcaccacacctggataatttttgtatttttagtagagatgggggtttcaccatgttggccaggctggtcccgaactccagacctcagatgatctgcccgccttggcctcccgaagtattgggattataggtgtgagccactgcacctggcctatctgtggcatttatgagacatatggaaaatttagacgctggctatttgatgatattaagaaaagattattaaaccaggtgcagtttctcatgcctgtaatcccagcaccttgggaggccaaggcaggaggatcactggggcacaggaattctagacccgtctgggcaacaaagtgagaactcgactctacgagaaataaaaaaatcagcaagcctggtggcatggacccgtggtcccaactgcacaggacctgaggtaggaggattgcttcagaccaggaggccaaggctgcagtgagccataaagaaaagaaaagattactaactaaaagtaagtccttgatatcagccagatgacactaaatcccatccattcccctgagctcacaggggggctgcctagactccagaaaaaaggctgtgcctagtcctagactctggcatgcaggaggtcagaaggctgaattctccactaaactcaaaagtataaccagtccagactgggtgtggtggcccgtgcctgtaatcccagcactttgggaggccgaggcgggcagatcacctgaggtcaggagttcgggacgagcctggccacatggtgaaaccccatccctactaaaaacacaaaaattagctgggcgtggtggcacattcgtataatccccgctactcgggaggcagaggcaggagaatcgcttgaaccttggtggggcagaggttgtagtaagccgagatcgtgtcattgtacttcagcccgggcaacaagagtaagactctgtctcaaaaaaaaaaaaaaaaaaaaagtatgtggccgggtgcggtggctcacgcctgtaatcccagcactttgggaggctgaggcgggcagatcatgaggtcagtagttcaagaccagcctggccaacatggtgaaattgcgactctactaaaaatacaaaaagtagctgggcgtggtggcatgtgcctgtaataccagctacttgggaggcggaggcaggagaattgcttgaacctgggaggcggaggttgcagtgagccatgatcgcaccactgcactctagtctgggtgacagagcaagactccgtctcaaaaaaaaaaaaaaaaaaaaaaagtagccctctctaagtcttaattccttcatctgtaaaaacagaataatgacttatgttagagatgctgtgaagagcccagggaataacaagtgctgtctgcataccacataacctgtccgctctcaaaggtggctgggctgatgatgtctggaagaagaaggctgggagaaatgctggttcccaaagtggtcagtaccaaggccacctagtccaacccttgcccctaggcctgtggttcctttggggcagattccagtctcgccaccacccagccaggggagtctgtgttgaatgggccatgtcctggaagtatgaaaggctcagccctctgagctgctggatggctctgtcctgtacccgccagtccataaatggtcagcagagcacatggcccacctacccgagccaaaggagttgggaaaaatctgtctgggtggccccctcatcctctcaacacacaggcctagagggaaaagggtactgtctaatgccagtcagtgctgtcctgagctcagctgctaagaatagcagggagtgaggtggtggtaaccagcaggactcaggcagaacagaggcccattacacacctggctgcccacaggctgccaccacctgctcttccacctttcatgccagttcctaccctactcatccacacagacagaaagctctggaaggggacgaaggtggcacaaagcaccctgacaaagtagccactacccaggctcagggatcacatattcccccagtgtaagccactcccagccctgagctgtaggagcagagatgcacaaaggcccctccccactgctgctctgtcccaggccaaggccaggtggtggctatgcagtcggggtgctcagctagtagcatagaaggctaaagccaaccccatctctgaataccccagtggaccaaggataaaggagcctttctcaaaagcagttacaggccaagcatggtggctcacacctgtagtctcagcactttgggaggctgaggtgggagaatcacttgagcccaggggtttgagaccagcctgggtgccacagtaagaccctgcctcttaaaaaaaaaaaaaaatttagctgggtgctgtggcatgtgcttgtggtcccagctatgtgggaggctgaggtgggaggattccttgagcctggaactttgaggttgcagtgagctatgactgggacatagcgagaccctgcctcaaaagaaaacagttcttaacaagcccacacttggagtggctactcttgtacctgacccccaaagtcgtgtgcctgatcctgagagcagactgcacatatctgtgggcagtcggcctgagacagccaccactgagtgcctacagcacggcccatttggccaagaccagcaacttccctgacctttttggatctcctaggtcccagttcagggccctgaatccccacaaccactgactgacggccctaccacctgctgtctctcctggcggccacagcagcagcagcagcagcaggaccatctctggtatcacatgaggtagggatcagatggctctgagaacaggccaggactgagtatggggtgggggtgggcaggaactctctgcaagcaggcactttctgaccaccacaattgcttaaatagaacaggtaatgatgctgccttttggacctgcctaaagagcagaagtcgtaaaagacagaacagctaaggctgataagggggtgagagacagggacaaccgtgcctcactgcagggacggagaacctacttgatcctttgaagaagtaatctggcaacagtcttaaaagtgactgcagttcaaacactctagccacacgactccagccctgggcatcctcacagcattgtttacaaaggcaaaagtccttccaaactagggcacttgtatgggccacagcagaccccctggccctaaagatgctcagtaagatacattgataatgtggaaaaatactcacgggataacatttgataataaaaataggatgcaaacttctggaagtgagggacatgtccattaccttgatggtactgatggtttcacgggttttatctatatgttaacacttatcaaattgtacactttaagtgtgtgtagtttattgtatattaatcatagctcaataaaaatgttttaagaaaagaactgaaggtgacaaatttttttaaagttttctatacagcataatctgaactacatacattataagataaacagacatgaagttaaaaagcttctgcatagcaaagtaaacgatcaacaaagtgaagagacagcccacaaatgggagaaaatatttgtaaactacccatctgacaagggattaataaccagaatatataaagaacgcaaacaactatataggaaaaatactaatagttccatcaaaagatgggcaaaagatacgaacagacatttctcaaaagaagacatacaaatagcaaacaggcatatggaaaggtattcaacgtcactggtcatcagagaaatgcaaatcaaaactacaatgagatatcatctcaccccagttaaaatggcttttatccaaaagacaggcaacaacaaatgctggcgaggttgtggaacccctgtacgctgttagtggaaatgtaaattataatagtgcaatcactatcgagaacagtttggaggttcctgaaaaaactaaaaattgatcaggtgtggtggctcatgcctgtaatctcagcactttgggacgtcgaggtgggaggatgacctgaggctaggagttcgagaccagcctggccaacacagcgaaaccccatctgtactaaaaataccaaaattaactgggcgtggtggtgtgtgcctataatcccagctacacgggaggctgaggcaggagaattgctagaactcgggaggcagaggttgcagtgagccaagatcatgccactgcactccagcctgggcaacaagagcaaaactccttctcaaaaaaaaaaaaaaaaaaaaaaaaaaaaggccaggcacactggctcacgcctgtaatcccagcactttgggaggccgaggcgggtggatcacgagctcaggagatcaagaccatccttgctaacacggtgaaaccccgtctctactaaaaagacaaaaaattagctggacctggtggcgggcgcctgtagtcccagctacttgggaggctgaggcccaagaattgcgtgaacctgggaggcggagcttgcagtgagctgagattgcgcccctgcgctccagcctgtgcaacagagcaagactctgtctcaaaaaaaaaaaaattttttcaaaaagaaaaaactaaactaaaaattgagctaccatatgatccagcaatcccactgctgggtatatacctgaaagaagggaaatcagtatatcgaagagatatatacctcaaagaagggaaatcagtatatcgaagagatatctgcattcccatgtttgttgcagcactgttcacaatagccaagatttggaagcaatctaagtgtccatcaacagatgaataaataaagaaaacacggtacagatacacaacagagtactattcagccataaaaaagaatgagatcctgtaatttgcaacaacatggatggaactggaggtcattatgttaagtgaaatgagccaggcagaaaaagacaaacactgcatgttatcacttatttgtgagagctaaaaattaaaacaattgaactcatagaggcaaagtactggatggttaccacaggcttggaacggtagtgtagggcttgtggggagatggggatggctaatgcgtacaaaaaaatcgaattaataagacctgtctggtagcagaacagagtgactgtagtaaataataattgtacatttaaaaataactaaaagagtataactagattgtttataacacaaaagataaatgcttgaggggatggataccccatttaccatgatgtgattattacgcattgcatgcctgtgtcaaagtatctcatataccctataaatacatatacctgctacatacccacaaaaattaaaaattaaaaatgtaacacaaagaaagaaaacagaaaagaatcgcatttgaatagtcatgttaaaataacaagatagcaggtgcttttccttctttttttagagacagggtcttgctctgtcacccaggctagagtgcagtggcatgcagaggccagctcactgcagcctcaacctcctaggctcaagtgatcctcccacatcagcctccctaacagctgggactacaggtgcacaccaccatgcccaggtaatttctgtattttattgtagagatggggtctggccatgttgctcaggctggtcttgaactcctggactcaagcaatctacccaccttggcctcccaaagtgctgcgattacaggtgtgaaccactgtgcctggccctctaagtttctgctaaaatgtacttgtaacttttacactgactacactcaaaagtattaaacttgtaaagaaaaggccctggaggagtttgttctttacaaggtcagtcagaagctacaaggggccaggctggggccaaggtgagggcaggtacatgcaggggcagatgctgggtgtggagtaggtgccaggtgctagctgggcatgaatgtgcacccgctccctgacctctgctccctgactctcacaaggaactagcactgcctggagacaggaagaagcagcgtacggaaggcagactctctggccagagatctcgcagccaggagcacagtgagaacagagcctaagcctatctgtccagagcccaggctccctttccctacaactgcagcctccttattctgctctggcccagcagagtgaggaggggccgcccacccagccatacctgccggtggctgctgggggtgcatggtcagaagaggaaagatgcggttcaggtagtcattcagcagcttctcctgcacaatgcctgagccacaagtcagaagggagaaaagggccacacgatgagtgcagctcctggcccctgctggccccagagacttctggtcctaggccagccacaggtgcagcaaggcctgaggcctttgtcccttccttctcctcccaacaagaggagcctccttccttctctgccagcccttacctgtgaccctggatttctcagcatctgaggtcagcctacagctcttgcgggagaaagacacgccggcccccttggatgccatccttcgtctctcatgggcagccagtggtcctggaggctgaggcagacacagagcctgtctactcagggccagccaggggcccccacacctgacctcagtcctgccatggcaggaagtcttgggagcaggtgaggccaggggcatgcacactaacacataggacaggggaatgcaggggctcccagcttcctacacaggcagggtagccagggtctaggcccatgtaacagggaccacttcttgttctccagtgtccctgtgcccagcacagggctgggcagagagcaggtaccagatatatttttgccaaaccataacaaaatgtctcagctctgtggaaatcagaccaaaatgtccaaagtgaggtgtcctaggggcagagcccctgtattcatctcggttgtaagccatactgagtccagctcacaaccagaagcgacaatcctacacattcccccaagtgcagaccaccactggtctggtcatctctagccataagtcccacttactccccacaaggctggagcctctttcctcagccctgggttcctcccttcttttatccatggtcctgatagtttcactgttcccactcacacatgtggcctcccacctcatccaagcaccacccttgcccagccctcatggcaaactccattggtcctcctagtgcatctatccctcacatcatgttgctgctgcagctgctccaaaacctgcactgagtccctggtgctggcctcactgatgtgtagctgtgctgtccaacacagcagccgtcatccacgtgaggttacttaaatttaaagttttaaaaattaacaattcgatttctcagttgcctcagccacatttcaagagttcaatgaccacatgtggctaacggttactctattggacagcacaaaggtagaacattcccaccatcatataaagttctattagacagcgcaggtctagagtttcgctctgcagcactgccttagccagcactccctactctgccgttcagtctcttatctcgccccaaacagaccctctactcccgccacaaacccctgtgggtctgcaccacgcctgctcctcgggaaggtgattttcccgacctcgggccctcggtgggcctccatgatcggtgccccttcactaccacagtagttgaagatctgattaaatgcagtcattcatttgatgagcagaccttccagacacccactccgggtgtcagttgctgaggacccaggtgagaggcggaccttgtccccgcccggggactccctgtcacggctatcccgtccaacctcgccggggtatccgggctcagaactgaacctactccgtctgggagcccaaggatggctcccccaagtcgcccccgcctggccccaagctccagaggacctgccagaccagcttccgctcggagtttcgcactcagatcccggcgctgcaggtgccctcgcagtggactaaactggaccgcgaagggaatagccggaacccgccaggctcagagccctgccgcccctcactcaccccgagcctcggccgccgcgacccggttcacaacatccgcccaacctctcggctacggcgtccgttcagggccaaatcacgcgcacgctcgcgcgctgagcctccagccgcgcacgcgcaccggcccgcgcccagcctccgctaggggaccccctccgtggcttcccaccgggttgttccaggcctcagcttcgccgaaaggcctcaccacctccgacctccgcctgccccggggatgctcccagccctgctgcggcagaacgcgacgtgctaaccggaatccctaggccgcctgtctcctacccatacttggaggccccgctcagacggtcctgaaaacgtctgaaaggcggttcctgccagagtccctgctacctgttacctccacccctatttagtcctagtggacagcttcgctcaccttccctgggatgacacttctggcggctgagatgagcgagcctctctgggctctgccgccgggcgtgggctgacctgcctacagctggggcctgataaggcagcagcaaaagggtggaggggaggcagtgttgaagctggggcaagtaattttccccaatttacagggaaaaaccgaaattcagaaaagtttaatgtcagccaggggctggaacccagacctctggcagctgtcactttcacaatgcccttgggctgactaggctgcagaggggtttcaccccaaccccagggcacctcaagtggccccaccaaaccttcctaacacctgaccactaagtagggaggcctctcagggggctagctgtgctaggcccttgcaactgacctgtgggacctgaggcctggcccctcatggctcctgtcaccaggtctcaggtcagggtccagcaggccctgagctgacgtgcggagccagagccacccaatcccgtagggacaggtttcacaacttcccggatggggctgtggtgggtcacagtgcagcctccagccagaaggatggggtggctcccactcctgctgcttctgactcaatgcttaggggtccctggtgagtgcccccaaccttgatccccatctgccttcaggaggggcttggccccattctcctattctgggatgagaaaaaagtcagggagccagaggctcagtgggcatggggcagtgaccttggcctcttgagcacagctgggaagccctaggaacacatagacatggcccacttaggcctctattagcacgtctgctctagcactgaagcagtgttaggaccacacagatgcacgcacacagcaggcagtgacccctcctgagcctgatctacccctctaacctagcgtatgcctttgtgcaggtgagagcccagctttggagtctgaatgcctagccagggcccctggctgggtaatgtgatggctctgagccttagcattctcatttgagagatgagatggggcaagctccatcacccactgctctcacagagcgtgtgtgttagatctgagcccggtgcctgggccactacacagaggcaccggtgataactaccaagtctgggcctgcttcccaggggaaattttttgacaagtatctgtgcaggggggctagactggcccttgaaagtgcatacagggtccatcccagaagccttgtagctttgatcccctgaatgaacaaactgtggacatgccaatacacattactgacatgtatgcccacctgacctgcacccactctgcagggcagcgctcgccattgaatgacttctaggtgctccggggcacagagctacagcgccgctacaagcggtggtgcccgggccttggcaggaggatgtggcagatgctgaagagtgtgctggtcgctgtgggcccttaatggactgccggtgagtggccactgggcatagataagactgggggcaggggagcctgggccgtggcgttaccttgtgccttcttctctccagggcgttccactacaatgtgagcagccatggttgccaactgctgccatggactcaacactcaccccacacgaggctgcggcattctgggcgctgtgacctcttccaggagaaaggcgagtgggggtggagaggggcagggtgggagacaggggacctcagcccaagttgatcttctgtctcttgctcccagactacatacggacctgcatcatgaacaatggggttgggtaccggggcaccatggccacgaccgtgggtggcctgtcctgccaggcttggagccacaagttcccgaacgatcaccagtgggacaaacaccttccctccgtcccggcctgggaccttcccccagcacacactatagtgatgctctgggccctcaggtacatgcccacgctccggaatggcctggaagagaacttctgccgtaaccctgatggcgaccccggaggtccttggtgccacacaacagaccctgccgtgcgcttccagagctgcggcatcaaatcctgccgggtgggtaagcggcgccgggtcaagctgggagagtggagggacaagcccacgcccatccacgaacccactggctctttgtctccagccgcgtgtgtctggtgcaatggcgaggaataccgcggcgcggtagaccgcaccgagtcagggcgcgagtgccagcgctgggatcttcagcacccgcaccagcaccccttcgagccgggcaagtacgcgtaggcggtatcggcgccctgggggccgggctagggaaggtccaggactccaggggcagggctccgtgtagggcaactgggcggggccagataagccagagtcccagggtcttcttcacgccccattaccgcccccaggttcctcgaccaaggtctggacgacaactattgccggaatcctgacggctccgagcggccatggtgctacactacggatccgcagatcgagcgagaattctgtgacctcccccgctgcggtaggcggcggggaccaggcctgggagggtacctgggaaccttggggaggggcgtggcttggccggggaggtcagaggggctgggcgtgacctgagagcatatcccgtggagtaccgtacacctgggaaaggcgggtttggtcccagccccagagggatctcagctgtcgctcggggccggacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggggggcgggcgttgggacgtgctgctgcgggtgagacgggaggagggtagtcacgggcttagggctggaggctggcgggctagggctgagtgcagcgcctgcttagagaccttcgggagaacttctgccggaaccccgacggctcagaggcgccctggtgcttcacactgcggcccggcatgcgcgtgggcttttgctaccagatccggcgttgtacagacgacgtgcggccccagggtgaggcccaagcttgggggctacagagccggggctggaagcctggaaccggagggccggggcggggtctcggcctgatggctgcccgcaccggccgcagactgctaccacggcgcgggggagcagtaccgcggcacggtcagcaagacccgcaagggtgtccagtgccagcgcgggtccgctgagacgccgcacaagccgcagtgaatccctggtgctcccggccccgccagggccctaaccctggggcggcatgctttgatgtctgggaccagagcctggaaatggttgagactaccctgccacgacttcgctcccgctcccgcctcggttcacgtttacctccgaaccgcatgcacaactggaggagaacttctgccagacccagatggggatagccatgggccctggtgctacacgatggacccaaggaccccattcgactactgtgccctgcgacgctgcggtgagcactagtgacgcttgccccatgaccctgcctcagccctcaccaccaaaggctggctcccttaaccgcagtgaactttgtctttcagctgatgaccagccgccatcaatcctggacccccccaggttaggagttgggccagttatgggtcaggccctttagcccacgacatccacacagtctgggtttcatccagcccaccccatcctacagaccaggtgcagtttgagaagtgtggcaagagggtggatcggctggatcagcgttgttccaagctgcgcgtggctgggggccatccgggcaactcaccctggacagtcagcttgcggaattggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccctttccccaggcaagctaacaagtgagccttggggcaacggactgagagtcacaaatgacctagcagagcttctctcccagccatatgcctctcacgggctatgaggtatggttgggcaccctgttccagaacccacaacatggagagccaggcctacagcgggtcccagtagccaagatgctgtgtgggccctcaggctctcagcttgtcctgctcaagctggagaggtatgtggacaacctgggagggtgtgaggtggggctgagccttgtggcctcagaccctgagtgcccccattcttgctaaagatctgtgaccctgaaccagcgtgtggccctgatctgcctgccgcctgaatgatatgtggtgcctccagggaccaagtgtgagattgcaggccggggtgagaccaaaggtaagagcatagtgcacaggactgctggtggccaggaggcccagccctggatcttcctccaggaccgtctccttctccccattcccctcactgcaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgaggttggtggcagggccctgggccagccctggaagggtatggggggctagaaatgaactattttatcatgaagcaggctagtcatggctgtggcccagggccctcatcagttctcctacctgccagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaggactttcttaaatgaaaatggtttttccccctacaagtaaacagtaataaagaagagaattattcctagtgcagtttgttttcatggtcttaatttttgctaagactccactgcttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaggagctgtttttctcctttctttcccccggcaatatttactatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaaggggatgcctatcaattaattcatttagagagccatacaccccaagaaataaattatttgtcctctggagcttgtcacagggggatttttaaaaaaacattaaacagaaagacaactgtgcatcttagaaagataaaaggccaattcttcctctccggctgataggttcttaataatagtgatatctactaataagatgttttacatagtgtaaagcatgttcacatacaaattacttagcctctttgagcctcagttttcttatatgtaaagctggattaatagtacattttgtgtttaaaaagatgatgtatatgaagtgtttaccatttttcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggctctcagaaaatattctcagctattctgttagcttgatctcctaccatctgagagtgggcttccttcaaacaaccaaatttccaggtatttctaaactgcccttcccctacaccattctttgattcagtatttcaagacccctaagagaaatggtacatttacgtgtaagcacaggatagtgaagtatttacaacaagtgctttggagccagcaaatatggatcagaatgcagctttcctttcctacatacatgacattgggcagctaatttctaagattttacttctttgtctatgaaagtggagtactagtacttgctttgtgcaactctgatggttgttacatgaggtagcatctagaaacagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacgcaggattttctataaccctctttctgctttgagctcctaaaggtatttcatagaaaaatgaccttatttttaaatagagggggcagttgaaaatcagtgaacggacctaccccctaatgatttttttctcagacataattataataattagcattataaagtgctaattatctttggacacagaggacctgcacaccagagacagaggtccgcattaagtaaagtgaatttcactttcttcagttgtgagatttctcttttttcttctttgtaatgatgcaaagatatatcatccaccaagcctcatttaaaagctttttccagttaaggaaactatctcttggccatccacagccagactccatattgagattatggatattcaaagaaattgtctttcccttgtatattgtcataactttttgtgaaatgttcgttttatagttccaggccagcacctagaaccttgctagaataaaaaactgcagaaatcatgagtttctagtttggatgaaagagcacacctattaacaaatgatagacggctatcctactgtgagtcctgaaaactggtggtgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgtaaaaaaattagacgaggaatggggcattggtgtaagattatacagagtgtaaagttgggctttctcttatcatctgttgtcaacaacaggatgattgttactgttacccactccttaccatcattcacacagagacattggatattgaggagagactttaaaacagaatattagtaatgcagagctataaagagccacgatcatattaatacaatcctccatacacatagtgacctgtctgcagctccagcctagagaaacccagttattcatttgtagtgggcagccccattatcagaaagcgctattcaattggaagtgctcatctgtgttaggtcaaaaacgacttcctctaaatatccattctgtgtattgaagtataaatgagtcccacttaagaaaaaacaaaacaaaccaacttccaatgatttaaaaatactaacgtgaccctcttacgtttacctaaagctagtgtttctcaaacatcagctgtatcagaatccctgaaggacttgttaaaacaaattgctggtctctactctgagcttctgattcattaaatgtgggatggtacctgagaatctgcatttctaacacgttcccaggtgaccctgatgctgttgctctgagaaccactttgagatccacatctctaagctcatcagtctgtccgttacaccttacaagacatactttcctaatctgacacccttctatttgtctttttttggaatgctttagaaatttagcagttatcttttttatgtattttacatttgttacagctttccttggtggacagatatgagttttctacttgaaaataaacacgtttttctttaaaatatcattaaataagagtgtaattagtgatataaagcaagatgactaaaaagaatctctcattattatgtttgcacagcctgtatagaaattatttgaactagaaaggatttgctaagtaaattatttctatttccctcacttaatagtgaatattatggtgattaggggaaaaaataagctttcttttttcttttgagatggagtctcactctgtcacccaggctggagtgcagtggcgcgatgtcggctcactctgtcacccaggctggagtgcagtggcgccatctcggatcactaagccatctcggcctccccagctcaagtgattctactgcctcagactcccaagtagctggaattacaggtgtccgccaccatgcccagctaatttttgtatttttagtagagatcaccatgttggccaggctggtctcgaactcccgacctcaagtgatccgcctgtcttggcctcccaatgtgctgcgattacaggcatgagccaccacgcccagctaaaagaagcttttctgatagtaactttgttttcccattctggagtttatggcagtatgaaaaagactgaatttataagcagaagatctgtttttgaaatccggggacctgtatttcacaatggctttgatgtgttttgattgtgcacctttagacaacttatcagtttcctcatttttatacagcaataaaatagtaacagctacccattaaattctgtacagaagctagggacagacgcaataacacttgcatatctataaaggctttgtaaatgtgggtattatatctaatgtttatgcacatgctgtttgattattttcatttggaattccactccattaaaggaaaagtaacatacgaattcagattcttgtaagtcttcaggcatgaggcctccattgactaagtacattgcctacataatttctcctaacccaaatgaatctccagttaaaccaagctggtggttatgtactgtctccagaggatgccaagcataaagtccttgagtatattcatcttggatcctctgattggacaactgcggtattgagacttcaagttcccccttgaaggccccagacggtacctgtaattttactcaagttttaaatgtatgctctttgttaagaaagagtgacaatgatttgatttattttccgtgactggggttagggatgggggagactctaggaatgtgacttaccagtgaggttctagttttataaatcataggacaagttttgataggcaaatgttggactatagggctgaggttgttttccaccacaacatatagacttctactagcccttgaaggaaaaaacacgagaaaatcagttgggtcagctgagtattcctttacgagtatggaacagacttacataacaattctgcaggtaatggctctggaaaggtcaaccacttagttttggacaactcttttctattctgtataaccactttttcaccaaaatgatactaaataaatatgctataggaagctatattttgacatgactgttttaggcaaagatacactcaccaacttactccacaagagtttctaatcagagaatatcatatggatctatttgaattgctcccatgcttggctgagcccaaaataatttactgtgcatatgtacaccaagtgagaaggttgaggaggtgtcacttgtacatctctttattcttttttttttgtatgtgtgtgttattttcatgtgttttgaaaggctctcttgcttagcttttattttgccattaaagatttttttctgtgctataactgtatttttaagtctggtttgagttcaagaaatccacaaattcacaaaagattaggaataatttgtgaacaaaatgatgcagaaataaaaaatgcattttccaaataactcccttgcagtccttctcgcccaactaccactttctattaagtttcttcttcctactctatgaagtgccatgagctttcaattcattgtattttaagtataagctatacttactaaccttcacgttattctttgctacttaaataagcttgctttcatagttcaattgacgtattgtttaactgatatttttaattggtatattttgatatatattgataattgatagatacataattcatttgagatattttgggtatggagggttggaaggaatcctttcataatttttctacttaaaagaaatcttttttcatttaacagcttttcccatggggatagagttttcatgaataaagcaaagtcattaaatgaggtatatggtacatcttttaagagtcacagaaagaagcaacaacaatttacccaggcagagggtataagtttagaccttggttgcctgatttgtgggacaagttctttaattttttttctttatattttgacttttttttggactctctcctccccttccaggctccaggtcaaatacttgacacctgaatgatgttcaattatttaaaagatggattggccagctcagctcctgtctcagacagactgtctttaaatgtattttcaacatgtcttcagacagttatttttcctctgttcaattttgttcatcttcttacttaaccgttcaagtgctcctatttcctttttaaatgtagtattgagaagtgcaaacattattggaaaagagagtctcactagcataattgtgcattatcttcctcttatatcgccggcctccctgcacccccatgcccacctcctcctcgcgcctccatgccgcctcccactgctccagctccttgcagctgcgagtccagtcactggtcacctttcgtatctcctcactcagagcctggttggccaaacctgcctggtccagctgttctcagagcatggcattcacctgggccaggctggcactcctgaatggggcacaggggatcagtaggcgctcgcccagggggccatgctgccagccctggccctccctgctgctcctcctccagccagatgagggcactctccaggtcttggctgtgctctgcgtcctgggtggcacagaggttaaagcatcaggctgggcaggtggagggcagggcctgcctctgccccaccctggcacccaccctcagctgctgctgctccagctctccggatctctccaacagctgctccagctccgagaacctcttcttgtactggagaatctggggattgggagctgatggtgagccccaggggtgggggcagggcaaagtgaacacgtgggagggaaagagcaggaatgggtggccctgaccttgccctgcagccgctgcacaagctgggcctgccgctgctggccctccaggtaggcctgcagcttgcgccactaggaggcctgctcctcctgcagctgcctccgcaactccacgctctggagtaccagccccctgggctcttgcgtctccagctcaccagattgcagccacagagcctgctccagctgcagggaagggccctgggtgagagtcctgggcctcctgggaaggcaggctcaggcctctgtagggggtggcaggctgggcccagacccacaatgccttgtaggctgatagcctggcgccctggggagcagcacatgtgggcaagcccaggggcagtgcacgtgtgcatggggtgatgcagccatgcacgggcacgcagatggggcatgcatggacacatgcaggtgagcccacaaacccaaaccatgcaggcaaagctcaaaggtgcacctggggtctacgtcaggggcctcagtacaccatgcgcctctcctccagaacacttagccctgtcgtggtttctgtttattacattgatgcctgtgtcttcccaccatgcccccaccccagtgtgagctcagaaagcctggattttttgttcctcattgtatcttagtgctataatggtgtctgtggaatggcatggctcacgctcagtaaatatttcttgtgatggtgaattaatggcatgagctcatgggaatacattcaaacagaggtgtcaatccgcctatgcatatctgagcttaaaaatatgcacacacataacacatacaggcaacctcaaacatccccagggggacacgaaggactcccctcatatacacagcattaagatttgtaagaggtgcacacagatgttgccctatacggcgcctgcatattaatgcccacttctggctgggtgcagtggctcatgcctgtaatcccagcactttgggaggtcaaggcgggtggatcacttgaagtcaggggttcgagaccagcctggccaacgtgatgaaatcccgtctctactaaaaatcgaaaaattagccgggtgtggtggcatgcacctgtaatcccagttactcaggaggctgaggcaggagaatcacttgaacctgggaggcagaggttgaagtgagccgagatcgcaccactgcactccaccctgggcgacagagcaagactccatcttttatttatttatttatttatgtattcatttatttgtctcatgggctgagcgaggggaccccggctggtggagggacagctgcgccctgcaggccgctgcgtccgggcagaccccggcctcttgtcgtgcccccggcccgcgacaacccgggcaggatgggcagcaggacgcggcggggcatccgcggagcccgtcgggaacgctctcttggcctccggtgccgggcagcggtgggtgcggcacccacagtgcccacagcgcccccagccctgggacgtggctccagcccgcccccaggcaggcggcctccttcgccgggagcacgtcgcctgggcaacatggagaaacttcaactcttaaaaaaacaagacagccaccacaacaacaaaaagaacagatataagccggctgtggtgactcgtgcctctgctactccagaggctgaggtgggaggatcgattcaaccaagatacagtgagactgtctctcagagaaaaagtcaaacaaacaaaaaaagaggctgtgtaagaggtgactctggggacagtggaaaaacactaaggttttcaagtggtgttaaaagccactaggccttggggaccattgagcaatctacaaagcacggaagcctagatccctgagctctgcctgccaagtaccaccacagctaacatgggagacctccccgacagagactgaaatttgcctcccgaggaaacaagtgactacagacatctgtcccaggacagtaaacaagaaagcaaggtctcacaaaaacaaaaacagctgaccacagcatacaatcactgagaccgagcctgcgactataggtgaaaaaaaaaaatgctgtccattattcataccatgaaagaccaggggaaagtgggaacgcagtcccctactactgttgtgggaatcaggagaacagagagaccaatgggtggaacaggaggatttattgactgcactgaggcccagcagatgaaaatccaaaggctgagccccgaacaaagacagggcttaactttatagacacttctgaaagggggtcggctagtttgaatggcgcggcgggaatttgatggcatgaaactcgggggcaggcaagagggcttatagaagcagaacaaaggcagctaatcaaactgtcacaggtcttgcaatgcaagtatagctggtgaccttgcagctgcactgaagggaaatcaagaacttaacaaaacttgaataattagaaatgggaagggggaaagagaaggtagtaaaggcatttgttgttttttcctcttatctttgttggggcttactgtgttgagagagtctccggaactcactcctcgcggctctgacttttcagatcgtgttaccgaggatctactagggctctatctatggcaggtcttggagtcagccaagtacagggaacctgtcttttccttttaacttctgccttattactacaagttgtacagcacaccatgcctggttttcatcagcaatgtttcctgaggttacagaaagatttctaatcctgggaggaaacactcccttgaagcaaaagtgttctcccccaaaaaatgcaaggagctatcttctagatagccaggcagataattctcaggttttgccccacagaatctctatctaaaatacagcagtggtcatgcctagtgaaaagtttgagggaactcgcccagtgttgggtttcttcagagccatatatatagatataaccaaatatcctaaaagacactgcccttcatcattccatgctgttagacatttacaggaccatggatggtgatctcctccagacaaaaataaatgctggtgcagaataggtaagtgtattataatttgaggacatcagcttttgggcattttaaaccatgggtcagacatgttagagcaagaggccaggttgatagcaagagggagtgtttttcttttaatttgtcaatagcaaagtgatgtttgccactgtgatttcagagtgaggtggcaatttgttgttgtttggttttgtgggtttttgtttgtttgtttgtttgtttgtttttgagacaaggtctcactgtcacccaggctggagtgcagtggcatgatcagggtttactcctgccttgacctcatgaattcaagcaaacctccttactaatcctcccgagtagctgggattacaggcacgtgaccccacaccctggggtgtgaactgggatttgatgttttcagttggctctctaatggaataggttcccttactcttgtagaatcagattgtcttcatgattatcattcttgtgtgcattatatttctactaccctgctatttttttttctatttttcttttttctttttatttttttctttgtgagacagagtctcgctctgtctcccaggctgtattgcagtagcaggatctcagctcactgcaacctccacctcctgggttcaagcaattcttttgcttcagcctcctgagtagccacctggctaatttttgtatttttagtggagacagggtttcaccatgttggcaggctggtctcaatctcctgacctcaagtgattcacccgcctcagcctcccaaagtgctgggattacaggcatgaactaccacacctggctctcaaaccattttagttaagcaaagacagatttgtctggctttttagtacaatgctgaattatcctccaatctatatttttaggaaggacctcgggaatggcaacttggagatatttggtgaaaatgtgaacctttcatgttctgcttcagtccctttttgaaaatccttccaatttaccttttgcaaccagttagtggccttcccttcttcaccagcatgtgagttaattgataaagatcagaatatttgggctcaaaggtttcaacagttaagtcaaattttctgccaaagcctacaggatcttggagcctgctttagaaacagaagagtgaaatgtatttaagtttagatcagggaagtcctttataatattcttaattcacgttttggtgaagtggtatacacaacggtaggctcccctcttcctgtgggtttgggttttaccttgaaaggggctgtcagaacagaagtttcagggaagggaccagatccctggggactttccttaggtgatggtgatggaagaagaggcaaggcaggacaggaaggctcaggtaagaaagactatgcaggtgcaggggcaggaggagaaggagcagttggaggtgaaagagacaaagcctcctcaatatttctcaaatcagaaaacatgacagtctacctccttcagcttacttcctcaatggaggcaattttctcagttcttttagaaattttagaaatttagacatttctaggtctcattggaattaagtctcctatttaatttgtctggttcaaaaaccaaatttctctctctctctctgtttttttttttttttttttgagacagggtcacccagactggagtgcagtggtgtgatctcggcttactgcactcaccacttgctgcatgacagccaataagtcgagagttgaggtgtaggggcagggaaggtgactttattccagagagccaccaaactgaacagatggtgaagtaacatcctgaagaaccatcttaaattaatactattttccggctccttgtacattagggaagggaggaagaaggaggcgattgaggtgaagaggtctgacaatgacagacatgggctgcagtgagagcccaaggggatggtgaaaattgttggtcctttgtcaggtcacacttctcttataaatcttcagcataacactgttacttgtgtatacaacctctctatcttctcaggagttagtttggggaagggattattatcatctgtgctttaaagttaaactgtaagctaaatccctcccatagatagcttggcctatgtgcagaaataagaaaaagcagttagcctggaagatgtcaccacacggtaggaagggttaggagcaaaatgcagtcagtcatgctaggcctccttttcattgccatatatttaatgtatttgaacacgtaagtttaattttttatactttatttttatttatttatgatttttttgagacagagtctcactctgttgcccccccaggctggagtgcaatggcgtgatcttggctcactgcgacctctgcctcctgagttcaagcaattctcctgcctcagccttctgagtagctgggattacaggagccccccaccatgcccggctaatttttgtatttttagtagagacagggtttcaccatgttggccaggctggtctcaaactcctgacctcgggctcccaaagtgcttggactacaggcatgagccaccatgcccagcctaaccaagattattaaaccattctaatttgtcaaaagagtcacactgatttttaaaaaataatgtaatgggccaggtgcagtggcctatgcctgtaaccccagcgctttgggaagccatagcaggaggatcatgaggtcaggagttcaagacagcctgaccaacatggtgaaaccccgtgtctactaaaaatacaaaaattagccaagtgtggtggtgtgtgcctgtaatcccagctactcaggaggctgagacaggagaattgcttgaacccgggaagcagtggttgcagtgagccgagattgcaccactgcactctagcttaggcgacagagtgagactacatctcaaaataaataaataaataaataaatataataataatgtaatgaactttttcatgtctttatataaaaaatattacattatttaaattgttcaaaagcatcaaagattcctctctgctatcaacttcatttattttattgtaccaaactaccaggaccattaatttaatctacagctaaatctattattttttcatgttagaaattcaacaagaaaatttttccctaatgaaacctcacatttcaagcataaggagcctgggcgagttggctcacacctgtaatcccagcactttgggaggccgagacaggtgtatcacttgaggtcaggagtttgagactagcctggcaaacatgatgaaaccctgtctctactaaacatataaaaattagctgggcgtggtggcgtgtgcctataatcccagctactctggaggctgaggcagggaaatagcttcaacctgggaggcagagcttgcagtgagctgagatggcaccactgcactctagcctgggctacagagcaagactctgtctcaaaaataaataaatagataaataagcataagtagtaaaaaaataacataaatttaaaaataaggcacagggtcttgctctgttatccaggctagagtgcagtggggcaatcatagctgaccaacttggaacttctgggctcaggcaatcctcctggctcagcttgccttgtatttttttagagatgatgtcatgccctgttccccaggctggtctccaactgctggcctaaagcaatccttccgcctcagcctgttgagttgctgggagtacaggtgcaagacatgcagcctagcattgtagtaaaacaattttcaacaaattcttaattttctttccttttttttttttttttgagttgggagtctcattctgtcactcaggctggagggcagtggcacaatcatagttcactgcagcctgagattacagtcatgcattatcatgcccggccaactttaaaaaattagctaatacttaaaaatttgtagagacaggggtttcactgtgttgcccaggctggtctccaactcttaaagtgctgggactgtagctatgagccaccatacctggcttaattttcttattttaattttatataagtgagtattattgttcctaagataattggggcagtgactcctttacaattttagagatctaatttgtctattcacttcactgaaagagtatgccaatttgtttcatgagaaaatatcctatatttgaaaagaaggaaaattccttccaccaaactagggtgcattctaaagaaacgaattgttctaagtaacatcacttaaagtgcaaacagaggcaatggtatctattaacaatgtttatcagtgaaggaaataaactgaaaatatgaacatcattagatcctcggagggccttcattgctgaaaatctgagtaatattgtgatactcttttgagtctggcaggacattctctttccagggcatgtaacagtgggtgaataatttcttttcattcatttccattaagggctgaacttccttaatgttctggagattattaaatttgatttgtatagttgtgaaaagtactcatattgctgattccattgcttatatgtgatcatataaatcttttctctttctgtagtgtggtttaaacttaatccttaaagggcatgtatttgaatttttcagctggttagaaacctgaatataccaatcaaataaaactgctccttacatgctacagatttagttttcttcctgtactaagatgtcttttagatacagtaaattcgttaaagccaagagcccctaggaaatgaagttgggtgggaggggggacatcgagtagtaagatcactcttgtaacagagatgccactcttgcagatattgacaaaaattgggcctataaaatgtttaccaaacattggaaagacaagatctgaacaacttatcattgctgcagtctcaaatatcaggaaatgccattattctcaggacaataaatagacaataaagaagactcacagaccagattagctgtcatgtatcaccaaacagggactggatccttgttaacacgacccaacagagattgtccccagaaattcacttcataacctcaaaaccaaaaacccacactgatggcaaaaaataatgatgcaaagaatgagagagaaagagagagagagagagagagagagagagagagagagacctgtcctatagccatactcagtgggtaaaagccaaagagctcaatttctgctcatgatacttaatagaacatagggaacatgagccaatagctcaatgggttcagatctgcaccaagtgcctgttggacgcaggattctactgtctccaataatatgtctcagatgcactaattttttttctctttttgagacagagtcttactctgttgcccaggctgcggtgcaatggcgcgatctcggctcacagtaacctccacctcccgggttcaagcgattctcctgcctcagcctcccgagtagttgggattacagacacacaccactgcgcccggcaattattattattatcattattattattattgtgcgtgtgtatgtgtttttagtagagacggagttttgccatgttggtcaggctggtcttgaactcctgacctcagctgatcaaaagtaggtgaggtcagaaaacataccctgggagaggctggcacaatgcccagaaccgctatcgctaggcctggggttttcctctgtagtggaatactagtgttcatgtagtgcagggacaaaaccaattagatagttctgggagttaaaaagagatgatttacagtgccatttgagaaggggtattaaggaatttgccagggcactgatgcgtgtcaggtgtaaacctcaggttgagagagagctaagtattttctgtccatgaaggtgataagcgagggcctgaagaaagagggactggggaggacactggcaccagaaataggaaagggcttcttgggggtgggaaggatgggtcacggtgctatctataaagttggctggcagtggatgtaggatgtgggagtgagacatcaaacatgaagcagtcgcttaaagtctaaagaaacactagatatatgaactgcaggagatagtagggaaactggaccggctcctcataaaacttcccgccttctatctccgggaggatcgcagggcatttccgccaagacaggtgagactgcggttctgacctgcgggcctccatgcatatgcgctagggcacctgggggccggcagagccgttcccctacgcaaagtaagagtgttatgtctacaacccaacggggacactgagagccccaaaggccctgctttcttcccagagaacagcgcccatctgcataatttctacctggctctatgaggtgagaacacactccccgctagcacagaaatcctacaaactcctgtgggggctgcgcttggaagcagaggctgtgtaagaggtgacttggggggtagggaaaaacacgaagattttcacacagggtgagaacccaagagactggagaccacggaccaatccctgcaaaaagcagccagggtagaaatggaagagctgagcggacttcacgatagctaatttgtgttacaaagccgatacggctgatgctcgctttttctcctatggcgtgcaggccacatgttacttcttattccccaggcctccactgtaggattaacaactaagacacaaaccaatacgaaaaaagacatgacccttggcgtacggtctgtttttgaaactccagaaagtcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagatcttcgggctctgccccgacacagcctcatacgcctcactctttacacacacggtcacttgccccgcgcactcccgagccctttccagccctgacacacagctgggattctcacttccgatccgcggtcctgaacccgctcccagggcacgggaactccttcgtggcgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagccgccaaggggaagtgacgtctgcctctccctttttccctcccgcccctgcgtctgttctctcccaaagaagctggtccttagcctgtgttaaggagcaacctttcggtggccagatggagccggggcatccttcttcaaataatggcttttaattcgcagactagaatgtttcggattacaaaagaaaccggttctcttcacatccttatccttgtgatgcagcattccgcttgcaattggaagccgtttaatatcagagagaaaccatatttatgaaagtaaagaggctgcttagatgactgcaaaccagccgtccttactggttttatcactggtaatgttataaagacagttgtccagtttcatgaatcttgtaggtttttttttttttgatgttgttttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaatattccaattcttggttaaagaaacccatcaagatgaaaccccagaacccattattctctcttgggtatgcccaagctcccctttcttgagtgtgtactttttgctttgcaataaatctcttctttcactatctgctgactcatctttgactttgttctcacgatggtgtcaagagcctggacaccacggctggggtcgagatcccaccagtgtccagggacctcccccagcccaccagtatcagattctattccattgctcaaatcacaaaacatcgagtggagagttctccttggagatcataaagtaaagattctgtggcatggtggccagttaggccactggaagcatggcaaaatattgaaaatgagggattaggtgacagtgtagtaactgctgaatactaaatacttgatccaggccccattccctggagattgacagggagacacattgtccaggtagtagtggagaaatgttttctgggtatctgaccagcctttgtggaaagaactggcaccatcctgcagatgtaaccgcctgatgggttcttcctgaccaatgtacacaaaaactcaattcatggagaccatggcactgcaggaaacggtttcattgacacaggccagccacgacatgtgggagacagagttattactcaaagcaatctcactgaaggcttggaggtaaggggtttttcaaagatagtttggtggggagggggctagggcttgcgtggtgctgattgttggggatgaaatcacaggggcgtggaaaatggccctcctgcatggagtcagcttctgggtgggggctaagggactggttgattttcgggccagatggtgccttccagcagtcagaaatgcaaaagcctgaaaagacatctcaagaggccaatcttaggttctacaatagtgatgttcttcacagcagtaattggggaagctgccaatcttgtgacttctggaataatggctggtaattatttaacgaggcatacatcttagtagaaatcaggcccctttcatccttctaacttggtggcctttcattcattttacaggggtaatttagttttggggaaggttatcatttaaagcagcctttttggctgtcctcaacctttttgtcaccagggactggtttcatggaagacaatttttccatggaagggggtggtggatgttttccatatgaaactgttccacttcaggtcatcaggcatcagttacagtctcataaggagtgcgcaatctggatcacgcacatgagctgtatcaccactcagctctcactccagcctcaggtatcagcaagacctcaccaaagattactgtttaattgtctctgtgtgtgtttttgtttgtttcaggtaacaactaatgttggaattatgaaaagctcttctctacttttaacaaagcttagtcacaaacagttccccagttgatgagaaaaactaaaacaacagaacaattgaaagtccgaatctgcaagttcatctctgagaaccgaattttacagccactccagatttgtactccaaatggatagtttgattgtagaaatcacttcccttcagtctgccaatgtgataactgcccaagagaaagtgatgcctacattcgtagataatcccctttcccccatcctatatataactggagtcaacagtagctggaggaaaatggcaagaacttggaatcaagattaggttagaataacactgctgtagacagtttatcagctcttcagcatatgtccattttccttgaaggatgagcctttagaaacctctgacaataaagtttattttacatccattcccttgcctatgattttttcatacaaatcacaattataaaactttcttgctccagctaaaagcaagaaactcaatcatgaatgtgttcactaaatatataccacagaatgatagcaaccagtctgaatgcatcacttgattccaaaattaaatgttagccctcagtggtgcaactacatgtatctccaactctggaagccacaggcaacatattcctgtttccttgcagggaaacagatctataagcagggcggcagtctcacacatgtacattcctgggaaacccaaggaaacaatgatagtgacgcagggcaggcaagcccccaaactgaaagagttttgctaatgtcgcgattggctttctatgttatttgaagactgagatctccatgaggaatgaagacaggtaatgcctaaggctgaggcatgacctcactgggtcaccttagctgtgaagtgaggtcagttgtcaccttgcaaaccttttggtaatccaaatcttggaatgatttctttaagaatttagacacttccagtacttttcctgtccttgtggggaaagcttctatccacctggtgaaagtgtctataaatactagcaaatcttgtagttccctgtaaggtggcatctgggttaagtctgtctgccagtcttcaccatggtatgttccttggtgttgtacaggtttaagcagggatcggggtatggggtggcttcctgagtggtaaccctttttatagtttagaacagtcccttcccgaagaatatttaggaaactaatttgaatggaaaatcccgtcccaaatgtgaggaatcatgaaaatgtttaattatttcccatctgtcagcctcaggaatagagtttgttcttttgtagcaaccatccagaggggtctccctggaagccttttactcagtccctttaatttccttaggggtatagtatggtgtcactgacacggatgcagtacctggtagtagcgcagcagcttgaaataccagggtttccttagttgtggccttagctgctctttccaccagggaatttcctctaataataaaagtgtctcccttctggtgtcccctgcagtgagtaattgttatttctttgggagttggacagcatctaaaagttccaagatctgagtaaagtcgtatgggggatcccttggctcttgatagtcccctttccttccctatggctgcatgagcatggagcaccaggaacccatatttagagtcagtcaacacattgactcttgagggttcatcctccccgcaggcaactggagatgtattgtccccagagggtacaatagagaatcttccgtcacaagtcagcaaccagcatatgtgagtgacagcatgtgtcccactcagaaatgagagtgtattagtccgttttcatgctgctgacaaatacataacagagtccaggaccaaaaagaggtttaattggacttacatttccatatgactggggaggcctcagaatcatggcgggaggcaaaaggcacttcttacaaggcagcagcaagagaaaatgaggaagaagccaaagcagaaacccctgagaaacccatcagatagtgagacttactggctatcaggagaatagcacaggaaagacccgcccccatgattcaattacctcctcctaagtccctcccacaacacatgggaattctgggagatacaattcaagttgagatttgggtgagggcacggccaaaccatgtcagaaagggatgaagtgacagcatatcctgatgtgtgtgatggtttcatgagttattatctatttcaaaatttattgcaatgtgtggaaaagaacaaggacttgtactatctgactttaaggtttactataagctatcagacacaaggcatcaagagtgacaaacggataaacagcctgagttagaaaacctgaaattgatccacagctatacggtcaataaatgggttttcagtaaaagcagttcaataaaagaaaataaatcatttcaattaatgaacttctatatggatgtggggagaccaacaatgttattctccctcacgttacacacaaaagtaatttcagccgcattacacaccaaaacttaaaagttaaagatataaagcatttcaaggatactttgtgacttgttggcaggcaaagattagcctaccaacaagcaggacacagaaaaaatacatatataagaaagacatgataaatgagacttcatcaacattagccacaccttctcatcaaaagataccactaagaaagcgaaaaggcaagcaagccacagacagagagaaaatacccacaaaacgtatctgacctccacatcctgcaattataattatagtggtctggtacactgcacccagtttctgctggatggagtattttctgggtgtctctaatgagtaagagagggccccatgggatattccttcagttcccagatgaacagtgggaaagactccacattgaccaacctcgggggcctgaaaacccaggtcctcaaggagggtagagtatacctggaccctgacccagacccctggatgggctgtgccaagagacccagcaagggaagggatttcctcctgcctcaggttctctgttcttctgtggttagaccacctgaacccaactccctccccaagcactagagatgggcttttccaagggctggggatcttgctgtcctgaggacagctgagcaagggggtcgaggaggagcttgggttgtggaggagaggaaaccgggtaagatgcgtgaagcagttggctataccaggcacagagaggacccgctgggacccaagagcctgcatgtgaagccaggccttgggccaccttgtctgtcaagggggtgcctacttccatggtgtcttcaaagggactgtggaaagagaggccttcagcccacacctctgaatgcttttccaccacagcatgccctgtggcctttatcctgctggtgtggaacagtcagacccctgcagggctgcagagcctctgtactgggcggcatcccagcctgagtgccagagctcagagggcaggcccccgagcaagcagagaggagggcaccttttggacagaacgtgtgggacaagagcgatggctcatccgttcaggttcctcacaaaatgagagtcaggaagatcagggcgccggcctgatttcccaggcagggctgaaagcagacaaccggagggagagcagcacctgggccaatgaggtagaagacagaagaccacagtgtactcctgccctcaacctcaccccctcccacccacatcctccacactccctgaccaccttcctcagaagtgtaataggaatccagattccccctggcctggttgctgcaggaggcacagtagcctgatggagcctgaggcaggtgtgggaagatgtggattgtctaactggaggttgggagtccagggtgtagaagcagcttggagtgcaggatttggtggtacgtgtgtggcagtaggcaaaagaaagagacaactggccgggcgcggtggctcacgcctgtaatcccaacactttgggagaccgaggcgggcggatcacgaggtcagatgaagaccacggtaaaacctcgtctctactaaaaatacaaaaaagtagccgggcgtggtggcgggtgcctgtagtcccagctactggggaggcagaggcaggagaatggcgtgaacccgggaggcggagcttgcagtgatctgagatcgcgccactgcactccagccactgcactccagcctgggtgacagagcaagactctgactcaaaaaaaaaaaaagaaaagaaaagaaaagaaaagaaaagaaagagacaactgagccacttgaaataccaagagaattcaaatttagaaaattcccagggaactatgcgtgcaggcactcaccagatccacaaaacagctgctgcataactgcatgttgcaagcaagccctaaattgctgattttgaaacagcctgatgggttcacaaagacaatttctgaatagtcgtaagagcagaggtgcactaaagccactgtgccccgcaggcccggatcccagtaagttctttaaggagtaagtcttacttccatttatggaagatttttggagttgtccttggtcacccccaggaatgttttggttaggagtagaattttagatgtcatcaatttaaaaattaaaactaaaacgctggaactcatagagagataaaattaagagaatacattcactatcctgagtagaaagatttcttatagaacataacaggctttaaaaataaagaaaaaaggccgggcgcggtggctcacgcctgtaatcccagcactttgggaggccgaggcgggtggatcctgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaagaaaaaatatggcaaaatttcatctaattaaatgctttgagaactaaaattaaaatccaaagccactggacagactgcttcttggccaaggagaccccagagaagtcttaaatactgagttcctgcccagtagttggaatctcagacacctctccttatactctctccctttgtggtttagacacaactgaccagcattattgttaaaatagagatcctaagactgacagaacagactccttgcagtaggaagatacggtatgataaacgagacctaaggccacgccaggcaaggtggagtcatgcgcccctcaacttaaagaataaactatgttctaattgccacaggtctttttcttcttcctttttttctctagctaaacaagcactggccttgagataagcaatgctgaagcacttgcagctcacccattaccataaactgactgagccctccctacacaagccataactacagctttgattggacaagagactgatttcagtaacttccccttgataagagagcactggctgtggacgggttctggacggtttacagaggctgtgcacttgactgcctttgtgtccctgcttccccttttgaagcatagggcctaattataatgtatttaaatgttgtctccaccccaaagtgaacatgggttgcatgtaacaggcatgtttactcagcatgcatgcagcaggatcccttcatgaatattcagagctcctcctattccctgttgaatatgtatatgtggcccaccacatcaacataaatccctgttcccccctcccctccctggaaacgtacttttcaggtttcagcagcaagagggtatgcctccctgtctgtcagaatggccaccttgcaggctgtaaccctttataaaaaataaaatctcccttctaaatttataaattgtgtgatttttcagttgacagctttcagtcagacttttcactgactgggaaaagtcatttgcaatatatttattttaaaaatgactcctcaggatacaaaattcttgtgcaaaaatcacaagcattcttatacaccaataacagacaaacagagagccaaatcattagtgaactcccattcacaattgcttcaaagagaataaaatacctaggaatccaacttacaagggatgtgaaggacctcttcaaggagaactacaaaacactgctcaacaaaataaaagaggatacaaacaaatggaagaacattccacgctcatgggtaggaagaatcactatcgtgaaaatggtcatactgcccaaggtaatttatagattccctgccatccccatcaagctaccaatgactttcttcacagaattggaaaaaactactttaaagttcatatggaaccaaaagagagcccgcatcgccatgtcaatcctaagccaaaagaacaaagctggaggcatcacgctacctgacttcaaatgatactacaaggctacagtaaccaaaacagcatggtactggtaccaaaacagagatatagaccaatggaggagaacagagccctcagaaataatgccacacatctacaactatctgatctttgacaaacctgacaaaaacaagaaatggggaaaggattccttatttaataaatggtgctgggaaaactggctagccatatgttgaaagctgaaactggatccctgttctcattgcttgcacctgggagacacaggttgcagtgaactgagattgagccatggcactccagcctgggtgacagaacgagactacatctcaataataataataatagtaataatttactgttctcataaaaattagcggatggggaatggaggcaagccggtgcaaaccatgacaactagtttagattttattgtcaactcatgaaaaactcgttctcattttgtgtttttaaaaaattccactgatacagccgttttctctaccgaaaaagactataaccgcattatttcatcactggaagctacagacagagggcccttgagaggcggcatcttcacctacgggaatgtttcctgctcaattgtgagacaaagagcatgtccaagttttcctataggccaggccgccccctagtttctgcgctgtgggctaaactccagaagctggcgcccttcagggccagaggtttcctgtgctctctggaggctgctaggattaaaggcaaagcaaacgacaggtctattagccacagttgcaggatagaaaacactactgtgactcagattagaacagaggttgtggcaaccacaactacaagtattaaccactacacgaccacaaagtctgctgacaaccattgcacttcttctatttttttaatgtaaaaacactcacactattttatctggtttattctaggacgtccgcagatttttgtgcttttctgtctttcatgtgcttctccctttctctccccattctgctacataatttaaaaaaaatctcttctctcaggatccagccactgcctctacaacaagcctcctgggaggtctctttgtcccattgacatctctgccttctttcgctgcttttttttttttttttttttttgacggagtctcgctctgtcgcccaggtggagtgcagtagcgcgatcttggctcactgcaacctttgcctcctgggttcaagcgattctcctgcctcagcgtcccaagtatagcgtcccaagaatagcaggtgcatgccaccacattcggctaatttttgtatttttagtagagatgggatttttccatgttagccaggctggtcttgaactcttgacctcaagcgatccatccgccttggcctcacaaaatgctgggattacaggcgtgtgccaacgtgcccggccaaatttcaggccaacacctgttgacacacattgccagacacacggaatccctcgcggaacaccgatgggcccacaaaacacgcgggggctgcggtcgctgatgatgtgagcaaattcgattcacggtgtctggggtacagccctgagggttcactggccacctctgcgcaaggaccagtctccgccgctcccctcatctccacgcagattcttgcccacacacctcccctttctttgggccgatgacaactcttggacctctgaggtgactgtcctgcccgcagcttctctccttccaagagtgtcatttcttgatcctctccatagtggctcaacggtaagcccaaggtccagcacgcgaatcaggaaactgatggttctttgggtttgcagggatccttccagtgaataaatgaaagtaacaggtaccagtatcaaaactgcagtgactcaccagagacacttcatgcttgccagcttgctaagctgtttgagtccaacaactgcatggggtcctgggttagtctcctgccgctactttggtgagtgttgttgtcactttaccttgtggtggccaagcccctaaatgcactcttgggttatgcagtataattttcagcgtaaaagacaagtaaagagccatagcgaagtgaaaaacaaccacgtgcagtggccgggaattgaacccgggtctcccgcatgggaggcgagaattctaccactaaaccaccaacgcctctctggaactaccccctggaggataacagaaaagagtaaccacaaagatttagaaactgttctaagcggttttttcaagtgtcgactaaaagctaacaaagacatccaaaccaaatgtgtttttataggaaacttttattagacaacgttataaatatcaaaatagctcatttgtcggatcaaactcttaactctgaaaaaggtctttctacctgcattacaaacccctataataaaacatcagaaattcattcatgtttcttttttctaatcctaaatcttccatcatcaacctcaaactgctgccttagaggttctgagaaggtaacctaactggtagtttaggtaagtaaagttcaaatccagggaggaaataagaagcagaagcagaattagaagaaagacgaaataaaaggacagaaccacggtagagataatgaagaaacaaaggttggtccactaagttagtcttttgtcgttggttttttttggcaaaagagtaatgatcggtctcgtaatcattataatactattatttgtctgcttgaagatgtataaagcatttgaaggaaatgtgatgtgaaaagatgaagaacgcttgccgtcaatgtttcattgtttgggagaatcccatttcctaagttaatatgctttgatgtgttagctatgtaagcagtagactagtttaaggaaatattgacggtcaaatattaacatattagtcttttgatgaagttcaaatattagagagatttctttcctcaattttcaatggagacattcaactgaagagacaaatccagagttttctccacatgttgggtctgggagtcattatgactttttcaaagacaggagctgtgacatggaatcatgcttcttctcaagctgagaagccaagctaggtccaggctgagtcataaacttgagcccaccaaggaaatcatccttcacattgacctcgcagagctttggctgttctctgttctttgcccaacacccaagacacacaccagctctggccaacaaaccttaacatatgatctatatcaaccaaagctacatttattcccaaatctccttctaaaatacaaacctgtactttctactctcaacttctaaatctaccaaggcctcatatgcatctgagtcacagatgctaaaacttaaccggttttctgaggattatttgaggaaggggtatgcatgcaaatgtatatacataattcatgtgatttaggaatatggactctatgacttccagatgcagatttagaacctttttaaaaaatattttgtttttgttgtcttgcaaatcagccagatctgcaacttaccagagtaaagccaaaccaagcgggacccttaggaaatgcgctaagatgtcatccactttcagtgtcagcctgtgaaaattcaggcgacagaagagaataaagagaatcttaaggaatttctggaaccaaagctaatattaagcaggcctcttgctggcagaccagtggaaattgtacctggtcaacaatctgtctagattgaggaggtctaaaatgtagccacaggttcaaatacttttctgtttgtttcccaacctcgattaaactcacaaaatttagggaccaaaaaaacaaacaaacaaacaaaaaaaaaaacaaaccacgacgttcccacccagtctcgaatcagggacttttctcgtgtgaggcgaacatgataaccactacaccacagaaactgcatatgcaccaaaaaaggcaaaatatcatcatgaaaatcttagatcagccatttctattatcgtttccaaagtaagaaattcaactgcatttcgaaattcgactgaaaaaagcccaataagcaccagccatcaagaagactatggctcccaataggcccaggcttagcgttccgcgcccacccccaacacgaaaaccatggggacccacacccgggcttcggggacacatacccgggcttcgggctcccgcatcctcccctgggtatgcagttccagaactaagcgccgtgtgcgggatcctcccggctgacactcttcggctcccagaagctgcaggagccggcgggctttgagcctccgagccctgggcgccccgtgcctctcaggagggtggacgccgcccttccagggatgcggaccccgcctcggggccttttccccggcgccggccgtcggggctcttggctcttctcgtcctcccaggaaccgtagaaccctccttgccctccctcccgtaggccgaggggcgtgagctgcgcctgtttcctcacggaccctttggcctcagcgcctcgatgtcttgcaattcttagctcacggctcttcctcctataacaaggcccttccatgtcatgtcccctactccctcttagcaccagagagatgtctcccctgccccacaggtcacattccatgagtggtgaagtttctagagttgtaaccatggcatctccagccctgtgtgttcctctccatgctccccattgagcagtcttgatcctatattagccccaggaaatgaaatagaaacaggaccctacgttaaaaagttgcagtggagatgtggtggccaccaggggctggaactgtggggtgactgagagtatccaaagccctgtggccaacttactggtgctgagtgtgctggtgagcctctctgtcagctggcttccccgggccagttgctcccggaagctctgtcccaggtagtagtcaatgtcattgctccttaggagatcctcaaaagattttactgtatcttttgcatgctgggtgagaagataacaaacacctctcccttctcgtattttttgccgtaggtaagacagttcccgggcctgatcctgaatcagggaatcatatttcctaatgcaggacagaagaggaaagggtggatgataagttatgggggcttctgtagagatttctatgagaacatctctaaggaactcccccaaactgaattctggcacataagccataggaggcatttaacagcaaattctaccctgataaagtatcgcactaaaaattttagtatgggccgggcgtggtggctcatgcctgtaatcccagcactttgggaggctgaggcaggcagatcataggtcaagagttcgtgacaagcctggccaatatggtgaaacccctcctctactaaaaacacacacaaaaattagctgggcatggtggcacatgcctgtaatcccagctacttgggaggctgagggaggagaattgcttgaacctgggaggtagaggttgcagtgagccgagatggcaccactgcactccagcctgggtgacagagtgagactctgtatcaaaacaaaacaaaacaaaaatttaccatgccactgttcttcaactgttatatatatgttaattatatgtccctagataaattttttgggagctgggcctccagctgggatactctctggaggagactcttcaggtcctttttggcctgaagtcctggagagtagaaagccccagtgccatcagacagccacaactcatcctcatcagtgacactatgaggtgaagacccctccagggtgtcaggagctctcagcttccagggtctttccagactagatgaataatcacttgtaaccaagagggactggacccggttcttgaggttttgaatgaccttgttggcattctgcagctgggccttcagatctttgatgtcctttcataggacccagatgttttctgactttccatatacccagaactcttcctgcctccctagttcattctccaagggcttcctctcagaggaactagccagcgttcagccccggcgcccctgctcagagcacagcccctccaccaggaccatttccttgcggctgctgtgctcctcatgctctgaaaaaagacaaagatgtcttcctaaataaaagttggatgtgctgttgtggccactgcctttgagaggaggcaggtttggtcatgaggacaataattactagggaataaggtgaagtcgtactttattcaaccctgacactgtactaggcattcaaatacagtatttcttatcctccttatacccacaagttaggtttcaccactttctattttactgactggggaaaccaaaacttaaagagaggtggtaaaccagcttgttctagatcactcaaactagcacatggcagagcctgaattcaaatcctccaacgtcctgtgttcattccacacacactgatgtttctcaagccattaacatggccttatctagttaggatagccacaagaacgcaggacaagctatttctgcatgctgcaagtttaatgctctctaaagtttactataatttaaaagtttattgggttaccactgtgtgaaaaataggcataggaaaataagacttcgaataaatatatcagcatgttaacatcagtgtattggggcagtggtagtcagaatgagaactaatccacagcattttacctgatgccagacactgttctaaagcattttataagaatttactcatttaattcacattagtatctgatggggtaggtagttcctttattactattttaacatatgaagaaactggggcataggaaagtttacaaattgggatttgaagcaacaagtctggccccaggatcttttctcttaactgccacactacacttcctcaagaatgagagagactgtgtttttcttctcttctggttttctttttttttttttttagtttgtaagcaaacatttatagccatgattccacagatgtggtaagtaaaccaacagccattcctaaataaaatacaagaatttccatcatgcatagtttacaggcttggtaagaagcagtctctttaggggctagatgcttaagaaatattcaacaaacaatgaaatcttggcttttttttttttttttacacaaatgtttggttatttagccacattagtgataaaacatattcatattctaactgcaagtggaataaacattgcaacaaaaatgcaacccaatcaaaatcattagtaataactattactccctcttagcagtaagaaccattattcttggatttcaaacattttattttctgtgcatagcttatagcactgtattataggaatcagagtgtataagcaaaaaaatgaaataaaacttcttgaagaccatttccattatttatgattaaatcaatgaaactatacaatttccacattaaatacaaattagtaaaagaattcctccaagtagtattgcatataagctacaactttaccccaactattttaatcactatgattcgagatttcctaggatttaacagcccaagattgggctgttactacctcagcaagaacaatcaccagtaaatacatgaactggggttatagctgaatttttagaaactctccagacaaaccacgtgttagaggaggtaagtagaaaaactaatgtttgagctgtgctattcctaccaggaactatgtcaaatatgcaaagttcaaacattcttagtaaaataatatgaaaggatctatatatactgtaaatttagcaaaaacacttttatgtacagaagcctaaatatcttaggaggtttagaataccaatgaagagaattgttaattcttcaaggctggtttcttatgaggattaaaaaccagcccttagtctcagatgcattccacctagatgtgttcacgaactccatagagtaagaaatataaaccatgaatatgtactcttaatttccattcttcaacttaatgttctatagtacttcagatttttaaatccagagtttggtgtacacttaggaaattatagtaagagtagattagagaagatttgcttgttttccttttgaagccatgtgaaggtttattaccctgtgtattttcatcactgaaaagttccccggtgactaataaaataaaagtgtcacaagctacatgatggatctcttcttttaatgttgcatacagtttcagtttggctagtgagggctaactagctcagccctagtttcattttattagagttgaccactaaaaactaaataaggaagttaccagtaaagctaattcccaatacaagcaaaaaacaaaaacaaaaaacaaaaacaaaaccattcgcataataaaatatatccttaacacaaaataagggtataacatattctgcagcatgacattttattttatttctcagctgtagctttttcattcagaaattggagaccatcttttcactgagttgttattccttcctcttcccttagcttagggatatgttgaaaaaggcttttcaacaagtattttattttttacaagttgctatgaaattaaaatttatatatatatcttaagtgtttataaagcactcaaaattgtagcttacatgtatatgacttctgaaaataaaaatcacacttctaacataatctttctgctctgcaaaaatattctacatacatgcatatgatcaaaacaatcttttcatgtttggggtatttcttacacatagtaaaagaaaagtcaacaattatatcagtacttcccctgttaagataactgagtgccacctagtgttcaatttctgcaactactaagcttacaaattcaatactgctattaaaacccaggttctgaaaacggcattttggaaatcttttttttttttttttatgtttacggtggcaaaatacgactatgaaaagaacatgatatcaaaatcagtataaaaatagccacaggctacttaaatatgacaaacagacttattttttttcttcaaatgcagacttctgcctccctcaaattgtatcaaaatctcaagggaatatctaggtaactggaatatacacaatgactctatacaatcaagaggccagggcttaatcagattccgtgaggacaaggcaaatgatttcttcaaaacacccattttcttactggaagtggtaggaaaagcagcaatgcatggttttttttttttttttttttgtaattagtagacatggtcttctacccataagctccattacattaaaagaacaaagtgggcttaacatctcacttaagataattcagcattattatcagttttaaaaaaaccaaaaatatcttagaaacaaatcagtctgctttaacaaattgcattcatgctaatgaaattttaatcttctttgtcatgatcaaaatccaaattgtaggacaatcttcagaaaagatggaatgtaaaatgttgagttcaatttagatgtcatcaatatcttcatcatcatctccaatgtcatcaaactgaatttcatcatcatctccaggaccaaatgtatcagtttcattgattttagcatgctctggaagctcgccgtatgcctgcagacttctagcttcgtctgcattgtattttaaaattacatcagctttgttatcctggtagtctcggagaccaaccaaaataatgtccgaggtatttatccaaaccttttttctcaattttcctctgatgtgacataacctctttacaccatcgaaacacattgcttctagccgtccatttcccaacattttgattacctgagcatactcctgaccatcctctttgaataccagttctcttttttcagattcattctcattcttacccctgcgtctatttttacctcctttacctttattcttgggcatggcggtggcggcgacctcgcggcgtctctgacttctttccgggtagcggcgaccgcggcggctgctgctccgaggggcgacacgagggagcgcgcgggaccaagtaggtgctggaggccaggcaacgtgcgcgggagaggctggcgacccagctcttcggagatccgcctgcgtccacgctcggcggcagcaaaatgctcttctggttttcaatgtggtgggtggccctatggttgtagtccttttataatgcaaaacaaaattatttttaacttacggtttgcatgtttccaaaacctcatgtggtctctaagtaggccttagtatttctataataatcagttggctagaactttatattattattattattattattattattattattattagcagtgtgccacaaactaattgtagaaattcaaacttatacgcagcctcattttgggtaagagttctcctattaacctcctgtcctcctcttccccactacttgtcaggtgtggaattggccaacagcacccaaatgtgatagctgactccagggagggaaggtgagccccacaccctgtgctcttaccgggactggtggtttcctcctgttcagcctcattcttgctttggccacaagtctcatagcccaggtcctggaggtccacctggacctgtttactgtcctgcttcagcaagggttcacctgcgtgggaagagacagcaggtgttacagaatgtctgaatttcccacatatgccctcagcctcaatggcacataccctaaccttgtggggcagggagggcagatccacagtgcgagagaagcttctttgaactggtgggagaagagaccaccagctccaggaagcagaatttctttccacaggaggagcctgcatttgccattgataatctccccttcagataacctaggccttagttgggacaaggtatctgtaagtcagggattgtgtactctcatctctagcagccccattgaagctggcaagtgctttatcagcaggggttcaataaatgttgaatggagctgaactaatttagagtcccaagacacctagacctgcactgtccaataaggtagttagtagccacatatggccactttatactaaattaactaaaattaaataaaaccaaatgtccaagttgcactagccacacttcatgtgctcaataaccacgttatgtctgtatagaacatacagagcttataagacgtacaggctagttctttactagtaagtcatagttacctactaagtataactctgtatttctccagctcgttcgcctgagcaaagacagtggcttctgatagcagcagcttctcctggagatcttgatagcgttgtttgcattgtgacagctgggagcgcaggtgctgggtggaccctggtgggctaaacgctgattgggcccagtgtcacaaggctgggactggttctccaactgtgaaaggggccaagacaaggatcaggacagtccgaggccacccccatgcagtgatgaccacggcccgttgtgaaccccgtggactttactcaagtctgtcacagcacttctcatgccatttggcagtgacttgctttccagatggagctcctggagtgctgggataatgttttcttcatatctgtatccacagcacacagcacagcgccaatcaagtctacagaggagctcttaggaaacgttttctcagtggtcaaaaagagaaggggtggaaccctccactcatctcccctcacattctgtgccatcgattctctcagaatcccctgtattccccattttactgaatcttcagcatggctcctcccctaaacaggatcccaataacccatctgaggtccaggaacagacacctgtgatgagctgtgaccaaaaaaaaaaaaaaaaatggcattgataaggaagggatgtcattacatactacttgtctgggctgcctcataacctgatgcatccctatgttacagcagttaccccctcctattaaaattacctgtttatgtgccatctttccttaccatattaagtatctcaagggcagccattggttttattgccccatgccaatgcctagtgtgttatctgaaaaattaagtactcaagaaatatttatattgtaaaaggctttctaaaggctgaatgtaggctgaatattattactgttgtttgtggtacaaagagacctttctcttggtacctcttgattcacatgggagaacgttttaaagtaaacactgtcatctcgagcccttctccagtggtttttcattccatctaagcctacattgacttggtgggcatccactgtgaaggtagccccaaggtcaaggctctggggtctggggcaaggcctcacagtcacattcccctcctcttggtgttggtgcttcccaggagaaccaaccagttctgtgtttattctgtcgatggtgctggtcagatgcacaaggagctctggagtaagtttactattcccttctttgctactcagcacaagttgttcttgaggaggttgatgatattgtgggcattcttcagttttccctggagctttctgaactcagcctgaagactactctcactcagaccctctttggcaaccacagtctcaaccaccaccttgcccttctccttgtcttcctcaatctcccatccctcagacatttctgctctttcagctctgcattctcaaggcaaagatgggttctgggtctccacagttgccagacttttctccaaagccaccttgaggaactaaaagaaaatcatgctttgaagaagttaggccattaaagagggcccaagagaaacatgagattgcaaaggtagtttttgatgagaacaaaaacaaacaaaaaaagcagatctaaaatgaactccctacccagaacctccttagtcaggcaataagagcaataagatctcaagactaagttttattattattattattattattattattattattattattatttgagacagggtctcgctctgttgccggggtggagcgcagtggtgagatcatggctcactgcagccacgacctcctgggctcacgtaatcctcccacctcagcctcccaagtagctggaaccacaggtgtgtgccactacacccagctaatttttttttttttaatcgagacggagtctcgctctgtcacccaggctggagtgcagtggcacgatctcggctcactgcaacctctgcctcccaggttcaagcgattttcctgcctcagccttctgagtagctgggattataggagcgtgccaccatgcccagctaatttttgtatttttagtagagacggggtttcaccatgttggtcaggctggtcttgaactcctgacctcaggtgatcattctgcctcagcctcccaaagtgctgggattacaggcgtgagccactgagcccggcccacccagctaatttttttttttttgaaatggagtctcactctgttgcccaggctggagtacaaaatggcgtgatcccggctaactgcaacctccgcttcccagattcaagtgattctcctgcctcagcctcccgagtagctgggattacaggcatgtgccatcacacccacctaatttttatatttttagtagagacggggtttcaccatgttggccaggctggtcttgaactcctgacctcaggtgatctacgcgcttcagcctcccaaagtgctgggattacaggtatgatccactgtgtgcagccccgtgcagctaattaaaaaaaattttttttcgtaggcctggtgtgaaggctcatgcctgtaatcccagcactttgggaggctgaggcgggtggatcacctgaggtcaggagttcgagaccagcatgaccaacatggcaaaacccggcctctactaaaaatacaaaaattagccaggcgtggtggcaggcgcctgtaatcccaactacctgggaggctgaggcaggagaatcacttgaacccaggaggtagaggttgcagtgagccaagattgtgccattgcactccagcctgggcaacaagagcaaaactctgtctcaaaaaaaaaaaaaaaaaggccaggcttgatggctcatgcctataatcccacaactttgggaggccgaggcgggtggatcacttcaggtcaggagtttgagaccagtttggccaacatggtgaaacccatctctactaaaaatacaaaattagctgggtgcggtggcacatgcttgtaatcccagctacttgggaggctgaggcaggagaatcacttgaacccaggaggcagaggttgcatgagcccagatcgccactgcactccagactgggtgacaagagtgaaaccccatctcaaaaaaagaaaaaaaaaattttttttttttttcagaatgaggtctcactgcattgcccaggctggtctcaaacttctggactcaagtggtccccctgccttggcctctcaaagtgctgggattacatgtgtaagccaccatgcctggccaaagacttacttttacaggaggagtataaaacatctcattagtaattttcataattgattatgtgtcgaaataatatttttgatattttgtgtcaagtaacactactaaaattaagctcacctatatccttctacattttcactgtggctactagaaaattttaaattacatctgtggctctcattacatttctattggacagcactgggctgggtgagatgactaggggcagaaagtacattctgagggccagacaatcaaggtgattgatactggggttaggttaactgaagggtagaaaaggccaggttaataggaggcagggactgagtaaccgggaacaaagttatcagagcatgagagagagattctgggggtcagccgtctgggatattatagggaggaaggaggctgtgctacaagggccaagagacaggaggatgcactcaagttggcctggatgaagggacgaccctctgcgacttgggtgggggtaagggtggcaggctggggccagccctgcactcaccgcttctgcttcctagaaggagaaacagtgtcacttggtacctccacctcaggggcgcagtcaagacccgctgccaggccagcctctgcctgaccgccggctcacctctcttcttccagcttcttccgcaggaggtcccacctccaggcgggcatgctggccagccgggcctcctcctcctcctgaaacacaaccacaaagcttcagagcctgcaggggctgggagatagggggcaccctcaacctggggacctgaaggagtcagggtcacaggaagtgaccctttggatgcatttctgtgggacaagtggatggaggtgcctggtcacaccccctcagagctggcctcctttctcctagtaacccagacccttgtgtcctacaggaggcaccagagagatcagagctgagtgggacagaagcagagaaaaagtagccgggacccagaggtcctgagcctgattccccacaggggcaggtggccaatggccacaggtccaagatctctgggcagacgcagatgcgggcccccacccagcctcttggctcagggagattcaggctgcccctggctcccctgagaaggaccttcagcccatggttgccctcttcccaacagagtggatacgtgctctacaatcgtggggctgcaatgacatcaggggcaggtgtggtgtccaacataggcagtttacagcaaacagttttatttcctgaatattacagaggagaaagggtctgtacaccgcacacttcacacagaacactgcacacgtggctcccttgacctcagccaaggaggtagctgtgaactccagtggaaaaccagagagcaggccacactgccccagggaggagccgcagcccctcactcagaggggcttcttctgctgcctggctccacacagagctcagcaagaccacggggccagagggggacacctggtttgttctgtgcctgccctgcctatccgaccaacgccccacacaacctgctcacgatgggacctcagaggctgaggcagcctggtcctgggccctccgggctgctcaaggccacagtcctgggttcttcccgctgcttcacgcctctggagggcgtcagacaggcgtccaggcccacgttaagacgctcgagggtgaactgcgaattccgaattccgctgctcagatgtcaaacagctctgcctccttctccttccagaaggagaagctgcggtcgatgtagcggcagatgtcctcgttgctgaattcgcccatctcagacactagttccaaagggtcttcggcgggggcttcggaacccggagagtctgagatccggggaggcgcggcggggaggcgcggcgggccggcgggcgggcgggcggtggcggcggctgcggcacaggggccagggcctcgcgctgccccttgggcgggtcccccttctgaaccggagcggcctcttcggtccgctcctgttctttccccttctcttcctttttcttcgcctgttcttcgggggccggcccagcctccaggccgtttccgaagaacctgtgcctgaggtcctcgaagccgtcgctccagccgcgccggccggcctccacctcctccagcaccacgcggtggaagaggcggatgcgctcccacgggtggctgtccagccggtggaacatctcgtagcacagtaggtggcggaacttgcgatcctcgcggctcaggcccatctccggtagctggaagtagccgagcatgaagaggtcgagcgtgaggctttcgtagcgcgggggtgcgccgccgtctaggggcgacaggaagtgctggggccagtacacgccgtgcgccaggcccgggcttggcggcacgtgccgccgcaggctccgccagtggtgcagcagcttgcccactgcctgccgctgcctcagcagctgccgcagccgttcgttggggctgtgggcctcgcccttgctcaccggcagccggggggcgtccgtggcctccagctccggccagcacgggcggccgtcacgccagggagcagtctgcctaggcgcgcctggtccgcggaaggcccggtccgaggaaggcccagaggcgccagtgctccaggaagaggtaaacgatgcgctccttgcgcaggtcgaggtagtcctggacgccgcgcagttccgtgcagaggggcggccggcgcgccagctgctcgggctcaagtagcgccgcctggcaatcctgtgcctcaggcgggcccagggtgtccaggggctcccagtcggccagcgggccgtgggcggcggcggcgctgggctggccagagccggccgccacgtagtcctcctacaggatgggctcgcggaccggggcgccagcggactgcgggggcttgcggcgcggacagcgcgggggcgccgcgtccagtgcgcgcagctcgtaggtggcgcggtgatgctgcacggagacgccgcactcgaggatctcgcgcgccacagcctcgcggcaccagttgagccagtgcgagcggcccaggcaaagcggccccggcagtcagggcgcctcaggcagcggcgccagcggctggcccgtgtcagcggtcggcagctccgccaggtgcgcaggccggccgcccagcgcggctagcagcgtggccatgctcttgagcagcgtggagatcttgctgcaccaggcgggcaggctggcggcgcggccatgcattcggcgcgggtcgacggtgaagcgcggctccacagggcgacggagatgggcagcagctgctcagctccagttgctccaggcgcgcctccagcttctgcgccttgtgcagcacctgcaggttctcgattgctgctcgatgcggaggatgtcggcctcggtcatgagctcgccaaagggccagaggatggcgttgtgctcgcgggagtacctccagccctcgcgggggtacctccagccctcgcgggggtagcagcacgagctggcggccgtcagctaaggcggggaagacaagagaggggagggaggcgcgtctccctctggcccagctcccgccgtggcgccaggaaccttttgcatgtcctgggtggtgtaatggctccgcggggctgcgtctgcagggagggaccgcgtctggccggcggggggtgacgctggggtgaggcttcggcctgagccgccgctccaggctctgggcagtgtccactttggtcgctggcggggggcacggccggttgctgctcgctgctgcggcggcaagaacaggccagcagacggggtctccatgcctggcttgttcgctcattacaccacccaaggaacttgccaaaggccttgaagctgagaggcgcggtggcccgccccaacccatccgagggcggctattgtgaggcctctcctcccagactcatgaccccttctccagctcccctgtggcccaagccttccgctccctgtggtcaatgttttatgtgcagaatgagaggccactcctctcttaaagaggctgcagctgcagcttccactgagctgcccacccttcccctcccttcgtcgtgctggacagctgggcaccgtaatattctcatttgctcacttttctccacctctgatgtccagttttcccccctgggcctgccatcgcctccacagaggtccctgattcatcttggccctatgggatccactccccacatacaaataggaagcagcctcttccctgcttaacactccccgcacccggctccccagtgctccaggagaaagtccgttctcttctgggcctctggccaggtcttggtaacctggcccccactgaggtctctccagctcagcgacccccttcctccaggacagtcagggccacatccactctcacttccagactgccctgtcccacctgcggctcttcagccccctctctgcctggccacccctcactcgtcttccaagtgttaccttagacatcacctcctccttccctaacacaccccccagcccacgtataaggtggccggttagggctgccccagtcccctgcgttccccattgcagctggctgtgttgcatcagcccaggtacttctctccactgccacccactctctcacactgccccattttgtgtgcttggtgactcgcacacatgtccgcagccaccttagagcaggccttgatatgttcaccatgaatccccagaggctacaagcgtgtggggcacataaatggcactcgggggccaggcgtggtggctcacgcctgtaatcccagcactttgggaggccgaggcgggcagatcacttgaggccaggagttcaagaccagcctggccaacatggtgaaaccccatctctactaagaatacaaaaattagccgggcatggttggcgggcatctgtagtcccagctactcgggaggctgaggcgggagaatcacttgaacccaggaggtggaggttgcagtgagtcaagatcgcaccactgtactccagcctcagtgacagagtgagaccctgtctcaaaaaaataaaaaataataaaaataaatggcattcggggaatagtttttggatgaatggaaagcaactcatcctgccagctggtgctgatcagctcaccttacagagaaggaaactgaggctggatgaggctcagtatcggcagctggaaggcggcagcgcagcaatggagaccaggtccctaagactgagaccaaagctctcttggctactcagtgtggtccttggaccagtgtcatcagcagcctcacccaggagctggctagaaatgcagaacctcagccctgcccagacctcctgaatccgaacaggccttttaaccagatcccaggtgctgggcaggtgaaggagagtctgagaaaggctgctgtctcactccaaggacaagctgctgggggtgtgtgtggagactgggacaagccccaaacggggtcgtgccaccctgatttccctaaagaagatggccgggcacagtggctcatgcctgtaatcccagccctggccaacatggtgaaaccccgtctctaataaaaatacaaaaaaattagctgggcgtggtggcatgcgcctgtaatcccagctacctgagaggctgaggcaggagaatcatttgaacccaggagacaaaggttgcagtgagccgagatcgcgccactgcactccagcctgggcgacagagcaagcctctgtctcacgaaaaagaaaaaaagaaaaagaaagaaagaaagaaaataggaggtcccgaggttggtgttgggggtggcgtgggggatgggctgtgcatccagatgcagaccccagggctccctgggcaccccgccccacccactttccacctctgctcctcctcctcctccatcttcagctgcatcttgcccaccatcacctggcgcttccactcgggcttgggacggccctgctcatcgtgcgtggggatgagcgcctccacgtccagctgcacccccggcgcaggagtagtgggcggcaccggaaccaagcttccgttgagcagcggctgaaaccccgcagctggcggtgtggggctccggactggtaacagtgcaggtgacacagacggcagcggccaatcgggctgcagggagaagcggtggggctgagcgcctggtggcctagggccagggaagccgggtcgcaggctcctgctgggcccgcctacctggaaggccggctgcctgctgcctgagaacactgtggtcagccccttgctctgtggcgtcggcttcaggctcttgcctgccttaatctcagccagtagctccgagttgtcgcccatcgggaacatcacgttgaaagacttggtgcctatgcagaggcaggagatgaggcactggccagggtggggctgcatccctgccacccctcacccgcccctctgcagcccccttcccaactccagattggatgggtgcccatcctcggggccagcgggcagctctccagatcccaggtcctgcaggcagctttcagggcccccagaggcaggcccttggttccccgactgtggcaaccccaccatcctcccccaccctactcacgggatggagggcccctgcctggagacccctgggagttcatggtggctcttgggcatatattcctgcccagccactgactgcccagccccaaaacactacctggaatcagccaccggacctttgtcccaggtttcctggctcagcccggctgggtggagcctccctctggccctctccctacatcagcaaagcctcagtgacccttgagctgagtcaattggggcctccatggacatgcagagtccagaccccagagtgccagtaccacctgctcccctccctcgccaccacacccacagacagacgcacaagcagacacattggttgcaagccgggagcacatttatggcaaagcacggctcagctctaggggaaagcagagcccttactaaggccacaggaggcacccaggaagaagggcagcaggtaatatgcaaacacccagggcagagggtgcattttctggcttagccggaggaggcgaatggagatttggagagataggtctcttgagtcccgatgaaggggtcaggtctgggagggaggaataaaatgggccgacagctcttggattcccaggctggggatcccagagtgcagtcaccgggaggagaagagtaggagaaagggaaaatcggtgtggcttactcatttatttaggcaaaaccatcagccaggcgcagaatgcttgggtgcatatgtgggtatgagggtaggtatgaggtgcaaggccccacccatgcatcgaggttctctcgcctgccagcccctgcccctgccctttcctcaaggctgggcccctcctcccgtgcttttcctgcctcttccccccaccccgcgcctcagcctcagccaggagccgcgcacgcagctactcactcttcctgtgcctcaggactctcacttctagggaccaagaggagagaagtgacagcggagttaggagggaaagggggccaggatgagactgggatagcaggggacagggagcgggccagggagagcaggaggggggaagtggagaagagaggaggagcatttctgcccatctgaccctggctcaggctgctctggggccccatgagggtggtccatcgagttcctggtttggctggtgcccctgagggctgggcagggcagggccaccagtggctctagcccccagcaagggcctccaccttggcactgggttggggtagggcacccagccctggctgtgctgggtgggggtgtctggggaagcccagagtatatttttctctgcccttagcttcagccctgctgcagactgtggagggaaggagaaggaggctcggcaggtgctggacatgcttccatgggctctggtctgcaggggctggggctccataggaaccatagggggacaagctctgctctgcactcctagtcagggagatgaagctttgaggggtgccactaagcatgatctctgccctgagtggctgggtgatgaaggcaccccagccaggctgggatgggagcaccacatctaggcaccctgtcctgggccttctaggtgtcctggcagggggacactgtcccaccctacagaaaagaagcccaggaatcctgcgccagtctagctcttaaaaaggatgcctagggaagtcaccggggagggagggggaaacatggtgggtcacagctttgcccccatagccaggctctggctggcccagggcccctggcaggaactggctaggaagagttcctggcatatctaagaaggcttcaggtctgtgctgcttggaaagacaagagaaagacgtggagagaggaagagaggctcaggatagacaggggcagggggaagggtggccagctgcggggcctctctgaagctggttcgacttcaagtgtccctccagtaccagctcatcagaaacaccagcaccagctcatgggaaacaccagcgccagagctggaaggccctttctagcccgtgggaggcaggcccagagaggggaggggacttgtccaggccacacagctagagggtgggaggcaggcccagactggggaagggacttgccccaggctgtgcagcccggtcctgctttggcaggacctcaagcaacccagagccctctcttagggtcaagtactcaatgcggtaggggtggccggaagaccatgtagaagaggaaggacccgggcagtgacagctggggagggggtggtgtctagatttccctcccctttcagggctagcgccgccccccacccctcaacctgcccctactcactgccggtgggcgaggaggagcggcgctgcccgcagccagggccagcgccctcgaggggcagaggcgggaccggcggcggcgaactcgcggcctcgggcaggggcggcggcggcggcggcggcggcagctgctgctccctggacgccttggggtccgcggcgcagccgttaggcacgtggttcccagggagttccgcctgcggggatgaaggtgggggctcacctcccagcttagggagaggctgaggggtctgggtcacatctggccgggggcgcgtgcagagccgcggtcaggtgtggcagagcagttggggcccacgtagcatccgcgacggctgcgccgcctgcgggggagcggaggggccttcgagcgagccgcgggcggcagggccgaggcgcgggcagccggcgggcgcgggctggcgggcacgcacctcctcgcggtgcgccatgcccgggcgtgcgaccagcgtctcgccggggcagcggcccagctgccggtagtagtcccccgtgctgggctgcttgctgaaagcgcggggcttgcggctggagtcctgcctccgtagcccgtcgtggccgtcgcaggagctcggctgcgggaagacagtgaccggtggggctcgggcaagtgcccggtaggcgccccccacgcctccccacccagctcttcacctcctgggaactcgcggccagcggccgtcggggggtgcagcagccgacttcctagaccccctgttctcacggtgggcagcgggcgaggttcatgggggcctcggtggaagggcaggctccgcccgccttacagggaggggttctgggcaccggccaaggggcacagggtcccccactgaggccagaaggggcgggcccaggggcgggccggcccagccccgacgccagggggagctagagaaggggcacctcccagcttagccttcactaggccctcggccgcactccgctctcggctgtcagaaggactgcgggtccccagggctccgcggagccctgtctttcgggggtcccgggccggagggagccccctccagagcctgtgctctccgaggctccggcttgccccggaccccgcttgtccgtctaggggctgctccaacctgccacggtgctggtggtcctgctgtgcacctggcggcgggggcggcaggacccgacacctgctttacgtgatacttcctctcaggttacagacgcccgcgcacggccagcctatgggctccgacggcctgacatcacccggggcccgccaatcccaggccgaaccccccccagccgtcgcggatgccacgggggcgccaactactctgccacacctggccgcggctctgcacccgccccgggccagatgtgaccccgccccctgcgcctctccctaagctgggagctgagcccccaccttcatccccgcccgagaggagagagggctgaccgtgggcagagggggcctctcatatttggctgccggctccgggtcgcgtccccaccgtttccctcctgcatctggaaaccatcgccatccacgaaagcgacaccgacacccgcgctcaagcctcggatttcaggggccgtaaggcggggtcgggtgacagcgcggcttcccgccccgtcgcagctgcccccaactaggcccagctcagtgagggagagtgaggcggccgggccaaagactgagtgaccgggtgggggctgtcccctgccccactctccagcccatgcgtccctgcggtggcctcagacccttcaccccgcccgacctggctcacgttgcaggaaacgcgacaccgcaggattcgttttctgggccagcccgccggctccgcgccccctgcagcccggaggctccgacgccacgaccctgctcccacctgcggtcaggcacccgcgcgggaggcgccgcggcgacacaaagagccctttgtagagcttcccggcccgggccctggcgtctgcggcccagcacgcacacagccgggagggacgcacacagccgggagggggctcgcacagccaggaggtgacctcacagacctggcacttgggctcagcggtggagagggggcactggctgggccacctgtcctgtggatttgggcggggcccacagtctgcgccgggagctcaacgattccagggcccctgcagccctacccgcccggccccctctgcctcccagagatgaaaggggaaagccactgtgggagcttggtctaaggtggcgtgaagagggcagctactggagctggcctgcaggtttggtgtccctcccatgcctcccttgcccactggccttgtgacctgagtcaccttgtatgaattggccctggggtggctttgccttgggcttaagagagaactgcaaggtcccaggctccagcaggaccccagggagctgccacaccacatctggccacctgtgacctcaggctgtcccctcacctcttagaccatccttgctctgttcctgtggccagaacgccagtgttccccagggcaccctgccgaggatacccgcaattgctcagaccagacctctgccccaatccctgctccagagcctcagccaggcgcctgcaggccccagacatccctaggcacctcacacttcacctacccaccctgccctcatcctctccacacaggctcgcttccctccagggctcccagctcaggcctggccctttcccccaggagctcaagccctaaactggaaccagccacagcttcacttcctcccagcccctactgccggtgggcgcccagccctgctagtgcctgctcaccttcctccctccctccttccagcccttacctctacagccatgccactggcaccttccacctggcagccacctcccttgggtgacactctccgactgagcctggggctgtgggggtgggggggcatgcttggggaggggcagtctccatgcattctctgtcaactccatgacaacccggccactcctgtgcaagaggtggcacaggcccagttcctggtgaggaacagctgtctggacctgcgtccttcaccccccagctcccatggagggcagtgacctgctcttactctcctcccagtccagtgtccagccctgacccctcgtgggactcgccaggagctttgactcttgaatatgccatggacccagggacccccaccctgtgcccactagtgaggccaggcctttggcctgactggcccccatcagcccagtacccctgctgggaggcaggcagtgggtgagggctcactacctccttcttgagggcctctgtctccacgtggcggagtttgttcttggtctgcatgtagatgtcagctgcctgtggtcccacaggaggcttgggagatgggtagctaggtgggggtgggggcagttgggtgcctgggggcgggggtggcggggggaagctgggtgggggtggtgggggtatgggcttcccaatcgtgccccaaggcaggcccagctctgggttcagcatgtccatgtagctctgtatgtctgcagctctagtgctggaaagccctggggaggcagaaggaagggccagatttggaagcatgcagacagcctttcccccaagaatgagactctccaccacctggaaacaacttgccgagggccaaggtgggctccgggcaccacttggtacacctgttgtggcccctggcgttgctgggcttcctctccctggccctgccctgccccagcccagcacttattgggggaagaccaggcactccggtttggaggggaagcactggaggctttggtgtgtctagagggcagggtcacctggaaggggagggtctactccttgggagtacagatggccacatccaatctttgcagggcaccctgccaggtctggaggccaccatctggtggcgtgaagcaggcattgcaagtggatggacgcccatgctcagggcacggtcagggtgtgtgtacacacaagcctgcagtctgccgaggcgattgtgaatttgtgtatgtttgagtgtgtacgcatttgtgcacatgcttctttgtattgatgaatgtgtgtgcattgctctgtggacatggtgtgtgtgtgtgtgcatatctgtagtatggaaatagagcattgtgtgcttgtgtgtaaggtgggtgtgtgcagatattagcatggctctgtatgtgtgttcatatctgtatgctgtgtgtacacatgtacaagtgtgtgcttttgtgtgtgagtagctaagaataatgaatggtgggtggcacacgtggattttgtgggtggggagagtacatgtggatgtacatgtatgtctgtgatgagcacacacaagtatgagtgacatctgtctctcaccagaaagggtgtcgcctccccatgtttaaaagcaagtgataagagtagtctccgatattggctgtggcaggctggcccaaggccaaccctcacagcccagcagtctggcttcagtctgctctccctccccctcttcctcctgggcacactcaccacgtggagggtgctggcccttgatgctggagtggctggaggagcaggagtcgtagttggagagggtgctggtgggcgagctgaggtcaaagttcagaggctggaccgacaccgtggtgttgggtgaggacatgcctgaatccggctgcttcgcctccagctccacggatggatcccgggagagcacgcagtgctccatgctctgaaggggaggcagggaggccatgaaggcaactgcaccccaagatgcgttgctctccaggccagggtcctactcagccatgcctttgccgtgggatcttggccaagccacacccctctctggggtctcttccccatcgctagagggtctttcaggttcctccgggttaagattcaagcccagccccgccaggcagaggacccaggttcctgggaaactccctcccctggctcctccctgattaggagggtggagagatcgacgaggagggggccttgagctgcaccccagggggagaactgccaggagatcggccttctccctcacagatcggcacaggctccatggggaagggcacagcacaggcccatccctagtgacctggctggcaagccagctctccttgccagacctgggacctggagcagactcccaacaccagcccggcctgtctcctgatggggcccttggggtaagggtagggcctggatggccagctgagcagtgatgggcagccagagctcaggctgccaggcctgccattcccccgccctgcccggtctgtgcgtctgaccacaggcctgtcccctcccggtgcagagggggctgtggtaggggccctgcttacattgcccatgctgcccctgctgccggcaagcccgcttgctccgctgcctcctgcccaggcctgctcctccttgccccgtgccccctccctacctaagaagtgtcacaggcaccctgggagagagaggcaggcctggcaccaggtaacggctcagcggccgcgctcattggccccgtaattaggggctctgctggagtgtttgccttttctgggccagcgtcttctgtggcttgggtctgtccctgcctcagctgggcctgcttgagtgaggggaccagggcacacacaccccacccattccaggggaccaggccctgttacctaccgcaggagtcaggggagccataggaggtggcatgggcagcacccaaaggtgctctttacctgggcaacagcagtgggtgctgagggcaccaagccctgacccctgtaggcagcagataagaggctgggccacagcaggtgtactgcgcctggcctgagccacccagctctgcagtctgggactgtggcttcaaactttccctccccgacttactagctatttcaggcgagtcacctgtgctttttgtgcctatgtttctttatctgcaaatgggggtaacagcactacttgctctgctgagctccaggacatggcgcccagtaaatgccatactgtcaaatttttttttttttttttttagacggagttttgttcttgttgcccaggctggagtacagtggcgcggtcttggctcagtgcaacctccacctcctgagttcaagcaattctcctgcctcagcctcccaagtagttggaattaaaggcacccgccaccacacccagctaatttttgtatatttagtagagatggggtttcatcatgttgaccaggctggtctcgaaccctgacttcaggtgatccacccgcctcagcttctcaaagtgcaggcatgagccaccacacccggcctgtcaacttttttattttattttattttatttttagacggagtcttgctctgtcaccaggctggagtgcagtggcgcggtcttggcttactgcaacctccgcctcctgggttcaagcgattctcctgcctcagcctcccgagtagctgggactacaggcgtgtgctaccacacctgactaatttttttttttttttgtagttttagtagatacggggtttcaccatgttggccaggatggtcttgatctactgacctcgtgatctgcccgcctcggcctcccaaagtgctgggattacaggcatgagccaccgcgcctggcctgagccactgcacccagccaactatttttttaatgtactgtgaagagtaactgagattacacctttaaggcactcggcagggtacctgcctaagtcagaatccaatgaatagtgtttgctgtcctatgaccactagcagctgcatccagacaggccctcaggtgccctgggctctggtgccaccccccatggtccctcgacagagtcacaggctctcttaactgatggggacccaccactgatgcagaaatgtccttccctgtgtccatcccggcttatataccctagtgacagagtgctgactacctgctgggccattcattctcttccagagactctttctcggggggaagttcaccctcaggcccacctgcagcctctggcctctgggccttgctgtgttctgcagcccccagagccaggaccatccccctgtgctggcagggacgacagatggacagacggtgctcagggcacagaccatctgccttcttccctccgggcctcatttcacagccactccatggccaggctgccccatggagttggtccgcatccttttggggttggctgtgaggcccactctcttccctgcctattgcctcaaagcaggcattgtaccagatggtgcagagccctcacttggagacatccacagctgagttcaagtcccagtaggtcacttcgtggctgtctcaccataaaaacataatttaaaaagagtagcatgggtttccagttatgacccagccatgaagtcagctaatatatggtgcaggggcagagaggtggctcctggtcaggccatcaaggtaggttctccactctaccacttactggtgatgcgatcctggtgccccgcagactccctttacccatatgtggaacgggacacttacactctcttctgcagagggtggctgtgagttatacccaagctaatgtctatgggtaggtgaatgagcctgcctgttcccaatggggcctgtcttgtgatttctccagccttaccccttggggtgaccctgttcttccctgtcctctttccgttaacctttgtgcctctactccctcagtccccagcaggcagtggttctgggctgacaggtcgtgtggggtagcgggcttcacgtctctgaacctcagcttcctccttggtaaaaggggtgacgacacccaccactggggtggaggggcgagaagagagaatgcaacaggagcagcgcagggatcgtaccaggttctccaccgtgcgcaggcagtgggtgcagtggctgtggccgttgaagtccgacaggtcagcggccgcgtacccgtcgcggtcgcggacttccagctccgcgccgttcactaccaggatctggcagcactgtgggggcacgcagtgaggacccggccgcggccacgagctgggacccccgcgcccgggcagggccgtgcggagagcgcggtgccagcagagggcgcgcgcccccaccccgggcccgcgctgacctctagctccccgttctcggcggcgtcgtacagcgcggtcccgccccacaggtcagccgagatctccccgccgtgcagcagcagccagctgagcaccttgctgtggccgcggctcgccgcgaagtgcgtggcggtggcgccgtctttgtcctgctccgacaggctcacgtcggtgcagctcacctgggcgggaggggcggggagagagggccgggggatgggggccaggcccctgcaggccccgcccacggtcctccgccccactcctgatggccccgctccctccactccccgccctgccggctccgccccgtctcccctccgcaccgcccgggcccggagctcaccaaccacacgatgaccgggctgtggcccatctgcgccgcggcgtgcagtggggtcatgccgtcgtgggcgcgcgcgtgcgggtccgcgccgcattcctgcaccaggtactgcgtcacctccaggtggccctcctggcacgccaggtacaggggcgtggcaccgttcttggtttgggcattcactcccctgcggagacacagcgcccaccgtgggctttcagcgcctcaccccctccgaggcctccttacccgcccccctcccctcccggggagccctggacggcagggagagtgggcgggagagggccctgtcaccggcccgctgccgcccggggggctccgcctggactgagtcctgagccaccctccctcagaggcccctgagggcgtcccacccagcactgccctgccctcagtcccacttttttttttttttttttttttttgagaagaagtctagctctgtcgcccaggctggagtgcagtggctggatcttggctcactgcaatctctgcctcccgggttcaagcgattcttctgcttcagcctcctgagtagctgggattacaggcatgcgccaccacgccccgctaatcttttgtatttttagtagagacggggtttcaccatgttgaccaggctggtctcgaacttctgaccttgtgatccgcccgcctcggcctcccaaagtgctgggattacagagccaccgcgcccagcctcagtcccactttttaaccgaggtctacaaagatgtggtgagctggcctttcctcccctctcgcccactgtcaccatgagtccccacaactgctgtgtctgacctctatccctttcatcgtgtgccccctccatctggaatgtccttccatcctcctccctcttgaagactcagtacccatccctcctccatgagggccaccctgatttatttcccccttgctggcctccgccccacactgcccagggccactatgagcatgacctgtcatgcttggttgaccataactgattttgacctttgcctcccccagaagactgagttcccagcgggcagggtggtaagggttgccagacaaaatgcagttcacacagttcaaccggaatttcggatgaacggataatgctttagtattctatatcccaaatattgcatgggacatacttatactaaaatacaacttttttatctgagattcaaagctagtcaaacatcccgggttttgttgttgctgtttttgttaatctggcagccctcgggatgtccactatgtactgaatgcttctgctgtgctagctctgggctacggcactggcaagcaggttcttctttttttatttttatttttgagacggagtctttctctgtcatccaggctggaatgcaatggcgcaatctcagctcactgcaccctctgcctcctgggttcaagccattctcctgcctgagcctcccaaacagctgggactacaggcatgtgccaccacgcctggctaattttcgtatttttagcagaaacccagttttgccatcttggccaggctggtctcaaactcctgagctcaagtgatccgcctgtctcggcctcccaaagtgctgggattacaggtgtgagccactgcgcccggccatcaactattactgtgaccatcaactgagattacaccggtaaggcacctagcaggggacctgccagaatcagaattcagtcaatggtgcagctacagctggggaggctcacaggtggggctgggactctgtgccatcacccatagtcccacaacagaggcacagactcagctctctcctcggtcacacagttggtaagtggcacttgaacacccatctgtctgtgcatgcagggcctggctggcaatatgggcatgcagggagtgaagagatggaatgtgtctcaggggctcctcctagggcctagttttcggctgtcactgtcccttatccttgctctgccagcccagagggggcctacctagggaacagcagggctgtcctggctgctgggctgttgggtgtgaacagcccagggtgcagttgccaccaaaggacactaggtggagccacaacctacccccagacccaggagaagttccaggttgggggccacgacctattgggttccagttcaccttttgtgcctaggaggccaattcctcacaggacttgacatcctgcccatctacctcccccagtctttcaccccgtagatcaaccacatgctccaccctgcattcatccctcgttcacccatccaactgcccatccacttgttgcctgcccatcaacgtgcaccaggctacccccctttgcccacccaccctcttgttcccaacacgactcagcccctcttctgacccctgtcacgtgtgccctctccctccctctcacacacatcctgagcccctcccagctggcatctccctgtccctaaagccctggttctctgtccacttccctgactcctgagaccccaaggctgactctgactgagacccctgactctgcagcccccatggacccccactcactgatttctcctccctccccactccctagacacagggctgccatttgctggggctgatgctgagccgggcacttcatgatggtgcggggagcaggcaccatgcctggtgatccagagggggtcccgtcaacacagatgagggagacagaagacccagctacgtatctatcttcagaaacatgctggctcgtggctgccagcctccacaccccagcgccagcgtcacccccacacacactcacatactgctgcatcagaacaggctgttgaatatttcatgaccgacgctcagcggcctaaattattcaccccgtaaccaaggcacagtgagtgccggggtctttgggatcaggggctggtgggggcccactgggttctttctgcagaggcccacggcggtgtacacagcgggtggggggccagacctgcagtgagctctgctctctcagcactccctacttggcagagatccatgacccaggggtgcccagccagccagagaaggtctgagaagctggcatcaagcaggatctgagcagcagggggaagtggtacccacggcctcctgcagggccgctggctggcactcccagcccaagttcctggcacggaatgagccctcagtaagtgctggagctcatcaccattctcattagtattccaccatctgcactcatgcgccccattatggagtcagagcctccagcttggaataccccagaacatgaggcagatatgctgttgggctgggtgggaaggggtcctggctcaacatccccttccaccttggcctgaggacaagaagaacaatgggcactctcacagtcactggggagtattacaaagatatggatgagcataaggaccaaaatgaaattcccatcacacacctggaatccaagcacctcgggaggccaaagcaggaggactgcctgagcctaggagttcgagaccagcctgggcaacatagagagacctccgtctctacaaacaatacaaaaatgagccaggtgtgttggtgcacacctgtagtcccagccactcaggaggctgaggagggaggatcacttgagtccaagaagttgaggctgcagggaactatgatcataccgctgcactccagcctgggtgtcagagcaagagcctatctctaaaataaataaataaatgagaaaataaacaaaattcccatcactagagagaggaattaataaaagtaataatagtaaataataataatagtgatagcagccaccatttactgaatgattactctgtctcaagcactgtgatgagtacaacacacacgttctctcagctggtctttgtaacaaccccacaggacaggtgttagcattgttcttctggtacagatgaggaaactgaggcacagagagctaagatcactctgtgagaaagaggcagagccccgatttgaggctgtgtctgatgcagagcctgcttctgactccaaatgtgccacgtctacaccccttctgctcttggtcggtctgtccctctgcctccctccctccctcccactgcacagaccactgcccttccccacagacctcactgctgggaactcaggaacactctttgacagctgctggggcacagccccgcaggaggacctggctcgagtcccgtgcctttgagctgtgccacagtcttgcttcttgtctctttgtgttcccaaacccatccatgaaatgggggcaacagttgtcatcctgacctcgtgcagagtgcctgagaagtgcctgcagagccctgagcacaggcctggtgcctggcgcacagccattgctgaactttaggatccttccctgtgcctgggaggaccagccaccaggggggtctatggctggcctggcctgtccgggtcctgccaagtacgggccaggctgggcatcatttctgctgtggggaacactacctagaggggagaggatgggtcttgggggagacctctgactcccagacccttgccagctctagccctgaccacagtgacagctgcagaaaagtgctcccagaccaagcccttgccctttgccccggctttgacccaaaccctctttgtaggtcagaggcgccctggcgatgatcgtataaatcatgatttgttttctttctcctgggaacaaagatgctatggatgaactgtaactattcatcaagtcacctctgattacacaaaagaaacatgggtcccccgtgtgggctgtgggaatctctggcggagactggtgccagctgactgccagcaccgccgcagggagtgagctgcccatggagccagagtcgggctgcagaatgattcccgcagcccgccccactgccagtcacgcctccccagagggaggccaggaagaggctgtccctccgaggatcagtctggttgtggcccgtgactgctttcaattgaaattcacggagcctttggtggatctacggctctcggtgtcctccagtcaaacttcccggcctatgttaaaagattcccaagtaggcctggcccagggaagaaatgcagccccgatttgagaaaggttctacaccccagcccatcagctagcatggaatagttccagaagcctacagttgcctgcaactctcccagcctcccaggtcttcctcctggcccgtaattaggccaaatttgaccccccctgaggcctctacacctccccacatcactgccagttccaccatggcagggctgcgaggccgaccctcttttcattaggttctcagctctcctcccctcaaagatgcctggcttccctgacccctcaacttaaagaaccatccccatcgcttcctaccaaactcctcatttcactatatagcacttgccactcctgaattatcttgttctcctattcctcagacccatacatgcgtggatagaagaatgtgtggctgacgtgatgacaggccgggcagttgagtgcacccacttgctgtttgttgaatgaataaatatgagaagggacatccaggccaggagtaggggatgtctcttcactcatggccgcagcctggtagagcaggttagatccacttgccagataggctcggaaatgcccagaggggagttttgtctagggtcacatgcaatgagctgtaggcagagtggacaagtccctgggattccatgccccactcattcagcagatgtttactggagtcaggctctgggcatacagagccgggaagacaaagcccctggccttattagtcacggacagacgggatgaaaacacacatctgtctgtgtgatgcagggcccagccagaaatccgggcatgcagggagtgaagagatggaatgtgtctcaggggcttctcctaggggttagcttccggctgtcacgcaggatgcacacagaacgcaaagccaggcaaccatagggcggctgggaggccaggtgcagtggctcatgcctgtaatcccagcactttgggaggccgaggtgggcggatcacctgagttcaggagttcgagaccagcctggccaacatggtgaaaccccatctctactaataatacaaaaattagccaggtgtggtgccatatgcacctataatcctggctactcaggaggctaaggcaggagaatcacctgaacctgggaggtggaggttacagagagctgtgccactgcactcaagcctgggcaatagagcaagagtcgagtctcaaggaaaagggcagcagggaacaaggtcagcgggaaagtgagtgggcatcatgggcgcgggtgacaatttcagcgaggctcagggttggccttgctgaggtgaggtctgggcaaagacttgcaggaaggcagggagcaggcggggatctctgatccctgcagagggatcagcctctgtgaaggcaggggtgctggcctgttggaggggaccacagcccggaggagggacagcctctgggccattgtaaggaagtgagcagcattccctgtcagtggccagaagcctgtgacgggaggtgctcttttttttttgtgaaacggagtcttgctctgttgcccaggctggaatgcagtggcacaatctcagctcactgtaaccgctgcctcccaggttcaagtgattcttatgcctcagcctcccaagcagctgggactacaggcgggagccaccacacccggctaactatttttccccctgagatggagtcttgctctgtcgcccaggcttgagtgcagtggcgcaatcttggttcactgcaacctccgccttccgggttcaagcaattctcctgcctcagcctcctgagtagcgggattacagacacccaccaccatgcccagctaatttttgtattttttagtagagacggggtttcaccgtattggccaagctggtctcaagttcctgaccttgtgatccgcccgcctcagcttcccaaagtgctgggattacaggcatgaaccactgcaccagaccaggacttgcattgtcttttcttttcttttctttttcttttttgagacggagtcttgctctgtcgcccaggctggagtacagtggctcgatcttggctcactgcaagctccgcctcccgggttccagcaattctcctgcctcagcctcccgagttgctgggactacaggcacgtgccaccacacccggctaatttttgtattttttagtagagacggggtttctccatgttggccaggctggtctcgaactcctgacctcgtgttccgcccgcctcagcctcccaaagtgctgggattacaggtgtgagccaccacacccagcaggacttgtgttttcaaaggctgcgggtggacatggacgggtgaaggccagggcctttcaggcttactgaggacttccccttttccgttctgtagtgcacagcctcacagagccttgggcccagctgagcccaaggggttcaggtagcccccacgtgaggcagaaagggggtttctcagaagccctgggatgccccagcagcgtgctgcttacagagccccagggtccaaggctcagctctcccccttagaagggtagggcaggagcactagccccggttagatgacagctgggaccaggagctgctggtggagacacgagatggtctcctgctgtgaggggcttccccggactccaccaggcccttcctttcccagagcctccacgtgggtcagggagtcaaggacggcagccacctcctcagtgtggacacaggccccgcccccacgccctgcagccaggtgaactgacagacaccaggggtagatctggggctgctgataaaaaggaatgagcccccacggcctgtggcagaatcagggaccaccccaggcagagcctccagccttctaagggggagagttgagccctgggccctggggctctctaagctgagagttgctaggggcttcccaacaaactccctttctgtcccaggtgggggctgcctgaacccctgggccgtgggagcagccagactccgtgaagctttgcacaaaggaagggaaaaggggaagtctgcagtggacttgaaaggccctgagtgattaggacctggaccaggagtgggagagagacccagagaggaggtacagcctgctcaaggccacacagcaagccagtgatgaccacagctggtgaatcagcctctctaaaacaccatttctgtacctgtcagctccaccaggcagggacgcttgtctggttcaccagcatatcactggcatttagaatattgcctggcacatagaagatgctcaataaacattagttgaatgagtccatctgtaaaatgggctgattacatagctactgctcggggtggttgtgtgactcagatgacactgggtggtgccagacccctagaagatactcagcaccaggttctttttttctttcctttcttttctttccttcctttctttcattcgttccttttttttttttttttttttttggacagagtcttgctctgttgcccaggctggaatgcaatagcatgatctgggctcactgcaacctccgcctccctggttcaagcgattctcctgcctcagcctccctagtagctgggattacaagcatgtgccacctgtacaggcatagcccagccacacacccagctaatttttgtatttttggtagagacggggtttcaccatgttggtcaggctggtcttgaactcttgacctcaggtgatccacctgcctcagcctcccaaagtgctgggattacaggcgtgagccaccatacccagccccaggtactttccaatcccattccagtctagtctggtcaggggtaggggaggctttgggggaaggaggcacctgctgaagttgataacatctctgggctaactggttttccagcttgctgtgactggcagcacccacgagcccaggggaagagactggagcctcctcactccccagcctggaagctcaagcctcagggtcccagctgatccccagctccccgacccacacagccctgtccagctgctcaggccctgggacagccagaagcaggtgtgaggggggcagagtgagctcctgggccccaggaccctcctgggagggtggccactggccttggggccacctgctcttcgcccctcctcactctgccctgaatgggggtctggaccccttgttcccctccatcagccactggagctcctgctgggagggccaaccctcccaactcaatctccctgagacccagagcctgggacttgcccagcccagctcctgccagccccgtacctcccaactgagaggtcctttttctttttcttttttttccccacctggagatggagtttcactcttgttgcccaggttgtagtgcaatggcgcgatcttggctcactgcaacctccgtctgccgggttcaagcgattctcctgcctcagcctcctgagtggctgggattacaggcacgcgccaccacacccggctaattttgtatgagagatcccttttctacaagggctcagagggagggtcccacgtggcagcagccccgaggtcactgtgacaagtcctctgcttctgggaagacttggccccatgaacgggatagacagggaggtgtgggggatgtgcaggacattcctgcaatctcaagcactttctattataacaccccaaggtgtagccctggaattagctgagcctccccgaggctgtccagccttccagctcctctgcagcgtgtcacttccatgtctcatggccacccacagcccctccctgggcaggatcgagtttcccaccagcaggtccgggagcccttcctccctcagcactcacccacgcgccagcgagagagctgagccttgtgaataattcacagcaattcacagcaggccccagaggctcgcaagatcatgaagctgggccacctgggtgccctgattgggccctgtggcctggggcagctcaagcctctgccctacccagctcccagccttcatatccacagcctcggtgagcaggaatccctacccgcaagataggaggttaagtgggtaccccagcccccaaccccaattcccagctgctcttcctgcataagcccagcctggcaaccacagaaagacaccttcttatcagtcgagtcacatgctgctgtggggaacggagcccaagccctctgtccacctccctgagattcatggtgactcctggggggctggcagctcatcagtccaggccatctggccactgggtcggcaccagcgcccaatcacacacagcacctggcatggcctgggagggggtcagggttccccagccccggagccctggagggcgttccacagcacagccagtcttcctaacacctgggatccagcccacggagggatcgtggcttctcagtgaggaaggcttaggggccggcggtccccaccagcacttgcataaggcgggctcagcgtcttccagttcacacttgggccatattggtcccgccatcaggggcacctgcccctctcaagacctgtccttctcctctgcttgaagtgagggggtgggacaggtgcatcagaatcaccgccatgagggtggggacatgtcccaggtgtggctcccaggccccaacctggagagtctaactcaggaatctgggacagcctccaagaggtgttgacaggagccagttggaaccctctactcaagggtccctgggtccctcctagtctaaatcccactgactttgacatgatccaaaccctagtttgtttggaagtagtgaattcataccaaagcagccaccaagaaggcctggcagggctggttgtgaagcaccccttcctccgggtgctgcctgttgggtctcccactaaccaaaccagggagccccttcttagcaaggatggaaccaggcccagctcccttgtcctgggctgaggggaccactggagcccggcctggtgggtcctagggccaccctacatccacgccagtgtgcctgggcccaagaggctgcagctgtggctaccttgccacatggccatatggccagaactggcctccagcttgctccctggtggccaggggccctgcaggcacacccagaaactgaccagtggtggggacaggccagaccctctcacctcgtagctgctctcgtcctgaggctgggtccacattcacatttccatctcaggctcccacttagactaacgagggtcacccatcagagtaacccactccccgctcagacccctgtggcatctggcaccctaccctctcagacagggcctgggcagcttttcccaggatccctgcctccccaggcgcacctaagacctgagtctcttcctccctccccaagactcacacatgccacctgctctgttcgaccccccaccccacccgggggagctcccagaccactccccaggaggtttgggatccccatgcttcccttgatagtgggaatgggctgaggggccacaggagataacaagttgctttctggatggcctccagccaggggctctggggtcaggaggtggggtgggggttggggaggggcctttctcccttaactgcttggtaactaatggggttccctttctgcctgtttgactagggcctaggaggcgctcctgcccttgctgcccccaactccattctgaacagtcttgcaaatgagcacagcctgagccagagagagcccctgcggcagaagcagcccaaggggaacaggtgaccttggcctgtgtgcccagcctcccaggtccagctgcgtgcggccgggcagctgaggatgttgggagcacctgcttgcagggctctgggggcagccccagaaggggttttccaggaggggaagatttcatgttgagtgggagccatttctctggcctggccctctggccccaggatggctactggagggatcattgccctggagtgccagagaagtgtggaaaatcccaggcatcccccaaagccctggcccggcccacccagaggaccccttaagaggagtgatcttactcagggtagtgcctgacgagaagcctcagggaggggaagtctcctttggctgcagcgtagtggataggcagggcgcccatgtctgtggccgcggtgggatccccaccgccatgatgcaagagccagttcaccaccttggggtggccaaagcgggcagtcagatgcaagactgtgggaccagaattgtctttgtcctgtgggaggagagcgggttcaagtcctaaagcctgttgctgccccgcccctggcttgggccgctcccagactcccacaggcctggaaggtagctctgtgctctctgtcttccctggaagaattggccaggcctcactcagcagtggtttttttgggtcaagcggatcctgggtttgaatcctgcttctgtccttgggcaactaattggccctctctgaaccgtacgtagccaataggcagcaccgtgcagggttttcagaggctgcaggtcctgactgcgagctgcctacacgacaggcacctggttgtcatggcaggagactggctccaggcccagggccacagccctgactcccaggggctcagggaatgcctgaaggagtgacacagggttactgggctgagcagggccaggaagggtggctgtggggctgtaccaagctagcatcaggattggggggcagcccctgcatccaacacttgccccctctctctccacccttcctaggtgtcacgtgggaacagagacctccaccttggtgcgcctccagcaacccaacctcagtgccttagtcaggcaataagggccctggggactggtttgggtaggaaggacacaccaaatgagcaggaggaatttccccatagaggcgaagagaatccagagatggtgagggagaaaagcacataagaaattaaaaacaaatgcaaacaaacaaggttgaaacagggctggagggtgtgaatgtggtgattcttctcttcctgaggagacagggtcctgcgagttttgtcacaagtcaggaagctccatcagctctgcaacacctgagtcctggatggcgggagatgatggcttaagatatctgggcgcaaagcctgaggccctgcctgtaactccgactccctcaagggcagctgagagggaggactcagggcactggggaaagtcagcagacccagtcacagaattagaataaggtggagctacgcagggaagacaacaccaactatttcctttttcttattttattttattttatttatttattttttttgagatggagtctcgctctgtcgcccaggctggagtgaagtggtgcgatctcggctcactgcaagctccacctcctgggttcacgcctttctcctgcctcagcctcccgagtggctgggactacaggcacctgccaccgcgcctggataatttttttatttttgtatttttagtagagacggggtttcaccatgttagccaggatggtctcgatctcctgacctcatgatctgcccacctcagcctcccaaagtgctgagatcacaggcgtgagccaccgtgccctgccaacaccaactatttcattggcagtagaagaatcacactctgcagctactgagaggtggaggtgaagccaccctgccgagcagccaacctcactttttggttattatccttgtgccgatgctgccggacaaactctctctacaaatctcagcatgtggaagaaacagaggcaggaacaattgcccagcacctttctatttctcgaggacactcttgaagttattcatcaatgttttaattaaagcagatcttatcgcttttcctcaaatgggaacttgttcacttttagactttgttattgttcattttgggcttatctttggtcttttcctgtgctcttaaaagggtgcaaatcaaaatctgagttatgataatccacttatcatatgactaattacttcagtacaaggagttcctgcctgtctgtccaatatgaatcttactacgtcccaatgtcacattggcttcttttccttctcggtggcagcatttggagcttttacttaacttagggtcaatttcgacctctgaattttccacccctcccccacagctgttgctgggtcatgctgttttcttttatctctataaatattgtgacttgtaattgtcacttataaattcattctggctatactgaatcattcccccattatccaagtcatccaaatattcgatgtgcatttccacaaatcatgtagtggccccctgattggggatgatttgtagaattaattatatgctttagatctccattcaggtcttcaggtcaccaatacattaagcagagcagggccctgaacagcttatatggatcaacgattgacagagctgtcggggttgctgcaaagccactgactttttgctgttccccgtaacaaagtatgttcaaatctaggtcacaggtttgtggtagggtcgattcacagtatacatgtgcaacggcgttcagtagcatagcagttgaggttgtgaagacatgtgcacccaggtcaaagaagaaagatccttagacaaagccgctcaattcccaggcacccaatcttccttgggctttgtgaacctgagatttgacaggctcttgggaatgtctgtctctaagactctgttggcaggcttaatcaggctggtggccatctccatatgtgcccccccagcatttgtgacaaaataagggaagggggacccaataaagctacttctgaaagcttatgatcccacccctcatttaaactatgtgatgttgtcattctatataaactctttccaagtaacttaactaaaacacactttgccattagtcttgagtgtgggcacagcattattcttttctaggccttaagggttccttctgcttaaaaataatgtctaactttcatgaagtttacccatgattaaagtgccttctgaatatatattatcttgttctattggtttcaatatacctattttctttaaaaagaaaaaaatgatgaaccatgagtgttaacaccagaaaaaccttaaggtacatctgatctaatttcccactttaaagtgagaaaatcaaacagtgcctaggggtttgatttttccccaggctaattcgggttttcatatttccatctcaaagtggactttctttggctaactttaagttttaaacgtaaaggcctgaaaagtaactcaggatctagctttttcattagttttgatcgtgtatgaaagcaaatatttctttcccccaaatgaaaccccagggcttccagtatttgtagtgatagtgtgaatccattaggtctatttttaattatatctctcttattggttatttttttcacatttcctaactcatttgtgatattgcttccatataattcaactttttgtgcgctgggttcccatttgccccacaaaggcctatgtgcaaatctgatatcctgtttgaatgacattgttttgtttttaccttattgcttcctatctttcacaacaatgttgtcagttctcaacattaaggcattaaaaattagcttttctcaaatgctcagcatcattaatcattagggaaatgcaaattaaaaccataatgaatatcatctcacacctgttagagtggcatttgtcaaaaaggtgaatgatgtgttagacataatgcagagaaaagggaacacacacattgtgaataggtatgtaaattagtacagctggtgtggaaaacagtatggagtttcctcaaaaaactaaaaatagaatctaccctatgatccaggaaccctatttctgggtacatatccaagagaagcttcagagagtgctttgttgggttttctggaacccggcagggctcaggtgtgtggggatgcgctctgtgagcctgtgtttcctccgccgtgagggctcctcccgctcctgtaggaaaaggcagtgcccattttgtcttgtccatgtgggactccaaagggtccagacgcgacagaaaggcggcgaatcctctcagagtgggcaggggaggagatgatagaatatggggaggagatagaatatgggaatggggcagtagaggggtgggatttcatgaaatttcctgattcaaggctatcatgaagtaggcctctttgggagctcggccctccagtcgctggtgagggtaacatcccaccagtctctggtgaggtccagtcgcctccgccgactgcattgaaagccaaaagcagaactaggccagcaccgcggcctggcgtccagtgacccagcggtctgcatattccccagggtggaagcactcggacttcaggtttgaaggcaatgcggtcaccactgcaataagaaaagcaactagggaaaatggcaccttcttctccaaacttttgagacactcttgctctgtcgtccaggctggagtgcagtggcacgatctcggctcactgcgacctctgcctcccgggttcaagcgattctcctgcctcggcctcccaagaagctaatttttggcatagagagagagaggggggaagggggggggagagagattgattttaatgtcttcaagcaaaaagagactctttctgcctgttggccatctgctgccaggtgaacgtgaaaatccatcgagacgctttctgtgaaaaccgcctttatctctttgtccctcttaggttaaaatccgcactccaaaaccttattgaacagaaaaattacaaaaagcacatataagacgtttcagttttgtaaagggtaaaatgaaactgcccttcaggaagaatcagaagaccgacgagggagagaggagcgatcgtgaaatctaagtgggctgcccccgggtcttccagggttttgtactcggtggcttggcctgagttgatgtgcccatattttcaaacagccaagtgccctgagacacagcctttgctacggtacctgctgaaatctggaagtgtgattaactattacttaaattgagtggggcagactaagagacagcagcagtgaaggatgccctttgggagaaagacgtcgaggcgctgaggccaaagggtccgtgaggaaagagcccgcagctcgcgcccctcggcctgcggaagggagggcaaggagggtcctacggttcctgggaggacgcgaagagccaagagctctgacagctggcgccggggaaaaggccccgaggcggggtccgcatccctggaagggcggcgtccacactcctgcgaggcacggggcgcccggggctcggaagctcaaagcccgccggcttctgcagcttctggagcttctgggagccaagagtgtcagccggaaggatcccgcacacggcgcttagttctggaactggatacccgggggaggatgcgggatcccgaagcccgggtgtgggtccccgtggtcttcgtgttgggggtaggtgcggaacgctaagcctgggcctactgggagccatagtcttcttgatggctggtgcttattgggcttttttcagtcgaatttcaaaatgcagttgaatttcttactttggaaacgataatagaaatggctgacctcagattttcatgattatgttttgccttttccagtgtatgtgcagtttctgtagtatagtggttatcatgtttgcctcacatgtgaaagacccttggctcgagactggagggaaacatggttttttggtttttctttttgtccctaaatttagtgagtttaatcgaggttgggaaacaaacagaaaagtagttgaacctgtggctacactttagacctcctcaatctagacagattgttgaccaggctacagtttccactggtctgccagcaagaggcctgcttaatgttagctttggttccagaaattccttaagattctcttcattctcttctgtcgcctgaattttcataggctgacactgaaagtggatgacatcttaatgcatttcctaagtgtcccgctgggcttcgctttactctgataagttgcagatctggctgatttgcgagacaaaaacaaaatatttttttaaaagattctaaatctgcatctggaacttgtagagtcaataatctgaaaccacacgaattatctacatacaaaagattttgaatgcataccccttccccaaataatcctcagaaaaccggttaagttttagcatctatgactctgagatgcatatgaggcctttgtaaatttagaagttgagagtagaaagtacaggtttgtattttagaaggagatttgggaataaatatagctctggtggatatagatcatatgttaaggtttgttggccagagctggtgtgtgtcttgggtgttgggcaaagaacagagaacagccaaagctctgcgaggtcaatgtgaagggtgatttccttggtgggctcaagtttatgacgcagcctggacctagcttggcttctcagctagagaagaagcatgattccatgtcacagctcctgtctttgaaaaagtcataatgactcccagacccaacatgtggggaaaactctggatttgtctcttcagttgaatgtctccgttgaaaattgaggaaagaaatctctctactatttgaacttcatcaaaagactaatatgttaatattttgaccgtcaatatttccttaaactagtctactcctttcatagctaatacatcaaagcatattaacttaggaaatgggattctcccaaacaaggaaacattgacggcaagggttcttaatcttttcacaccacatttccttcaaatgctttatacatcttcaagcagacaaataatagtattataatgattacgagaccgatcattactcttttgccaaaaaaaccagcgacaaaagactaacttagtggaccaacctttgtttcttcattatctgtacattgattctgtccttttatttcgtctttcttctaattctgcttctgcttcttgtttcctccctggatttgaactttatttacctaaactaccagttaggttaccttctcagaacctctaaggcagcagtttgagattgacaatggaagatttaagattagaaaaaagaaacatgaatgaatttctgatgttttattataggggtttataatgcaggtagaaagacctttttcagacttaagagtttgatccaccaaatgagctattttgatatttataactttgtctagtaaaagtttcctataaaaacatttggtttggatatgtttgttagcttttagtcgacacttgaaaaaggcggttggaaggttctaagtctttttggatactcttttctcttatcccccaggccgtgggtgtgtagaggccttggtggtgcagtggtagaattctcgcctcccacgtgggagacccgggttcaattcccggccaatgcagcaggtacttcttcatttcattatggccttttacccgtcttttacgctgcaaaattatactgcataacctaatagtgcatttaggggcttggccaccacaaggtaaagtgacaacattactcacgagagtagcggcaagagacattcaggacactaacccaggacccatgcaattgttggactcaaacagcttagcaaagtggcaagcacgaagtctttccggtgagtcactgcagttttgatattggtacctgttactttcatctattcacggggcggatccctgcaaacccgaagaatcatcaggttcctgattcgcgtgctggaccttgggcttactgctgagccactgtagagaggatcaagaaatgacgctcttggaaggagagaagctgcgggcaggacagtcacgtcagaggtccaagaggcttcagcggcccaaagaaagggaaggtgtgtggggaagaatctgcgtggagatgaggggagcggcggggactggtccttgcgcagaggtggccagtggaccctcagggctgtaccccagacaccgtgaaccgaatttgctcacatcgtcagcggccgcggcctccgcgtgctttgtgggcccatcggtgttctgcgagggattccgtgtgtctggcaatgtctgtcaacaggtgttggcctgaaatttggccgggcacgttggctcatgcctgtaatcccagcactgtgtgaggccgaggcggatggatcgcttgaggtcaagagttcaagaccagcctggctaacatggaaaaatcccgtctctactaaaaatacaaaaattagccgaatgtggtggcatgcacctgctattccggctacttgggaggctgaggcaggagaatcgcttgaacccaggaggcagaggttgcagtgagccaagattgcgctactgcactccacctgggcgacagagcgagactgcgtcaaaaaaaaaaaaaaaaagcagcgaaagaaggcagagatgtcaatgggacaaagagacctcccaggaggcttgttgtagaggcagtgggtggatcctgggagatgagatttttttaaaattatgtagcagaatggggagagaaacggagaagcgcatgaaagagagaaaagcacgaaaatcggcggcgtccaagaataaagcagataaaatagtgtgagtgtttttacattcaaaaaatagaagaagtgcaatgcttgtcagcaggctttgtggtcgtgtagtggttaatacttgtagttgtggttgccacaacctgggttctaatctgagtcacagtagtgttttctagcctgcgattgtggctaatagacctgtcgtttgctttgcctttaatcctagcagcctccagagagcagagtaaacctctggccccgaagggcgccagcttctggagtttagcccacagcgcagaaactagggggcggcctggccgataggaaaacttggacatgctctttgtctcacaattgagcaggaaaaattcccgtaggtgaagatgccgcctctcaagggccctttgtctgtagcttccactggtgaaataatgcggttatagtctttttcggtagagaaaacggctgtatcagtggaattttttaaaaacacaaaacgagaacgagtttttaatgagctgacaataaaatctaaactagttgtcatggtctgcacaggcttgcctccattccccatctgctaatttttatgagaacagtaaattattactattatcattatttttgagacgtagtcttgttctgtcacccaggctggagtgccgtggctcaatctcggctcactgcaacctgtgtctccgaggttcaagcaatgagaacagtaaagaagctacagttcacataaagtgcacaaatctttagtgcaatttgtttagttttgatcaatgttatcaccacccagctcaagttatagaaaattgccatcatctgagaaaggcctgttagagcccctgtccaggtgattcccaccctgtgtcctcttagttatcactattctgatgtctattcccacaggttacaattgcctgttcttaaagttcacatgagtgaatgtacatatgttttgtgtctggcctttttctccagttacattcattatactcatgagatatatccacgtagtttcatagatcacttctcaattttggggttattgatttcttgtgctgaatattcttataacagtctttgtgtgcacttgagattcatggaagtccttcaattgctgggtcatgacctgagtataagtttaacatcagtataaattgccagtcttctagaatgctttttcgccagcgatgacagttgaagtggcaccaaattcttgtcagcatttggtgtactaactttgttaaatgtagctatgctctcagaccaggctggccaacatggcaaaaccctgtctctactcaaaatacaaaaattagctgggcatggtggcatgcacctgtagtcccagctactccggagggggatgttgcagtgagtcaagatcgcaccattgcactccagcttgcgtgacagaatgagaccctgtctcagaaaaaaaaaaaaagtagccatacactggtgagtggttagtgctatctcagtgtggaattaatttgtatttgcctaatgagcaatcctatgaagcatattttcttatggcttccagcatataagaaactctcctttgcaaaggcctattcgaatattttgccctattttatttggcttagctctatattactgacttacaaaagttctcttatatattcaagaattgagtcttgttttgacgttttttaaattatactttaagttttaaggtacatgtgcacaacgtgcaggtttgttacatatgtatacatgtgccatgttggtgtgctgcacccattaactcgtcatttacattaggtatatctcctgatgctatccctccccctccccccaccccacaacagtccccggtgtgtgatgttccccttcctgtgtccaagtgttctcattgttgaattcccacctatgagtgagaacatgcggtgtttggttttttgtccttgcgatagtttgctgagaatgatggtttccagcttcatccctgtccctacaaaggacatgaactcatcattttttatggttgcatagtattccatggtgtatatgtgccacattttcttaatccagtctatcattgtgggacatttgggttggttccaagtctatgctattgtgaatagtgccgcaataaacatacgtgtgcatgtgtctttatagcagcctgatttataatcctttgagtatatacccagtaatgggatggctgggtcaaatggtatttctagttctagatccctgaggaatcaccatactgacttccacaatggttgaactagtttacagtcccaccaacagtgtaaaagtgttcctatttctccacatcctccccaacacctgttgcttcctgactttttaatgatcaccattctaacaggtgtgagatggtatctcactgtggttttgatttgcatttccctgatggccactgatgatgaggattttttcatgtatcttttggctgcataaatgtcttcttttgagaagtgtctgttcatacccttcgcccacttgttgatggggttgtttgttcttttcttgtaaatttgtttgagttctttgtagattctgatgaaactacagatgagtagattgcaaaaattttctcccattctgtaggttgcctgttcactctaatgacagtttcttttgctgtgcagaagcccttaagtttaattagatcccatttgtcaattttggcttttgttgccattgctttcggtgttttagacatgaagtacttgcccatgcctatgtcctgaatggtattgcctaggttttcttctaggctttttatggttttaggtctgacatttaagtctttaatccatcttgaattaatttttgtataaggtgtaaggaaaggatccagtttcagctttcaacatatggctagccagttttcccagcaccatttattaaatagggaatcctttccccatttcttgtttttgtcaggtttgtcaaagatcagatagttgtagatgtgtggcattatttctgagggctctgttctcctccattggtctatatctctgttttggtaccagtaccatgctgttttggttactgtagccttgtagtatagtttgaagtcaggtagcgtgatgcctccagctttgttcttttggcttaggattgacatggcaatgcgggctcttttttggttccatatgaactttaaagtagttttttccaattctgtgaagaaagtcattggtagcttgatggggatggcatggaatctataaattaccttgggcagtatgaccattttcccgatagtgattcttcctacccatgagcgtggaatgttcttccatttgtttgtatcctgttttattttgttgagcagtgttttgtagttctccttgaagaggtccttcacatcccttgtaagttggattcctaggtattttattctctttgaagcaattgtgaatgggagttccctcatgatttggctctctgtttgtctgttattggtgtataagaatgcttgtgatctttgcacaagaattctgtatgctgaggagtcatttttaaaataaatatattgcaaatgacttttcccagtcagtgaaaagtctgactgaaagctgtcaactgaaaaatcacacaatttataaatttagaagggagattttattttttataaatggttacagcctgcaaggtggccattctgacagacagggaggcataccctcttgctgctgaaacctgaaaagtacgtttccagggaggggaggggggaacagggatttatgttgatgtggtgggccacatatacatattcaacagggaataggaggagctctgaatattcatgaagggatcctgctgcatgcatgctgagtaaacatgcctgttacatgcaacccatgttcattttggggtggagacaacatttaaatacattataattaggccctatgcttcaaaaggggaagcagggacacaaaggcagtcaagtgcacagcctctgtaaaccgtccagaacccgtccacagccagtgctctcttatcaaggggaagttactgaaatcagtctcttgtccaatcaaagctgtagttatggcttgtgtagggagggctcagtcagtttatggtaatgggtgagctgcaagtgcttcagcattgcttatctcaaggccagtgcttgtttagctagagaaaaaaaggaagaagaaaaaaacctgtggcaattggaacatagtttattctttaagttgaggggcgcatgactccaccttgcctggcgtggccttaggtctcgtttatcataccatatcttactactgcaaggagtctgttctgtcagtcttaggatctctattttaacaataatgctggtcagttgtgtctaaaccacaaagggagagagtataaggagaggtgtctgagattccaactactgggcaggaactcagtagttaagacttctctggggtctccttggccaagaaacagtctgtccagttggttgagtggctttggattttaattttagttctcaaagcatttaatttgatgaaattttgccatattttttctttatttttaaagcctgttatgttctataagaaatctttctactcaggatagtgaatgtattctcttaattttatctctctatgagttccagcgttttagttttaatttttaaattgatgacatctaaaattctactcctaaccaaaacattcctgggggtgaccaaggacaactccaaaaatcttccataaatggaagtaagacttactccttgaagaacttactgggatctgggcctgcagggcacagtggctttagtgcacctctgctcttacgactattcagaaattgtctttgtgaacccatcaggctgtttcaaaatcagcaatttagggcttgcttgcaacatgcagttatgcagcagctgttttgtggatctggtgagtgcctgcacgcatagttccccgggaattttctgaatttgaattctcatggtatttcaagtggctcagttgtctctttcttttcttttcttttcttttcttttctttttttttttttgagtcagagtcttgctctgtcacccaggctggagtgcagtggctggagtgcagtggcgcgatctcagatcactgcaagctccgcctcccgggttcacgccattctcctgcctctgcctccccagtagctgggactacaggcacccgccaccacgcccggctacttttttgtatttttagtagagacgaggttttaccgtggtcttcatctgacctcgtgatccgcccgcctcggtctcccaaagtgttgggattacaggcgtgagccaccgcgcccggccagttgtctctttcttttgcctactgccacacacgtaccaccaaatcctgcactccaagctgcttctacaccctggactcccaacctccagttagacaatccacatcttcccacacctgcctcaggctccatcaggctactgtgcctcctgcagcaaccaggccagggggaatctggattcctattacacttctgaggaaggtggtcagggagtgtggaggatgtgggtgggagggggtgaggttgagggcaggagtacactgtggtcttctgtcttctacctcattggcccaggtgctgctctccctccggttgtctgctttcagccctgcctgggaaatcaggccggcgccctgatcttcctgactctcattttgtgaggaacctgaacggatgagccatcgctcttgtcccacacgttctgtccaaaaggtgccctcctctctgcttgctcgggggcctgccctctgagctctggcactcaggctgggatgccgcccagtacagaggctctgcagccctgcaggggtctgactgttccacaccagcaggataaaggccacagggcatgctgtggtggaaaagcattcagaggtgtgggctgaaggcctctctttccacagtccctttgaagacaccatggaagtaggcacccccttgacagacaaggtggcccaaggcctggcttcacatgcaggctcttgggtcccagcgggtcctctctgtgcctggtatagccaactgcttcacgcatcttacccggtttcctctcctccacaacccaagctcctcctcgacccccttgctcagctgtcctcaggacagcaagatccccagcccttggaaaagcccatctctagtgcttggggagggagttgggttcaggtggtctaaccacagaagaacagagaacctgaggcaggaggaaatcccttcccttgctgggtctcttggcacagcccatccaggggtctgggtcagggtccaggtatactctaccctccttgaggacctgggttttcaggcccccgaggttggtcaatgtggagtctttcccactgttcatctgggaactgaaggaatatcccatggggccctctcttactcattagagacacccagaaaatactccatccagcagaaactgggtgcagtgtaccagaccactataattataattgcaggatgtggaggtcagatacgttttgtgggtattttctctctgtctgtggcttgcttgccttttcgctttcttagtggtatcttttgatgagaaggtgtggctaatgttgatgaagtctcatttatcatgtctttcttatatatgtattttttctgtgtcctgcttgttggtaggctaatctttgcctgccaacaagtcacaaagtatccttgaaatgctttatatctttaacttttaagttttggtgtgtaatgcggctgaaattacttttgtgtgtaacgtgagggagaataacattgttggtctccccacatccatatagaagttcattaattgaaatgatttattttcttttattgaactgcttttactgaaaacccatttattgaccgtatagctgtggatcaatttcaggttttctaactcaggctgtttatccgtttgtcactcttgatgccttgtgtctaatagcttatagtaaaccttaaagtcagatagtacaagtccttgttcttttccacacattgcaataaattttgaaatagataataactcatgaaaccatcacacacatcaggatatgctgtcacttcatccctttctgacatggtttggccgtgccctcacccaaatctcaacttgaattgtatctcccagaattcccatgtgttgtgggagggacttaggaggaggtaattgaatcatgggggcgggtctttcctgtgctattctcctgatagccagtaagtctcactatctgatgggtttctcaggggtttctgctttggcttcttcctcattttctcttgctgctgccttgtaagaagtgccttttgcctcccgccatgattctgaggcctccccagtcatatggaaatgtaagtccaattaaacctctttttggtcctggactctgttatgtatttgtcagcagcatgaaaacggactaatacactctcatttctgagtgggacacatgctgtcactcacatatgctggttgctgacttgtgacggaagattctctattgtaccctctggggacaatacatctccagttgcctgcggggaggatgaaccctcaagagtcaatgtgttgactgactctaaatatgggttcctggtgctccatgctcatgcagccatagggaaggaaaggggactatcaagagccaagggatcccccatacgactttactcagatcttggaacttttagatgctgtccaactcccaaagaaataacaattactcactgcaggggacaccagaagggagacacttttattattagaggaaattccctggtggaaagagcagctaaggccacaactaaggaaaccctggtatttcaagctgctgcgctactaccaggtactgcatccgtgtcagtgacaccatactatacccctaaggaaattaaagggactgagtaaaaggcttccagggagacccctctggatggttgctacaaaagaacaaactctattcctgaggctgacagatgggaaataattaaacattttcatgattcctcacatttgggacgggattttccattcaaattagtttcctaaatattcttcgggaagggactgttctaaactataaaaagggttaccactcaggaagccaccccataccccgatccctgcttaaacctgtacaacaccaaggaacataccatggtgaagactggcagacagacttaacccagatgccaccttacagggaactacaagatttgctagtatttatagacactttcaccaggtggatagaagctttccccacaaggacaggaaaagtactggaagtgtctaaattcttaaagaaatcattccaagatttggattaccaaaaggtttgcaaggtgacaactgacctcacttcacagctaaggtgacccagtgaggtcatgcctcagccttaggcattacctgtcttcattcctcatggagatctcagtcttcaaataacatagaaagccaatcgcgacattagcaaaactctttcagtttgggggcttgcctgccctgcgtcactatcattgtttccttgggtttcccaggaatgtacatgtgtgagactgccgccctgcttatagatctgtttccctgcaaggaaacaggaatatgttgcctgtggcttccagagttggagatacatgtagttgcaccactgagggctaacatttaattttggaatcaagtgatgcattcagactggttgctatcattctgtggtatatatttagtgaacacattcatgattgagtttcttgcttttagctggagcaagaaagttttataattgtgatttgtatgaaaaaatcataggcaagggaatggatgtaaaataaactttattgtcagaggtttctaaaggctcatccttcaaggaaaatggacatatgctgaagagctgataaactgtctacagcagtgttattctaacctaatcttgattccaagttcttgccattttcctccagctactgttgactccagttatatataggatgggggaaaggggattatctacgaatgtaggcatcactttctcttgggcagttatcacattggcagactgaagggaagtgatttctacaatcaaactatccatttggagtacaaatctggagtggctgtaaaattcggttctcagagatgaacttgcagattcggactttcaattgttctgttgttttagtttttctcatcaactggggaactgtttgtgactaagctttgttaaaagtagagaagagcttttcataattccaacattagttgttacctgaaacaaacaaaaacacacacagagacaattaaacagtaatctttggtgaggtcttgctgatacctgaggctggagtgagagctgagtggtgatacagctcatgtgcgtgatccagattgcgcactccttatgagactgtaactgatgcctgatgacctgaagtggaacagtttcatatggaaaacatccaccacccccttccatggaaaaattgtcttccatgaaaccagtccctggtgacaaaaaggttgaggacagccaaaaaggctgctttaaatgataaccttccccaaaactaaattacccctgtaaaatgaatgaaaggccaccaagttagaaggatgaaaggggcctgatttctactaagatgtatgcctcgttaaataattaccagccattattccagaagtcacaagattggcagcttccccaattactgctgtgaagaacatcactattgtagaacctaagattggcctcttgagatgtcttttcaggcttttgcatttctgactgctggaaggcaccatctggcccgaaaatcaaccagtcccttagcccccacccagaagctgactccatgcaggagggccattttccacgcccctgtgatttcatccccaacaatcagcaccacgcaagccctagccccctccccaccaaactatctttgaaaaaccccttacctccaagccttcagtgagattgctttgagtaataactctgtctcccacatgtcgtggctggcctgtgtcaatgaaaccgtttcctgcagtgccatggtctccatgaattgagtttttgtgtacattggtcaggaagaacccatcaggcggttacatctgcaggatggtgccagttctttccacaaaggctggtcagatacccagaaaacatttctccactactacctggacaatgtgtctccctgtcaatctccagggaatggggcctggatcaagtatttagtattcagcagttactacactgtcacctaatccctcattttcaatattttgccatgcttccagtggcctaactggccaccatgccacagaatctttactttatgatctccaaggagaactctccactcgatgttttgtgatttgagcaatggaatagaatctgatactggtgggctgggggaggtccctggacactggtgggatctcgaccccagccgtggtgtccaggctcttgacaccatcgtgagaacaaagtcaaagatgagtcagcagatagtgaaagaagagatttattgcaaagcaaaaagtacacactcaagaaaggggagcttgggcatacccaagagagaataatgggttctggggtttcatcttgatgggtttctttaaccaagaattggaatattcacgaaaattcctgggtaaaggtggagatttcttggaactgtggtgccatttttacatcaaacactggtctcagaactgtcatggcactggcgggtgtgtgatttagtatgttaatgagcatataatgagggcctaggtaaaacctccatccaatccagcaccacgttgggtccactcagccttagccagcttggtccacaccctggtttttcagcgtcttaacagcccacagcctcaagtcatgtaaatctgctgcctagaatttgttatcctgtgaccaccctgtagtattcctgtctgaaatctacttgtaaatattcaaatggtctttcacttgggcattccaactttgcttacttcacagtgtttcctgcgtaatatataagaaaagatgatccagacatttgttaaacatctcaaataagatgtagcccaggtatttgtgtcaaatttggattattttggtttcgtctttgcagaatataaaaaactaacatgaggtaagcactaaggtgtggagatggctgtgcaagagatgacaaagtccagcaccacgcttgagagtgtccaatcatctcttctgggacagcatatttttctacaatacggatttttgaaaaaaaaaacaacatcaaaaaaaaaaaaacctacaagattcatgaaactggacaactgtctttataacattaccagtgataaaaccagtaaggacggctggtttgcagtcatctaagcagcctctttactttcataaatatggtttctctctgatattaaacggcttccaattgcaagcggaatgctgcatcacaaggataaggatgtgaagagaaccggtttcttttgtaatccgaaacattctagtctgcgaattaaaagccattatttgaagaaggatgccccggctccatctggccaccgaaaggttgctccttaacacaggctaaggaccagcttctttgggagagaacagacgcaggggcgggagggaaaaagggagaggcagacgtcacttccccttggcggctctggcagcagattggtcggttgagtggcagaaaggcagacggggactgggcaaggcactgtcggtgacatcacggacagggcgacttctatgtagatgaggcagcgcagaggctgctgcttcgccacttgctgcttcgccacgaaggagttcccgtgccctgggagcgggttcaggaccgcggatcggaagtgagaatcccagctgtgtgtcagggctggaaagggctcgggagtgcgcggggcaagtgaccgtgtgtgtaaagagtgaggcgtatgaggctgtgtcggggcagagcccgaagatctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttcaaaaacagaccgtacgccaagggtcatgtcttttttcgtattggtttgtgtcttagttgttaatcctacagtggaggcctggggaataagaagtaacatgtggcctgcacgccataggagaaaaagcgagcatcagccgtatcggctttgtaacacaaattagctatcgtgaagtccgctcagctcttccatttctaccctggctgctttttgcagggattggtccgtggtctccagtctcttgggttctcaccctgtgtgaaaatcttcgtgtttttccctaccccccaagtcacctcttacacagcctctgcttccaagcgcagcccccacaggagtttgtaggatttctgtgctagcggggagtgtgttctcacctcatagagccaggtagaaattatgcagatgggcgctgttctctgggaagaaagcagggcctttggggctctcagtgtccccgttgggttgtagacataacactcttactttgcgtaggggaacggctctgccggcccccaggtgccctagcgcatatgcatggaggcccgcaggtcagaaccgcagtctcacctgtcttggcggaaatgccctgcgatcctcccggagatagaaggcgggaagttttatgaggagccggtccagtttccctactatctcctgcagttcatatatctagtgtttctttagactttaagcgactgcttcatgtttgatgtctcactcccacatcctacatccactgccagccaactttatagatagcaccgtgacccatccttcccacccccaagaagccctttcctatttctggtgccagtgtcctccccagtccctctttcttcaggccctcgcttatcaccttcatggacagaaaatacttagctctctctcaacctgaggtttacacctgacacgcatcagtgccctggcaaattccttaataccccttctcaaatggcactgtaaatcatctctttttaactcccagaactatctaattggttttgtccctgcactacatgaacactagtattccactacagaggaaaaccccaggcctagcgatagcggttctgggcattgtgccagcctctcccagggtatgttttctgacctcacctacttttgatcagctgaggtcaggagttcaagaccagcctgaccaacatggcaaaactccgtctctactaaaaacacatacacacgcacaataataataataatgataataataataattgccgggcgcagtggtgtgtgtctgtaatcccaactactcgggaggctgaggcaggagaatcgcttgaacccgggaggtggaggttactgtgagccgagatcgcgccattgcaccgcagcctgggcaacagagtaagactctgtctcaaaaagagaaaaaaaattagtgcatctgagacatattattggagacagtagaatcctgcgtccaacaggcacttggtgcagatctgaacccattgagctattggctcatgttccctatgttctattaagtatcatgagcagaaattgagctctttggcttttacccactgagtatggctataggacaggtctctctctctctctctctctctctctctctctctctttctctctcattctttgcatcattattttttgccatcagtgtgggtttttggttttgaggttatgaagtgaatttctggggacaatctctgttgggtcgtgttaacaaggatccagtccctgtttggtgatacatgacagctaatctggtctgtgagtcttctttattgtctatttattgtcctgagaataatggcatttcctgatatttgagactgcagcaatgataagttgttcagatcttgtctttccaatgtttggtaaacattttataggcccaatttttgtcaatatctgcaagagtggcatctctgttacaagagtgatcttactactcgatgtcccccctcccacccaacttcatttcctaggggctcttggctttaacgaatttactgtatctaaaagacatcttagtacaggaagaaaactaaatctgtagcatgtaaggagcagttttatttgattggtatattcaggtttctaaccagctgaaaaattcaaatacatgccctttaaggattaagtttaaaccacactacagaaagagaaaagatttatatgatcacatataagcaatggaatcagcaatatgagtacttttcacaactatacaaatcaaatttaataatctccagaacattaaggaagttcagcccttaatggaaatgaatgaaaagaaattattcacccactgttacatgccctggaaagagaatgtcctgccagactcaaaagagtatcacaatattactcagattttcagcaatgaaggccctccgaggatctaatgatgttcatattttcagtttatttccttcactgataaacattgttaatagataccattgcctctgtttgcactttaagtgatgttacttagaacaattcgtttctttagcatgcaccctagtttggtggaaggaattttccttcttttcaaatataggatattttctcatgaaacaaattggcatactctttcagtgaagtgaatagacaaattagatctctacaattgtaaaggagtcactgccccaattatcttaggaacaataataatcacttatataaaattaaaataagaaaattaagccaggtatggtggctcatagctacagtcccagcactttaagagttggagaccagcctgggcaacacagtgaaacccctgtctctacaaatttttaagtattagctaattttttaaagttggccgggcatgataatgcatgactgtaatctcaggctgcagtgaactatgattgtgccactgccctccagcctgagtgacagaatgagactcccaactcaaaaaaaaaaaaaaggaaagaaaattaagaatttgttgaaaattgttttactacaatgctaggctgcatgtcttgcacctgtactcccagcaactcaacaggctgaggcggaaggattgctttaggccagcagttggagaccagcctggggaacagggcatgacatcatctctaaaaaaatacaaggcaagctgagccaggaggattgcctgagcccagaagttccaagttggtcagctatgattgccccactgcactctagcctggataacagagcaagaccctgtgccttatttttaaatttatgttatttttttactacttatgcttatttatctatttatttatttttgagacagagtcttgctctgtagcccaggctagagtgcagtggtgccatctcagctcactgcaagctctgcctcccaggttgaagctatttccctgcctcagcctccagagtagctgggattataggcacacgccaccacgcccagctaatttttatatgtttagtagagacagggtttcatcatgtttgccaggctagtctcaaactcctgacctcaagtgatacacctgtctcggcctcccaaagtgctgggattacaggtgtgagccaactcgcccaggctccttatgcttgaaatgtgaggtttcattagggaaaaattttcttgttgaatttctaacatgaaaaaataatagatttagctgtagattaaattaatggtcctggtagtttggtacaataaaataaatgaagttgatagcagagaggaatctttgatgcttttgaacaatttaaataatgtaatattttttatataaagacatgaaaaagttcattacattattattatatttatttatttatttatttattttgagatgtagtctcactctgtcgcctaagctagagtgcagtggtgcaatctcggctcactgcaaccactgcttcccgggttcaagcaattctcctgtctcagcctcctgagtagctgggattacaggcacacaccaccacacttggctaatttttgtatttttagtagacacggggtttcaccatgttggtcaggctgtcttgaactcctgacctcatgatcctcctgctatggcttcccaaagcgctggggttacaggcataggccactgcacctggcccattacattattttttaaaaatcagtgtgactcttttgacaaattagaatggtttaataatcttggttaggctgggcatggtggctcatgcctgtagtccaagcactttgggagcccgaggtcaggagtttgagaccagcctggccaacatggtgaaaccctgtctctactaaaaatacaaaaattagccgggcatggtggggggctcctgtaatcccagctactcagaaggctgaggcaggagaattgcttgaactcaggaggcagaggtcgcagtgagccaagatcacgccattgcactccagcctgggggggcaacagagtgagactctgtctcaaaaaaatcataaataaataaaaataaagtataaaaaattaaaattacgtgttcaaatacattaaatatatggcaatgaaaaggaggcctagcatgactgactgcattttgctcctaacccttcctaccgtgtggtgacatcttccaggctaactgctttttcttatttctgcacataggccaagctatctatgggagggatttagcttacagtttaactttaaagcacagatgataataatcccttccccaaactaactcctgagaagatagagaggttgtatacacaagtaacagtgttatgctgaagatttataagagaagtgtgacctgacaaaggaccaacaattttcaccatccccttgggctctcactgcagcccatgtctgtcattgtcagacctcttcacctcaatcgcctccttcttcctcccttccctaatgtacaaggagccggaaaatagtattaatttaagatggttcttcaggatgttacttcaccatctgttcagtttggtggctctctggaataaagtcaccttccctgcccctacacctcaactctcgacttattggctgtcatgcagcaagtggtgagtgcagtaagccgagatcacaccactgcactccagtctgggtgaccctgtctcaaaaaaaaaaaaaaaaaaaaaacagagagagagagagaaatttggtttttgaaccagacaaattaaataggagacttaattccaatgagacctagaaatgtctaaatttctaaaatttctaaaagaactgagaaaattgcctccattgaggaagtaagctgaaggaggtagactgtcatgttttctgatttgagaaatattgaggaggctttgtctctttcacctccaactgctccttctcctcctgcccctgcacctgcatagtctttcttacctgagccttcctgtcctgccttgcctcttcttccatcaccatcacctaaggaaagtccccagggatctggtcccttccctgaaacttctgttctgacagcccctttcaaggtaaaacccaaacccacaggaagaggggagcctaccgttgtgtataccacttcaccaaaacgtgaattaagaatattataaaggacttccctgatctaaacttaaatacatttcactcttctgtttctaaagcaggctccaagatcctgtaggctttggcagaaaatttgacttaactgttgaaacctttgagcccaaatattctgatctttatcaattaactcacatgctggtgaagaagggaaggccactaactggttgcaaaaggtaaattggaaggattttcaaaaagggactgaagcagaacatgaaaggttcacattttcaccaaatatctccaagttgccattccccaggtccttcctaaaaatatagattggaggataattcagcattgtactaaaaagccagacaaatctgtctttgcttaactaaaatggtttgagagccaggtgtggtagttcatgcctgtaatcccagcactttgggaggctgaggcgggtgaatcacttgaggtcaggagattgagaccagcctgccaacatggtgaaaccctgtctccactaaaaatacaaaaattagccaggtggctactcaggaggctgaagcaaaagaattgcttgaacccaggaggtggaggttgcagtgagctgagatcctgctactgcaatacagcctgggagacagagcgagactctgtctcacaaagaaaaaaataaaaagaaaaaagaaaaatagaaaaaaaaatagcagggtagtagaaatataatgcacacaagaatgataatcatgaagacaatctgattctacaagagtaagggaacctattccattagagagccaactgaaaacatcaaatcccagttcacaccccagggtgtggggtcacgtgcctgtaatcccagctactcgggaggattagtaaggaggtttgcttgaattcatgaggtcaaggcaggagtaaaccctgatcatgccactgcactccagcctgggtgacagtgagaccttgtctcaaaaacaaacaaacaaacaaacaaacaaaaacccacaaaaccaaacaacaacaaattgccacctcactctgaaatcacagtggcaaacatcactttgctattgacaaattaaaagaaaaacactccctcttgctatcaacctggcctcttgctctaacatgtctgacccatggtttaaaatgcccaaaagctgatgtcctcaaattataatacacttacctattctgcaccagcatttatttttgtctggaggagatcaccatccatggtcctgtaaatgtctaacagcatggaatgatgaagggcagtgtcttttaggatatttggttatatctatatatatggctctgaagaaacccaacactgggcgagttccctcaaacttttcactaggcatgaccactgctgtattttagatagagattctgtggggcaaaacctgagaattatctgcctggctatctagaagatagctccttgcattttttgggggagaacacttttgcttcaagggagtgtttcctcccaggattagaaatctttctgtaacctcaggaaacattgctgatgaaaaccaggcatggtgtgctgtacaacttgtagtaataaggcagaagttaaaaggaaaagacaggttccctgtacttggctgactccaagacctgccatagatagagccctagcagatcctcggtaacacgatctgaaaagtcagagccgcgaggagtgagttccggagactctctcaacacagtaagccccaacaaagataagaggaaaaaacaacaaatgcctttactaccttctctttcccccttcccatttctaattattcaagttttgttaagttcttgatttcccttcagtgcagctgcaaggtcaccagctatacttgcattgcaagacctgtgacagtttgattagctgcctttgttctgcttctataagccctcttgcctgcccccgagtttcatgccatcaaattcccgccgcgccattcaaactagccgaccccctttcagaagtgtctataaagttaagccctgtctttgttcggggctcagcctttggattttcatctgctgggcctcagtgcagtcaataaatcctcctgttccacccattggtctctctgttctcctgattcccacaacagtagtaggggactgcgttcccactttcccctggtctttcatggtatgaataatggacagcatttttttttttcacctatagtcgcaggctcggtctcagtgattgtatgctgtggtcagctgtttttgtttttgtgagaccttgctttcttgtttactgtcctgggacagatgtctgtagtcacttgtttcctcgggaggcaaatttcagtctctgtgggggaggtctcccatgttagctgtggtggtacttggcaggcagagctcagggatctaggcttccgtgctttgtagattgctcaatggtccccaaggcctagtggcttttaacaccacttgaaaaccttagtgtttttccactgtccccagagtcacctcttacacagcctctttttttgtttgtttgactttttctctgagagacagtctcactgtatcttggttgaatcgatcctcccacctcagcctctggagtagcagaggcacgagtcaccacagccggcttatatctgttcttgtttttgttgttgtggtggctgtcttgtttttttaagagttgaagtttctccatgttgcccaggcgacgtgctcccggcgaaggaggccgcctgcctgggggcgggctggagccacgtcccagggctgggggcgctgtgggcactgtgggtgccgcacccaccgctgcccggcactggaggccaagagagcgttcccgacgggctccgcggatgccccgccgcgtcctgctgcccatcctgcccgggttgtcgcgggccgggggcacgacaagaggccggggtctgcccggacgcagcggcctgcagggcgcagctgtccctccaccagccggggtcccctcgctcagcccatgagacaaataaatgaatacataaataaataaataaataaaagatggagtcttgctctgtcgcccagggtggagtgcagtggtgcgatctcggctcacttcaacctctgcctcccaggttcaagtgattctcctgcctcagcctcctgagtaactgggattacaggtgcatgccaccacacccggctaatttttcgatttttagtagagacgggatttcatcacgttggccaggctggtctcgaacccctgacttcaagtgatccacccgccttgacctcccgaagtgctgggattacaggcatgagccactgcacccagccagaagtgggcattaatatgcaggcgccgtatagggcaacatctgtgtgcacctcttacaaatcttaatgctgtgtatatgaggggagtccttcgtgtccccctggggatgtttgaggttgcctgtatgtgttatgtgtgtgcatatttttaagctcagatatgcataggcggattgacacctctgtttgaatgtattcccatgagctcatgccattaattcaccatcacaagaaatatttactgagcgtgagccatgccattccacagacaccattatagcactaagatacaatgaggaacaaaaaatccaggctttctgagctcacactggggtgggggcatggtgggaagacacaggcatcaatgtaataaacagaaaccacgacagggctaagtgttctggaggagaggcgcatggtgtactgaggcccctgacgtagaccccaggtgcacctttgagctttgcttgcatggtttgggtttgtgggctcacctgcatgtgtccatgcatgccccatctgcgtgcccgtgcatggctgcatcaccccatgcacacgtgcactgcccctgggcttgcccacatgtgctgctccccagggcgccaggctatcagcctacaaggcattgtgggtctgggcccagcctgccaccccctacagaggcctgagcctgccttcccaggaggcccaggactctcacccagggcccttccctgcagctggagcaggctctgtggctgcaatctggtgagctggagacgcaagagcccagggggctggtactccagagcgtggagttgcggaggcagctgcaggaggagcaggcctcctagtggcgcaagctgcaggcctacctggagggccagcagcggcaggcccagcttgtgcagcggctgcagggcaaggtcagggccacccattcctgctctttccctcccacgtgttcactttgccctgcccccacccctggggctcaccatcagctcccaatccccagattctccagtacaagaagaggttctcggagctggagcagctgttggagagatccggagagctggagcagcagcagctgagggtgggtgccagggtggggcagaggcaggccctgccctccacctgcccagcctgatgctttaacctctctgccacccaggacgcagagcacagccaagacctggagagtgccctcatctggctggaggaggagcagcagggagggccagggctggcagcatggccccctgggcgagcgcctactgatcccctgtgccccattcaggagtgccagcctggcccaggtgaatgccatgctctgagaacagctggaccaggcaggtttggccaaccaggctctgagtgaggagatacgaaaggtgaccagtgactggactcgcagctgcaaggagctggagcagtgggaggcggcatggaggcgcgaggaggaggtgggcatgggggtgcagggaggccggcgatataagaggaagataatgcacaattatgctagtgagactctcttttccaataatgtttgcacttctcaatactacatttaaaaaggaaataggagcacttgaacggttaagtaagaagatgaacaaaattgaacagaggaaaaataactgtctgaagacatgttgaaaatacatttaaagacagtctgtctgagacaggagctgagctggccaatccatcttttaaatcattgaacatcattcaggtgtcaagtatttgacctggagcctggaaggggaggagagagtccaaaaaaaagtcaaaatataaagaaaaaaaattaaagaacttgtcccacaaatcaggcaaccaaggtctaaacttataccctctgcctgggtaaattgttgttgcttctttctgtgactcttaaaagatgtaccatatacctcatttaatgactttgctttattcatgaaaactctatccccatgggaaaagctgttaaatgaaaaaagatttcttttaagtagaaaaattatgaaaggattccttccaaccctccatacccaaaatatctcaaatgaattatgtatctatcaattatcaatatatatcaaaatataccaattaaaaatatcagttaaacaatacgtcaattgaactatgaaagcaagcttatttaagtagcaaagaataacgtgaaggttagtaagtatagcttatacttaaaatacaatgaattgaaagctcatggcacttcatagagtaggaagaagaaacttaatagaaagtggtagttgggcgagaaggactgcaagggagttatttggaaaatgcattttttatttctgcatcattttgttcacaaattattcctaatcttttgtgaatttgtggatttcttgaactcaaaccagacttaaaaatacagttatagcacagaaaaaaatctttaatggcaaaataaaagctaagcaagagagcctttcaaaacacatgaaaataacacacacatacaaaaaaaaaagaataaagagatgtacaagtgacacctcctcaaccttctcacttggtgtacatatgcacagtaaattattttgggctcagccaagcatgggagcaattcaaatagatccatatgatattctctgattagaaactcttgtggagtaagttggtgagtgtatctttgcctaaaacagtcatgtcaaaatatagcttcctatagcatatttatttagtatcattttggtgaaaaagtggttatacagaatagaaaagagttgtccaaaactaagtggttgacctttccagagccattacctgcagaattgttatgtaagtctgttccatactcataaaggaatactcagctgacccaactgattttctcgtgttttttccttcaagggctagtagaagtctatatgttgtggtggaaaacaacctcagccctatagtccaacatttgcctatcaaaacttgtcctatgatttataaaactagaacctcactggtaagtcacattcctagagtctcccccatccctaaccccagtcacggaaaataaatcaaatcattgtcactctttcttaacaaagagcatacatttaaaacttgagtaaaattacaggtaccgtctgggtccttcaagggggaacttgaagtctcaataccgcagttgtccaatcagaggatccaagatgaatatactcaaggactttatgcttggcatcctctggagacagtacataaccaccagcttggtttaactggagattcatttgggttaggagaaattatgtaggcaatgtacttagtcaatggaggcctcatccctgaagacttacaagaatctgaattcgtatgttacttttcctttaatggagtggaattccaaatgaaaataatcaaacagcatgtgcataaacattagatataatacccacatttacaaagcctttatagatatgcaagtgttattgcgtctgtccctagcttctgtacagaatttaatgggtagctgttactattttattgctgtataaaaatgaggaaactgataagttgtctaaaggtgcacaatcaaaacacatcaaagccattgtgaaatacaggtccccggatttcaaaaacagatcttctgcttataaattcagtctttttcatactgccataaactccagaatgggaaaacaaagttactatcagaaaagcttcttttagctgggcgtggtggctcatgcctgtaatcgcagcatattgggaggccaagacaggcggatcacttgaggtcgggagttcgagaccagcctggccaacatggtgatctctactaaaaatacaaaaattagctgggcatggtggcggacacctgtaattccagctacttgggaggctgaggcagtagaatcgcttgagctggggaggccgagatggcgtagtgatccgagatggcgccactgcactccagcctgggtgacagagtgagccgacatcgcgccactgcactccagcctgggtgacagagtgagactccatctcaaaagaaaaaagaaagcttattttttcccctaatcaccataatattcactattaagtgagggaaatagaaataatttatttagcaaatcctttctagttcaaataatttgtatacaggctgtgcaaacataataatgagattctttttagtcatcttgctttatatcactaattacactcttatttaatgatattttaaagaaaaacgtgtttattttcaagtagaaaactcatatctgtccaccaaggaaagctgtaacaaatgtaaaatacataaaaaagataactgctaaatttctaaagcattccagaaaaagacaaatagaagggtgtcagattaggaaagtatgtcttgtaaggtgtaacggacagactgatgagcttagagatgtggatctcaaagtggttctcagagcaacagcatcagggtcacctgggaacgtgttagaaatgcagattctcaggtaccatcccacatttaatgaatcagaagctcagagtagagaccagcaatttgttttaacaagtccttcagggattctgatacagctgatgtttgagaaacactagctttaggtaaacgtaagagggtcacgttagtatttttaaatcattggaagttggtttgttttgttttttcttaagtgggactcatttatacttcaatacacagaatggatatttagaggaagtcgtttttgacctaacacggatgagcatttccaattgaatagcgctttctgataatggggctgcccactacaagtgaataactgggtttctctaggctggagctgcagacaggtcactatgtgtatggaggattgtattaatatgatcgtggctctttatagctctgcattactaatattctgttttaaagtctctcctcaatatccaatgtctctgtgtgaatgatggtaaggagtgggtaacagtaacaatcatcctgttgttgacaacagatgataagagaaagcccaactttacactctgtataaccttacaccaatgccccattcctcgtctaattttttttacatgttaacacatgaccttggcattactaaataagaagccctctcacttagaacccgatgcagtatgataaaaattattttgagaacaatcaggagctctagttttcaattctgcttctcttctcaagtagttctgtgccttagtttcttctttgtaaatttaaatggttggaacagaggatctgttaagtgtgattcaagctgaaattgtatgtagcccacactgagtttctctgctatacccctaacccattcaacaatcacaccaccagttttcaggactcacagtaggatagccgtctatcatttgttaataggtgtgctctttcatccaaacaagaaactcatgatttctgcagttttttattctagccaggttctaggtgctggcctggaactataaaacgaacatttcacaaaaagttatgacaatatacaaaggaaagacaatttctttgaatatccataatctcaatatgcagtctggctgtggatggccaagagatagtttccttaactggaaaaagcttttaaatgaggcttggtggaagatatatctttgcatcattacaaagaagaaaaaagagaaatctcacaactgaagaaagtgaaatccactttacttaatgcggacctctgtctctggtgtgcaggtcctctgtgtccaaagataattagcactttataatgctaattattataattaggtctgagaaaaaaatcattagggggtaggcccgttcactgattttcaactgccccctctatttaaaaataaggtcatttttctatgaaatacctttaggagctcaaagcagaaagagggttatagaaaatcctgtgtaggtataagcctgagtttttaatattcttataattctgtgatgtgtctggaaactgaaccgggaggaaaacagtgaacctatttagtccaggagactagaaatcaggactcagaagagtaaacatttctgtaatagttagtcctcaaatagtcattcattgaccttccactgggtgtctggcaatgtgcaagctgcttctagatgctacctcatgtaacaaccatcacagttgcacagagcaagtactagtactccactttcatagataaagaagtaaaatcttagaaattagctgcccaatgtcatgtatgtaggaaaggaaagctggattctgattcatatttgctggctccaaagcacttgttgtaaatacttcactatcctgtgcttacatgtaaatgtaccatttctcttaggggtcttgaaatactgaaccaaagaatggtgtaggggaagggcagtttagaaatacctggaaatttggttgtttgaaggaagcccactctcagatggtaggagatcaagctaacagaatagctgagaatattttctgaggccccagaagtataaaaacggtctaggggggaaaatttgggacacagagtgaaaatagcctgcctctgaagaccagcttcatttcttcccctctgggtgttaatgaaagagcctttaactttgccaggcctcagttactaatttctaaaacaactgctgctactattactacggatcttactgctactatgaccaccaccaccaccacatcagttactgagaactgaactagatgccaagcaaaaatggtaaacacttcatatacattatctttttaaacacaaaatgtactattaatccagttttacatataagaaaactgaggctcaaagaggctaagtaatttgtatgtgaacatgctttacactatgtaaaacaccttattagtagatatcactattattaagaacctatcagccggagaggaagaattggccttttatctttctaagatgcacagttgtctttctgtttaatggttttttaaaaatccccctgtgacaagctccagaggacaaataatttgtttcttgtggtgtatggctctctaaatgaattaattgataggcatcccattgtcagtctcagggatgtggaaataaaacagacatgagatgttttttaccaaactaatttgtgctttaaacacataaataataaatatatatatattaaagtaaatgtgtatttaccgtctctcctgctccactttgaattcaagaacccgtgtctttgttgggtcactgcactgtcaattgagaagtttggttttgtttctttgagtgttagtaagtggcattaaatggtaaatattgccgggggaaagaaaggagaaaaacagctcttccaatccatccctgtttccattcaattaaaggagggtagaaagaatacttaagataattgtaataagtctaatagaatagcaggagccactcttttcctttcagtaggccattagctcagaactattttcagagtaatactaagatgatatttgccttttcactgtgttggcacttgtattgataaggcaaaaacagtggagtcttagcaaaaattaagaccatgaaaacaaactgcactaggaataattctcttcttcattactgtttacttgcagggggaaaaaccattttcgtttaagaaagtccttggtgaagtagtaaaaatattaattttattaaatctcaaccttgagtacaagtcttgtccttgactgtacttacaagttttgtcctccccaaagcatatggcgtcaaggctgggcctaacccagtctcatgaccttgtgaatccagtccacaaacacagagacacgcgtgaagacggctggccagcgcgaccttgtgcatactcggttggggattctaattcctttcaggacccagcagttgtgggtaaagcaggcaagtgggcccccgtagtcaccctggcaggtaggagaactgatgagggccccgggccacagcaatgactagcctgcttcatgataaaatagttcatttctagccccccatacccttccagggctggcccagggccctgccaccaacctcacaggcccccacaggggccaacagtccctcagtgcacatctcgctctcccgcacatgtcctcggtgcttgatgttacactcctggttggagatgacgttcagcaaggccacatttaggactgtgtcattacccgtacctgcagtgaggggaatggggagaaggagacggtcctggaggaagatccagggctgggcctcctggccaccagcagtcctgtgcactatgctcttacctttggtctcaccccagcctgcaatctcacacttggtccctggaggcaccacataccattcaggcggcaggcagatcagggccacacgctggttcagggtcacagatctttaacaagaatgggggcactcagggtctgaggccacaaggctcagccccacctcacatcctcccaggttgtccacatacctctccagcttgagcaggacaagctgggagcctgagggcccacacagcatcttggctactgggacccgctgtaggcctggctctccatgttgtgggttctggaacagggtgcccaaccatacctcatagcccgtgagaggcatatggctgggagagaagctctgctaggtcatttgtgactctcagtccgttgccccaaggctcacttgttagcttgcctggggaaaggggaaagtgggatgagactgggtccccaaacacaagggaggctcaccaggaggagaagcactgccgggcagtcagtatccactgctcctttactagagaccccgcgcagaaatgctggccctgcctagaggagtggggaattaggacagggaacagactcctgggacagatgctagacctgccatcttctggctaggacctctgggggcagggatagattcccagcccccagtggcataaccacagaggacacaacctcagctcctctctgtgggagacaggcagttgtgcctcaccgattccgcaagctgactgtccagggtgagttgcccggatggcccccagccacgcgcagcttggaacgacgctgatccagccgatccaccctcttgccacacttctcaaactgcacctggtctgtaggatggggtgggctggatgaaacccagactgtgtggatgtcgtgggctaaagggcctgacccataactggcccaactcgtaacctgggggggtccaggattgatggcggctggtcatcagctgaaagacaaagttcactggggttaagggagccagcctttggtggtgagggctgaggtaaggtcatggggcaagcgtcactagtgctcaccgcagcgtcgcagggcacagtagtcgaatggggtccttgggtccatcgtgtagcaccagggcccatggctatccccatctgggtctggcagaagttctcctccagttgtgcatgcggttcggaggtaaatgtgaaccgaggcgggagcgggagcaaaatcgtggcagggtagtctcaaccatttccaggctctggtcccagacatcaaagcatgccgccccagggttagggccctggcggggccgggagcaccagggactcactgcagcttgtgcggcgtctcagcggaccagcgctggcactggacacccttgcgggtcttgctgaccgtgccgcggtactgctcccccgcgccgtggtagcagtctgcggccggtgcgggcagccatcaggccgagacctcgccccggccctccggttccaggcttccagccccggctctgtagcccccaagcttgggcctcaccctggggccgcacgtcgtctgtacaacgccggatctggtagcaaaagcccacgcgcgtgccgggccgcagggtgaagcaccagggcgcctctgagccgtcgaggttccagcagaagttctcccgaaggtctctaagcaggcgctccactcagccctagcccgccagcctccagccctaagcccgtgactaccctcctcccgtctcacccgcagcagcacgtcccaacgcccgcccccccgcccacctcacttgcacgcgtatttttctggcgtaaatcggtgctgatgtgggatttgcgcgtcccaacgctggcaaggtacgccgcggtggtggtattggctgtgccccggtagccctcacccttcccgcggaagcagctgacacttgtggcctcttggcggggctgtgcctcggacccttagatggaccgagataggtcgggccccgagcgacagctgagatccctctggggctgggaccaaacccgcctttcccaggtgtacggtactccacgggatatgctctcaggtcacgcccagcccctctgacctccccggccaagccacgcccctccccaaggttcccaggtaccctcccaggcctggtccccgccgcctaccgcagcgggggaggtcacagaactctcgctcgatctgcggatccgtagtgtagcaccatggccgctcggagccgtcaggattccggcaatagttgtcgtccagaccttggtcgaggaacctgggggcggtaatggggcgtgaagaagaccctggtactctggcttatctggccccgcccagttgccctacacggagccctgcccctggagtcctggaccttccctagcccggcccccagggcgccgataccgcctacgcgtacttgcccggctcgaaggggtgctggtgcgggtgctgaagatcccagcgctggcactcgcgccctgactcggtgcggtctaccgcgccgcggtattcctcgccattgcaccagacacacgcggctggagacaaagagccagtgggttcgtggatgggcgtgggcttgcccctccactctcccagcttgacccggcgccgcttacccacccggcaggatttgatgctgcagctctggaagcgcacggcagggtctgttgtgtggcaccaaggacctccggggtcgccatcagggttacggcagaagttctcttccaggccattccggagcgtgggcatgtacctgagggcccagagcatcactatagtgtgtgctgggggaaggtcccaggccgggacggagggaaggtgtttgtctcacttgtgatcgttcgggaacttgtggctccaagcctggcaggacaggccacccacggtcgtggccatggtgccccggtacccaaccccattgttcatgatgcaggtccgtatgtagtctgggagcaagagacagaagatcaacttgggctgaggtcccctgtctcccaccctgcccctctccacccccactcgcctttctcctggaagaggtcacagcgcccagaatgccacagccttgagtggggcgagtgttgagtccatggcagcagttggcaaccatggctgctcacattgtagtggaacgccctggagagaagaaggcacagggtaacgccacggcccaggctcccctgcccccagtcttatctaggcccagtggccactcaccagcagtccattaagggcccacagcgaccagcacactcttcagcatctgccacatcctcctgccaaggcccgggcaccaccgcatgtagcaggtgctgtagctctgtgccccggagcacctggaagtcattcgatggcgagcgctgccctgcagagtgggcatgagtgggtgcaggtcaggtgggcatacatgtcagtaatgtgtattggcatgtccacactttgttcattcaggggatcaaagctacaaggcttctgggatggaccctgtatgcactttcaagggccagtctagcccccctgcacagatacttgtcaaaaaaatttcccctgggaagcaggcccagacttggtagttatcaccggtgcctctgtgtagtggcccaggcactgggctcagatctaacacatacgctctgtgagagcagtgggtgatggagcttgccccatctcatctctcaaatgagaatgctaaggctcagagccatcacattacccagccaggggccctggctaggcattcagactccaaatctgggctctcacctgcacaaaggcatacgctaggttagaggggtagatcaggctcaggaggggtcatttcctgctgtgtgcgtgcatctgtgtggtcctaacactgcttcagtgctagagcagacgtgctaatagaggcctaagtgggccgtgtctgtgtgttcctagggcttcccagctgtgctcaagaggccaaggtcactgccccatgcccactgagcctctggctccccgacttttttctcatcccagaataggagaatagggccaaccccctcctgaaggcagatggggatcagggttgggggcactcaccagggacccctaagtattgagtcagaagcagcaggagtgggagccactcctccaggatgacttcatcttaactaattatatgactatgttgactgcaacatatgtatgaagtttcatatactcaattcctttactgcttccttgagcctatgaaccccctcctgcatctcctagtcttcactgaacattatgtcaattctcagcctcagctctaaatgctcatggtttccaaaaacatatttacaacccaccataggtcctgagcaccaaagcctgatgtccagttgcccagtggacagacatctccactgggacatctcataagcactaaaaatctcaatgtactgaaacctgaatttatatttctctccccaaatgtgctccatttccatcttccctttctcaacatccatccagtggaaatgttgctcaaacccaagtccagagccacccttggcacgctcatcttcctgagccccccacttccatcggccacccaggtgcttgtcagtttgcccactttctccctctccacagcccttttcctagttcagaccttctgtctcccttgttgggatcatgtcaacctcttcctcactcgcctctggctctgggcttgtgccttcaaccgactcttcaaaccgtagcaagagggatgcctcgaatcacagatcagatccctctctccttaaagccctgcagcagcttcctgtggctctcaggatagaattcaaacacttccaggatctgggcatctcctgcccctccacagccctgcctcgccctgcattccagccccaccaaaccacagtcagtcccttccatggttttggatctcttgtctgggaactttgcacctgctgttctctctgcttaaactctcgctttcacccatgcgacctggttcactcctcattctcctgcatgtctcagcttggaagtcacctcttccagaaagccttccctgaccctcaggtccaggttagatcccccacctggattcccacagcaccgtgtttttcccctaccacaaccctagtcatgccctttagcgaacagccaacagttactaagcacctgctgtgttaggctgtttcttaggactttataagaaagatcacatttaatcctacgaagtaggtactgctattatcctattttttagatgaacaaactgaggcaagagcagtcacacacacatagagtcagtaagtggtaaagttgggatagaaaccaagacaatctgactcatggatgttacaccgtgtgttagaactagccttgaaaaaaagacacaagcttgtgccctgtgccaagaaagtttctgataatggtggcggtggtggtggtggtgggatttaatcagttggcagaagtctgtatttctaacaatctctgattcaaatgggcaggacccatgtccatttctctttattgcaattgtactatgtttcttaccttcactctgcaacaagcttggtgaagacagagaacatgtatctgaggcccttcatctcccctcagttcctagaccagcactagcccatagtcaaccctccatcaaagtagagggagaaagtaagtggcttttaccctgtgctttctgaactcctgggatgctaggaagagccagaaaaccttgtccaccgaacccacaaattcactctcttcatcccttcctcactccacttccttcccagtagttgttggagtttttgaattttccctctgtgagcccttgccctcccctgccatgttctcagcaaaggccctggcctccaggtccatgagaacaggattccctgtagtaagagctcttccctagcctcctccacttccaaaggggctggaatcttcaccccttgatcccttccctttttagagcacagaggaagcggagccctcctcctgccctgggctcccatgccccacatgttcctggagagcacccttgggccactgttgtaactacatggtgacttgcttgctctcatccttcatgaccccccctcctcccatgccccactttgttaatttcactctcctctcaaaactccccacagtgccagtgatggggtataaatgcagctgggcaacgaggctcccacagacagacccaaacctatcttccaagtgttaatttcttttctctcctcttcttcaaataggtctcttccttacacatttctgccattcctttctctctctgccttgcctctcccttttctcccggccacagccttatccaacctcccagcccagcttggactcagctttcctaggaggctcccagacaatccagtgggctctcatttttttgagtgtattcagcagttggctgatgctgcatctccagcacttgccctaggttgttttatctccctaatggcctgtaaaccccttgagggcaggatctggcctttgtactctaaaaaggtcttcctactagagaatgctccacacatgtgtgatgcttcggggagtcccaaccttcatcagagattcccactggtgccagctcatagctcatcatgacgtgtcccagatggtgactgggagtagcctatgccaagcaggagtttttccccgaagtcttcctgtttattgcaccgggctggctgcaagacattgaggatgctgccccaggggccagcagggtgactggggcaggcgccatgatggctgtgcctgggtgctggccagtgtggccccaagaagaggccgggagccagagctgcatgccctctgtcagcaccagcctcctaaaaacactctcgactttctccaagcatggattgcctgagctcccctcctgctccccaaagaggccggggaacaagtcagacaggggataagtcagacaggctcagctgtgggaggctggaggaaaaagaccaataaaactgactttatttgtaatgttcccatgtttgtgattttgttatttctactctgtttcctcagagcaatgaaacaaggaaacggaacaaaaaataacaaaacccagctctaagtatacgtgaactgtaaggcctccctctggcctcctctcttcctccttcctcaccaggtttgcctggctgacccttccagccagtgaattcctttcccaggttgagtgttttccattttaatttttgtggcatttccctggattaatggttaacgcattcattttctcccctccagcctccattatcaaagagtgctttgaataaccattaactctctggttaagcgaaagaaacacgttaatcatctacaagtcctggggcaggaaaattattcttggtaaccttctcccaatggcaagaaaaccactgtccctgagcagctcaacttcagccacacctgggtctacaagcttgcaaaacccctccggtaaccttgttacaaggacttggtaaactgaggtcataaactgctgaatggctaagcgctgtgcttttcaacccagccaccaccggttctctaggaccctataaagagacaaggctgggctgctgcttctccctttacttttaaaaattgttttgccagtaaagtctcatctattgtacattccttgttacggggaaactcaagtggctgtacaggctgttcttggagccacagttaaaagcgctttgactcaaacacacatgtggcgtcatcctgagctccgtttgcgtggggccggaacaccggactaggaaacctctccctgctttagcaactgagtgtggctagattgagggaccacagggggtggctctggatgcagcaatccaagtccccttttcagggagggtgacctctttccgaagttcagtggatggcccccttccagggttagggagacaggaggaggaggaagaagaaaaggaggaggaaagctctcaacagccccccacccccaacccatccaggagagaaggactgcagtccccgagaccagctggaggagtggcgtgtgcatggtgtgccctcagggtagagcgcgccatcttggagagatgcctctttcattcacaaagcggatctgttgcagagcccagagccccggggagagcagggcggcgtccaagtgcttgctgggtttggcttgcactccctctcccttaaagaagacagaggcggaagggagaggctgttcttcggaggcgagcctcaggcactgctagacttagtaggaaagatattgctggggtcttggcaagccgtaggtgcagcgctccccatcgtcattccggtgcggctggttactgtcaccctgcctcctccccgccggcctgagagcctctctgttccagatccaaacatttccacattaggcagcctgcatgtgcatttccctggcagtggagggaaaggcacccctgtgacctgggatgaccgacgacggggacttgccctcctcccccacaggtgcacttgctcttttctgggccagccttgtgatctggtgtccgggcacttggcagcatttagcaaatgttcctcagtgctctgtttggtagttaatgctgttgacacggacacctttgggagcacgtgggagaagctgctgcctccgtttcccccgggttacagcgcctggcgcagtctgttgtcccctcagaagtggtgggcgacattatctcctttttcatccctagccctctcccttgaagctgtcctgatctctcttttggacccaggaacgtgagcagaggttactactcactatatatacacactgcatctagactcatgcatgccttcttggtgtcaaggacacctcacatttcaaagacttcatgaaaaagaacgtgaggtatctcacacggtgacatgataaagctttggacaacgtgggttaagctaaaaacaggtcattacaattaattgtatctctgtcttttgacccttcagtggctcctgaaatccatcacacatgtggcttgcaagtattttggtcggacaacgctgccgtagattgtcccactctgaaatggttccctctgggcttacgggactgctatagaagggtcctaaggtcctgtgcctccctgcttttcaagtggctgcaaacttctgtgcctaccgcttcctccactggatgtttccttcctgccctcctccctgaggacctcctagtccctcttcaggatgcagagctggagcctccactccaggaaagccactcatgttgttgccaacacaaccccctgcacacatgcagtattaggcattggtctgcctggctgtccctgggctgtgctgtccttgagggcagtttttgtgtctaattcccagagagtgcaagaacacaagcatgctcatccagacgttagtaagctgccctaaggggtggagcagtcagattccggttttatttatttttcccctgcaaggagcaatcaattattaaccgaagtcacgatactttggttgctgttatcagcacatgaaaatatcagtcaaggctgggtttcagacccgcctggcactattcaaaggaaattttttagtaattcttattttattaagagcactagtatattcagatcaagtaaaacttcacatataacaggttcactcttctatatgaaatgtttgtgggaaatctatcatgcatcaggtgctctcaaaaggtggtgaggtgtaaatgtcagcctcaaaggctgcagtgtccaacatggcacacagcttgtgtggctcttagcacctgaagcatgcctcgtccacagtgagatgtgccgaaaatgtaatatacatccagattttgaagacttggtaaaatatctcaccagcaattttttatattgattacatgaggaagtgataatgttttgggttggttaagttaaacgtattattaaaattcatctcacctgtttctttttaaaagtggcttctagagaattttaaataacatgtagttcacattatatttctatgagacagtgctgctctaaggcgattatgctttgtttgttttgagacactcacaggtgtatgtgagcatttcaaccgggtttataacagcttaggaaactgggaactttgacttggaactttcccgccaagtgacaaaacatccgtccagtgatagaagttttaattctacttcctccagctagatcttgcctggaggacccacgttgacttactctctccagaaacggccccactggctctctgggggaactcctgggttctgcagggacttgctaggtagtaattacaggtgtgtagagaccctcctgcttcatacgctcagtcatcattatttacttttaccaggcaccaggggcgtgatgagagcttagctgaaaggagagaagactcagcaagcacatcaccttgaagctgacctgtcagccagatttcgcagcacctgcctgttccagcctgaggggctgcgattcattccttgggaaagagagctgcaaattccctctctaggccacagtccaaatccttgctcttctctctcaggttctggaagacagaatggaggcatctacagagcaaggacatgttttctacctgaattagcttttctgacaccttgaaaccatctctaagaaattgattttttaacatacacatatacaggtaaacatttaaatctgtgccataatgtatttgcacttcgagtccccctgaagtcctaagtcacatgcttctcttcctaggggttctgtctgaagcagagacccctggattggagcagtgggaagaatcctgatgaatcaggtgttcctgcctgtttacattaactgggcaccctgcctgcccaccccacatgctgaatactgctggggagaagagaagaaacatttattaaaggcaaggaaaaattagagccttttcattgaggtcagaagatttttgaggttggatcggctggccaggtgcatgaccaattttcttggctccttagaagcagcaaagtatttgaaaaataatggagcccttcgtcctacaagtaaaagcccatttatattgggaattttttaaaaagtgctggcgatggaaaatttccgatgagatgcatttcttcctgcctgaatgtcttgaatgcctgctggatttgtctccctgctaagacactcacacttgcaaatctgtgcttttcaaggtggggagatgaaaataaaaagtctgtgacatgtatttctgggaggcctgaaaacaggaagcaaattggaaccacagcatgtggggcacggatgctggattctgggggatatttgcttatttggaaaggctgcaaacattccatcctacccactgctaggagctctgcactttgctaacgtcccatggaaaccaaggttctctttaggactcgacaggactgggttatttttctcagcttaaattgtttttatatggttatcctcagtactcttttctgttttgggatattttcatactttttattttttaaaaaccccagaatatcttgattttgaaaaggtacattcacccaaataaagtgcccagcgcatagacaaggctgcctcaatatttcacgtgtcaacagccaatgcccccggtacgtgcagaaaagcctgagaacaaggaaggaagaaaagggtctggtccttgctctgcgggtatttaagcatttctcagccccctcctctgacttctcaactatgttcacctatatggcctcaaatggagagaactggggttataaaagaggatattagctatgcctgctatagaatgaggaaggcatttcaggatgtgcttggggaggagatggaatgaatggcaaaggggatgtttgtccgtgagggtggtctgtgatctgtgggtgggggatgtctgtgcagctcccttcatggcctctcatggcccacacagtaggcagtgtttgccacacacagaccctggacaaagtcacagagtggtgttggtaccatttcataggaggggtcctaggggacattctaggaagttcttcatcagcttaggaaggtgcagcctctgcagtcattaaacacagtctaccagccagagaagcccaaaagctgctgctcctgctgttctgcgtggtgtgggaaactacggcattggcacaactttgggagctctctttgatctcttgtttgtctgcatttcccatactcttccagtcaccaagtgtcatcattcttccccaggttgtctctgtctcccttccttttctgtccccatgactcttacctgtatccaaaactatggcgtttaaggtgaaagagccagtctgtaggagctgcttcgaggaaagtcttgcaagactgccttcttgaacttggtgctcaaactcccctctggcttcacaacctgcatagttgcctgggtcagaaacaggttcctcaggcaacttggtgttgcattaaccaagtgacactgattgtcacttggaagacactcagtgactgactattagagatcatctgcctctcattttggggatgtgaaggttgagactcagagaggtcaggcaacatgtctgaggtcattgagccaactagcagcagccccagagttgtcacccagatttcccgactccccattcattccagaaaacctacccatggggaatgttctgccaggctgttctacatcaccagtagagagaagttgccttgagtattcggtttggttttgaagttaacctattcagacacacttgagcatgcagtgagtcactgactggattcattcccagacctatggactcagcacatcagctcaccaagcctcctgcatactctgcttctacgctggacaactgtgcattttgagaagctggaggaaattgtttggcatactgttctaggccagcagtcatgcgatactgagctaggcctggctcctataggctggtgaaagccaagtgttaactgttcaggatttttttgagttggttaactattgatagcttcaaagtcgccatggcaggggtatttataccatagaaattggtacatgttacaaattagggtttcatttttcaccatccagagatctgatttactaactcactactgattctgaggtaggaccccagcttaggaaggcactttcaggcaagactgttctgcggtaattagaaaatggagagtggccctgtcagatgcaaaggagaatatcaaatttggaaaaaagtactgcctattgcacaagaggtaagagtcactgagacatcttgcaccagacccaagtgagggatggaaggggccctgatggtcatcttgggacagcttcttagggtcacccaggagcccaggagccaggtatgccactccgtggtgggacagaaacccctgtaaagagcaagcagacactcagtcacccaggaccctccccaacactcccattccctgcaatctatcagcgcatcctatcaatcccgtctggagtagatatctgatcatgccttctctcccttgtgactgccatcacccaagtccaggttcctgctacatccttcctaaaaggccttcccctgcaagcttgcctacctcacatcgactttccccacatagctgcaaaagtggacgtctgagaagaagggggaggaagaggagaagaaggaagagatgaagaaggcgaagatgaagaaaaagaagaagaggaggaagaagaagaaggaggaagagggggaaaagaggaggagatgatgttatgtcatcccttcacccttcccctgcacacacacacacacacacacacacacacacacacacacagacacacacacacacacacacacaccacgaaaacccttcaagagcttcccattgtacttagaataaaatccacgcttgagtaaagctctgcatgatttggcccctgcaaacctctccagcctcctcttgcttgggagcctctgtgctcacaactctcctgtcaccctggtcttcttccaggtccttgaatgccggctaagctctttgctgccccaggaccttcgcacctggtcttctactggcaggaatactgtttcctgagtcttcccctgactggctccttcatttcctttaggtctcagcttgagtgtaacctcacagggccatttcctgctcacctggtgaaaagtcaggcctcgtctgttctctgttttagctcctaagtttctttatgacaattatttcagcccacagttcttttatttacttgtctgcttacattttgttttaatcttttctttacttccccccacttcaacagatgctccatggagaaatgggttaaccactgcattgccagagcctggcatataggggtgctcaaataaagacttgatgagtgggctgggtgtggtggctcacacctgtaatctcagcactttgggaggcaaaggcgggcagatcacctgaggtcaggagttcgagaccagcctggacaacatggtgaaaccctgtctctactaaaaatacaaaagttagctgggtgtggtggtgagtgcctgtaatcccagctactctgggaggctgaggcaggagaatcgcttgaacctgggagacagggattgcagtgagctgagaccgcaccactgcactccagcctgggagacagagcgagactccatctcaaaaaaaaaaaaagttgatgagtggttcattctactgccaccacctatgggaagacaggtcaggaatgttgaaatgaaagaagtgcttggcttcctctgagccccagctggacacaggcatctgtgatgcatccagattcaggctgctcatggactctgaggactcaacgctcccggagggctagcagggagctttgcacacatacaaccagttctcaccaagcaactggggattaatagtgcaaggggttaaatgggttcaaactgttcctcttaagctccccaagatggtgaaccgcacttcaaagctgcttgaaaattcttacttggtgagcatgctgttctgtgtcccttttgggcagaggattgggaaggcagccaccaaggccgcctgccgagtgaacagggggagggggcactccaggtgacgtgtgtgcagagacccgctcatgcctgacccacagttagtgcacgctcacagtggttccagtcttgtcccagcgacccgactggcctgctttgttattggaactagagctgatgattcactttaaatagatccttaacctcacaatttgtttttcttgaaacggtcctgagaggtgctttccaagaaacaaggaaaaaactgactgcacagtggtgactttgagtctgtctgcagaaagcagtgtgagtggatggttcattcccatggcaaagcctttccctgtcacccggtgtcagggacagtgaaaaaaacgggccgtagcttgggaaacaggggtgctctgcagttgccgtagcaggtcttcagggagagcttacgggaacccacggtgtaggggcgggggagggggactgggtgtgttcatttcccggggatgctgtaacaaattaccacaaactgggggccttaaaacaacagaaatgtattgtctcacatttctggaggctggaagtctgaaatcaatgtgtcgcaggaccacacttcttccttgccgctttctggcttctggcgcttgccagcagtccttggcagttctcggccggcggttgcatctctccagtctctgcctttgctgtcgtgtggccatcttccctctgtctctgtctctgtctccgtattcaaatctttttctctttgtgagaacaccagtcattggatttagggcttgccctaatccagtaggatcttattttaacttgattacatctgcaattatatcctattttctaatagggtcatattcacaggcatcagagttaggacatcagcatatcttttggggctggggactcaattcaacccaccacaggagaggtccccttgctactaggcgggtagtcatatcacacgcacatgtcgtaaacatgctgagcagacgagaacccaaaatctctgatttgggtaagatgtgattccaaaatgtagagtgcagaatttactaaaacgttttgaggcttagagtaagagactgctgcagtttaggaagacttcctcattaaaagattccaaaagacatattccatgagtcaccagggtagactgaataatgagcgctcaaagatgtccgtgctgtaatcccgggagcctgtgactatgttaccttgcatgacaaaagggactttacagatgtgtttaaattcaggatttgagatgagatgatcctggattctctgaatggatcttctaagaatcacaagggtccttacaggagggaggcaggagggtcagagttagagaaggagacgtgatggctgaagcagagatcagagcgcgaggggttggaggatggagggaggatctagaagaggaaagcaggcagcttctagaaactggaacaggcaaggaaatagattttcccttcagagcctctggaaggagctgaccctgctggacgcttcaatcctagcccggtgagactgatttttttcttcatgacaagtcagttgatgttgttttaagctcctaaatttgataattggttacagcagcaataggaagcattgcagtcacatagcccagtttggcatcttgtattattttaacaaactctccatcaatccacctgtgtatcattttagtctgctaacaccaagaacaatatgttgcatgtggaagaccttaataactacttgttggatgcatactctgagagcttattatacactcggtagtatgctaaaccctttggatacatccctgtcctcctatctatcagtgtggaggagaattggacattgaacaaataattttacaaataaaacagacattgatttatgtgacaagtgctgtcacagaaaaaccacagggagacatgacagggtagagtcggggaaacctaacttcaacgtggggtcaggcagagccttccaggacactcccagctgaagccaggactggacataccctcgcttggttccagttttaaagacaagacactttgcccaaggaggtgacccgagttgagcactcggagcgtccaccatcttttctgaatggtgcgaggttgtctgttgttcatggagctcgtgtggggtaggccaatccctggtctgaacttgaggcggtgacacattttcatcttggttctgccgtaggtttagcgggtgacctttgacatatcgtctgcccttcctgcatgtcgtttgtgctctggctgacaaacaacgatctcaccagccatcagcgctccacaggaatgaaaagagtgagtgaccaggacagggagggaggaaagaagaagttgccttgttgccacggccttcctcagatgtgcctccgtgccttgggtcacccctggggctactggcaccttctgagacagagccggggctgagggctagattgtcgttcactgggcacctctgcaccggggaaggggacgggagctgaggagggggcactgagcaaggcagaatccttatccccaagcagttgctgacaggtggagagacaaatgcaaacactcagaatgcaaacacacagtgtccaaagcagaagcagcaggaggggcgtgggctctgccccaggaattcaggtgcacagaaggagctgggcctgcagggatactttggggtttggtaaatgaaggcggggtcgtgcactctgcggtggacaacaagagagaagcctccccacacatcagggttacacgtggcttggggtatggcttgccaccttctcccgtttctccccacatgagcaagggcggtgtccattatctctcaagcaattcctacctccctggcactggtagatgctggacacatggtacctcctccagcctcacaacaacactgtcacatcgtcacctccatttctcagatgaaactcaaagaggtgacacttgtccagtgtcaggtggctgtgaagatcccagcacagtctccttgcatccaaggccctagctcttaccacattgttgatcctgggttgatggtgaaggtgtaagctggggttcctccccagcccctacctgtcgtgtgcacacctggccttctctgggggtgcatttcccagctgaggagactgtctgcgtgtgtggctccgaaggaagcctagctggtgagttcagaacaggccctgtgtgtgatgtggtgacctgaggtcataggatacagactgcgtcccaggagcacctgccattttaggggtggctcaggaaagcctctgagctccctggaggaagttgtcccctctccactgctgcaaaggagagttggtcatggggccaggcagacactctctggacatgctcgtggaagagctctttgggagaaaagacactcgagcatgccaacaaggggacttaggggccagaatgttctgccacttgccactcgccaacctgaaatctgcacctcctaatcacctcctctcagccctgcctcatcaagtggggtcttgcaggaactgctggcagctcggccaccatcggggaaaacaccccagtcaaacacaggctctcctgtgccttggcatagagggaagagccagccctgcccccgcccctgcccactatggtctcaggattcactccttgctgaagcctttacaggggagccaaatgccctctcacccaaggcccttccaaggccctcccacatcctttgggtgaatctgtttcaggagcacccatttgagggaaaacttcgtccccaggagaaatggcaacggagaggtgaaggggtggaggtacgctttggagcagggccaaggcacatgggggtgggctccagcctcgagcctgtccttctccatgatcctgaacatgactcttctggaacctggccggaagttgcccctcaggagacagcgggggaaggaagttgtggtccagaaactccagaatgcagggtgcccttcccattcaatcacggaggctggtccaggccaagagcatcctcggcctttgtttaagctcccgtgagttcttggttgacctggagaggctgagagaggcccacaggacctctttccttctgacccttcattgcctttggatccagctcacctcagtgcaagcctgtggcctgcaggggaggccctgaggtagaggcactcagccctgataccgtgagggacccttgaaagtttgtgctcttgtttatggtctcaaagacaagaggccaaattcctcagctgacatttttactgtcaggacgtgccaatgttgttcactttttgttttgctttgcttatgattgtctggcaccttgagatgatgctgagtatgccaggctataggatggagatgtgggtgggagcaggcaacagactggccctgatcttccagagctgatcacattctctgacgtcagctctctctgttcatgtcctttgaagggcaatggactccgtgaggggagacccgaagtctgtgaatgcccagcttctgagataccgtcaatactgttgactgcatgaatggatgaattgcaagtgagttgttgaacacagtggcaaggaggctccttactagcttggaaccccctcctccggcagggaaagtgattaccaacctggaggtcagccaggccaagagggctttgagatctacaacaccatctccatctactgggtttgggttacgtgttttaagtggctcaaccttcctctgaaatcatagcaatagcaatgaatgatgtcccatcaggcactgccctggtttttttgcacacactatctttcatccctataaggacgatgtgggatggccattgtcatgttcctttcacagaggtgaaaattaacactcagagagagtaggcatcttgctcaaggctagaatggggtaaagccattcatttaatttatttattcaacaaatattcattgccaacctgctataggccaagcccctggcactattccaggtatcgggaaaatagcagtgagcaaaatggacgagaattcctgctctccgggagcttcacttctaatgggggaagcagagcaacacacaagataaaatacacagcatgccagaggttgttaagtgccaaggaggaaaagtggagaaggtggaggggaagggaagggctggtgggcagagggatatgcctactgctgaggaagctcccaccatgaaggtgacatttgcaaacaaacctgaaggaggtggaagactggccaagcagagacctccgggaagaggggctaggcccagacccaagcatgagggtggccagagtgttctgggaacacgaagaccagcgctgctgcaggtgggaggggatgtggggaagataagatgagacagagtaagggtgtgttggggggtgacagattatggagggccccagaggccatcctgaggatacgggagccattctctgagcagagaagtgacataatccaatttcagtttctgcagggtccttctgggctctaggctgagagtggactgagggatgagggtggagtcaggggcatggattaggaggctatggctagtccaggcaagggggatggcagtctaaatcagggcagcagcagagtcaggttttggaaatgttttgaaaatagagccagtaggatttgccaacattggcaaagattggatgtgaggtgccagaccaagtgttgtcctcagcaactgggaaaaaagagttaacgttctgcattaggctgttccagcattgccataaagaaataccagagactgggaagtctataaagaacagaggtttaattggctcacggttctgcaggctgtacaggaagcatggtgctggcatctgctttccttctggggaggcctcaggaagcttccaatcatggtggaaggcagagggagagtgggcatgtcacatggccagagcaggagcaagacagcaaggggggaggtgccacacacttttaaacaaccagatctcatgagaactctctctctatctgcaggatggcaccaagagagatggtgctaaaccattcatgagaaatctgcccccatgatacaatcgcctcccaccaggccccacctccaacattggggattacagtgaacatgaggtctgagtggggacacagatacaaaccatatcatgttccctgagataggatggctgggggttgggggtgaacagtatttgggagggaaaatcagggactctgttttggacacaatccattggagttgcaggtagacgttccagtggagaagacaagtggctggctggctctctgagcctggagttgagggggtgatgtgggctggagattggactttggcatcatcagtgttggtgaggcagctacaatcatgactctggatgagctcattgatgggggcagcaagtgtggacagagaagcaggaggtctgaagactgaggtctgaggtgtttggggagaagaggaggaacctgcaaaggagatagggagcaagcaaggaggcaggaggagagccgggcaggtgggctgcagccaagcaaggagagggggaggaggaaggggggaaggggaaaggcggggagtgggaagagggtaggagggggaggaggagagggggaagaggagagcagggggagtaggggtaggaggagaaggggaggaaggggaggaggagggggggaagggggtgagggagaggaaggggaggaaaggaggggtaaggggggaggaggagaggggaagaggggagaaggagtgaaatatacctgtcgtgggatttgacctatattagagaatcactgtgcagtgcaccaagtggcactggagaagtcatccccgaaataaattggattgtgtgacaagagatgggttcagcagatgcaacagacagggaggagggaaactggaccagccttggctgtggattggctgcgcgatcttggacaaatcacccatcatgttttccttccgtgttacgtggaaatgtctctgatatctactgcccttacctcacagagtaaagacccaaaggagatgtcatgaaagcattttgaaatgctgctgaacactcagcacagtggctggcacagagtgggtagaactcaatggttggaaaatgtacttggctgttattgtgcctttttcatgaaaatatgaaaagctaaataaacctgaaacatgttggggactgagtgaggggagatgagcacgttctgagagtcctaggaccatgcactctcagagtgcctttgctattgtttcgcctcccgtcctacagaggaagggcttaggtttgctgtgaatttcccccttgcctaccagcattgcgccaattaaggtttctacttcaccgcacgtttcagccaaggatgtcaagggaatccactgctgctccagtgagacaaataacatatccagcatcaacactgccatcatcattagcatcattgtggccattaggatggttggcaaggcaataggttggcactactgatgggcagcaccattagtcttcttagtgatttttcaaaatggacagtctggagctaaaagcgtgagccctggaggagctcatttcatcagacctgctgcaggcaaacactcttctcttcatacctttcccgcctgtacgtgtggggtgatgcctgtcttgggaggaaatatagatgcagtgcctagatattccaaagcccaggttcggaatctgtgttccctttgttttttgatatttcccctcctttcctcctgccctttagatcttgtgcatttgtgggtttttccctttctgctcagctctgatcacttatttgcttttgtttttggagagctgcgtcctctctttactcacccacctgcttcattagagattgctactcacctgcagtatccatgctcaccttcttccacgataattgaaagagtgtccggcacacggctgtctacttaaaaactgctttctctagtatcccttgcagcctggtgtggtcatgggactgatttctgcaagaagagtttgagcttcagtgtggtgtgacctctggacctttgaaaagaggggtttattccttccattctcccacctttctcttccttcctccttgttggagtgtggctatcatggtgatggtgaaccatcttggaccacatggatgagggccacacactcaggatgctggagcaacaaggtggaaggtacctgggtctcgactgcccacccttgtgaaaggtaaatgcagttccatcttatctgaaccctagtattttgaggttctgttagaattgctgcacctgtattctaactaataccttctttaggctctttgacccacttgccagattgcaggttgcaggaagacagaacatggttttgctcaccattaggtcatcagggctggcacagattgctcaacacataataaatacttgttggaagtgttaatgagttatggttttactctggtatctggacttctgctttccaaaggatgagtggcccttgacgcattgttcccttgggcaactgcagcctctgtcatgggccaagtatggaatgtccctgggaaataaaatctcagaggaagagagctcctgcccagccgaaattctccctggaattgtgagcctccaattaggctagaagatacagtcttcccatctgttgtagaaacagaaagttatttagagtataaaacaatctcccggcttcatgtgtgaagcctatttgagagtcagagggttccagcagagggaggaggaacatcagctacacctggagctctggggatgaaagaacccatgagggcctcatagattatagggctctgactcctccagggaaagatgatccagtgttctggcctatcttggcctgtggttctttgtgatccatggagtgagagtgtccacaatcgcctgctgtgtggtatttccctgacttgagcctttgctcataaccagcatagcccacaaacaccagccgtatccctcaattcctgacttctgctttcctgtctttacagaagaaccccagctgtgctaatggtcctgtaacctctcagctcagggccatgagaccttctctctgcatgaatctcgcctcctctgcaccccacacttccacaccacttcctcatataacgtgttatctgactacacaaccctggaaatgatgttcctcctgatgtgttcccaagcattcttgctattctgcttcctctagaagccagggaactttagctgaccaggtctgtgtcttgggcacctgccttggtgagcgacctctgagaatttctcactaaacatttgttgaatgaactaggagatatataagggaatgcctcttctgcctaccatgagcatggccttaagtgttatctttgttgcttggccaagtcatggccttgagtcccaagtgaggtgcccagcccttattcctgatcaataaatacttttagactcctgattattctcttgcttgcttgcttgcttgctaatctctaatagattagatctattccctaatctaattctctgatcttcctcctgaaacttggctccatattgagttccttgccctatatccgtacttgcacggccgctatttgccacccagagtccctgtgctggcaaattcaacacccggagcattatcattttggtgcaattcctgagcacagcttgctgactcttcagtacttattgtttctatctggaatacaagagggagtatattatgaggatgatggtaaacccagatcatggtgctcagagcagatctgaaactctggcagcgtaacacctctctccagcatggacagataagggtgattattatttaattggacttttcattttgagagaaattgtaggttcacatgcaaatgtaagaaatgatgtggagacctatgtaccttttatacagtttctcccaaaggtaataccttcaaaactattgtatgatttcacaaacaggacactgacattgatagagtccagattcagaacatgtccgtcatcaccaaggtccctcatgttgcccttttgtggccgcacctgcgtcctcttactctccccatctctgccccatctttaactcctgacaactactaaactgttctttgtataactactaaactgttctttgtataactactaaactgttctttgtataactaaagttataattttgtcatgtcaagaatttcatatgaatggaattacacagcatgcaaccttgacttttcttactcagcacaaccgtctggaggttcacccaggttgtggcatgtgtcaatagttttctcttttgttgctgagtagtattccataatagagatgtactgcagtttgtttaaccactcaccttccacctgaagggcagctggttttttccactttggggggattacaaacaaagctgctgcagacattcacatgtgggtttttgtgggaacctaagttttttgtgtttttttttttttttttcctgggatgaatgctcaggagtgcatgccaggttgcacagaccttgcatgtttagttttataagaaactgtcagactgttttctagagtgattgcaccattttacattctcaccaacaatgtatgagggatccagtttctccacatccttgccagcatttgtggttgtcactcttttagccattcaatagtcatgtaatgatatctcattgtggttgtaatttgtattttcctaatggctaatgattttaaattacctcttcatatgcttatttgccacctgtatattttcctcttcagttaaatatctcttcatgtcttttctcatttcttcaaatttaaaaattcttatttatttattttttattttttttactgtggagttttgagagttctttctatattctacatactagtcctttgtcagataggcagtttgcaagtattttctcccagtctgtagcttgacttttcatcctcttaacagggtctttcatagagcaaatgtttaactttgatgaagtctaatttaaccatttttcctcttatggctcatgcttttggcatcaagtctaagaattccttgcctggccctagctttcaaatattttctctttttttctctataagttttatcgttttatgttttacatgtaaatccatgatcaatttggagttaatttctgcatgaagcgtgagactagattgaggtttatttatttattttttgcttatgaatatcgattgcttccataccatttgttgaaaagggtatctttcctccattgaattgcctttgtacccttatctaaagtcagttggaaattttgcgtgggcctatttctattaacttccactggtctgtgtatctatcccttcactaatagcatgtagccttgatcactgtagctatacagtaaatcttgacattaggtagactaatctatcccatttcatttttctttttcaaaattgttttagctattctagtttctctgccattttatatacatttaggataatcttgtctagatctatgcaataatattgctgggattttgtttgcagttatattgacccatatatcaagatggggagaattgacatctttactgttgagtcttctgattcatgaatttgtaatgcttcttcatgtattttagctcttatttggtttcttttgtaggaattttaagcacacaagtactgcacatattttgttagatttacacctacgtatttcatttctcttgagtgactgcaaatggcattgcatttgtaattttggtgtccacttgttcattgcagtatacagaaatagaattgagttcatgtgtttatctcttattctgtaacattgctgaactcattagttctagggttttttttttggtttgttttatagattctttgggattgtctatgttcacaatcatagggatggttttatttcttcctttccaaactatctgcttttattttattttcttattttattgcactggcagaacttccagtaggaagttgaataggagtggtagagtggtcattcttgcctctccttgatcttatgtggaaagcattcagcctttcatcatcaagtataatgttagctatagggttttatagatgctttttagtaagttgaggaagtccccctctattcctatttttctgagaggttttctaatgaatgggtgttgaattttgtcaaatggggcaagagggtggtaattcttcattattccttactgtaattagtctgtcaatgttaatgagcatgctattattaagcacctattggatgttcagtgttgtgctaggccctgtgagacatataggaacctaaaaatttgagccttgccctcaagcactaaggaaacacactttctaaaccacaatttagcatataccataagtgctgcagaaggccccaggcagcggaggccagtgttgccctggctagaaggtgtcacttaggttggcctttgggctggagtagaacctagatacacaagagaggggagtgaattagagaaaattcaacggcctaaaattctattttctaacaaggacaatggtaagttgataattagtaggatagagatagcttttgattaatgaagttggattatctctattctgtggattatccctgacaaatgcttaatcctgaacttcctccctttttgagcatttgggctctcttttctgccatccgtcaacatgttcaggggaatgcaaactaatattactattagctaaagaaaaacataattaaggagggcaatctgctgtccctaaattgtatcatcttttccaaactaaatatgagtgatattggtactatcttttgtttggagagatccacaccacttctctccctcttaaggctcaagaagaattgactgtgaccatgatatacacaatacatttattaagctgtctctctaacaaggtagctaaacacttgggaagtaagagtaatgccttagagaatttggaacccatgacatctgattcattggtattgtccatatttgtacatgtttactctaatataaagtaataatataatagtgctgtcatttgcaaaattaaaaatcctggcacattactcatgggtcatgctttgggttgtcattctaacgggtttggtggatttgtatagatctggtcctctatctcactttgtcctgctggtgaccagtggctcctcttggaggcagacggccagggttaagggtggaatctgaggccgtgagggagagtgaaattaactgctcccttcacaagggaattgaacccctgaccttcacctcattagcacagcactccaatgcagcaattcctaacctcaattttatatcaccccagggtgtctccacttatctcaagcgggagctgcagaattcctccaacaaaattaattttaattcaccttaatttaaacattaaatacggactatgaggcagcaacttgcaggagtggggaagaatggctgttgttaataaatcccaccaccacaatgcactgttatccaaacaccccaaaacaccctctcgaacccactgagccaaacagtgtggggaggaagaagtctataagtaagcagcaggcatggaaggcttttaaattgcgggggaagcaacacccaaccctaccaaacatctgcatttcatagagactgtttcatgtggtcagctggggtgcactctgacattcactgggccagatggacatatttcagctcccgtccagccagcccatccctttttcctcctagggactgtgatgctttgcatagtcccaggagtttgctgcaggaacattttgtgatttactaagaaaataaattggtctttgttgctggggctttctcctgggtcaatacaaaagatttatcacctccatgccggcccacggagaggttggctcaaaggattctctggccactggcttattctggagacaagcagagtcccagcagaacctttgcagggcaggccagcagcctgagtgtaaggcaggggaagtaaccgtaggaatcagttattgatgaacatccttaaaactctgtttgtttgtttgtttgtttgttttgagatggagtctcactctgtcgcccaggctggagtgcagtgacgcgatctcggctcactgcaagctcctccttccaggttcacaccattctgccacctcagcctcccgagtagctgggactacaggcgcccgccaccatggccagctaattcttttttgtgtttttagtagagactgggtttcaccgtgttagccaggatggtcttgatctcctgacctcatgatccaccggccttggcctcccaaagtgctgggattacaggcgtgggccaccgcgcccggccgaacatccttaaaactcttcatggtcttttactgataacaacatccacatgcattttttaaaggagaataagcatagttccttaccctggcagtgcactttatataatttgtcaaagagtttcacatgcattgtatctcaattgttttctacctacccagaattaccaacttcattttattgaagagcaaatagacttggaaaagttaaatgccttgcccaaggtcgcatagctagtaaatcatggttgtagcaccagatcccatgtcttctcatatactgcactcttttctctatactaatcttatcttggtttattatcaacatccatttgcttttggcagggaagggtccagaatcttcattttacagaacaacgaattgaggtaagtaagcgttttgggtcctgcctctttttctgctggcaccatgtgcctttcttgctgaagggcaaggagttcttttgcaggcacactcatttctgctctcagaggccaggctctcaaccatcatcatcagtgccatcctgctcattgggccccaccctgccctctgtgtccagtgggggcttacatctgtgatttctgggcagtgagggggtcatacgtgaacagttccttcgcatcctcttaaaattgctctttcagctccataagtttcaactagtcaaaacactctccttcacacttcttcaaagatgagcatttgttctacatatttttttgtagtcatattctgcgagtgcacactttccctcttgggtccttagacacacccttttccaggcatgattcacttcctcaagctccgttctggacacatacatctggtgccacctggaagagggcttatcaggtcctcccacctggaatacagcttaaccagagttgatttctaaggcatgcaaccaagaaaccagactgatataaatgggatattattgattttatctgcctaaccgagtctataaatttctgaaagccatggaaggaactctattttgttgcattcctcataacatctagaacggtgctttgcatatactgagtgctcaaggcatatttgcagatggtgacgaggatgatttgatgtcgttttaaaggccggacatccaagaggaggtctgttctctacatgtgcatgcacgtacacttacacacactctctgacttgtaagatgccctttgcaagagtccatttgggaaatgcagtgggcccactggaagaaattcaaggccatgggccagctacaccacggaagccctacacccagccaaacgtgctcactggcaagtcaaacccaaaaactgtcatcaaattctgcttcctggcagcccggatccaacaatactctgaaagacaaaagaagcagaaactcaagtgaagatcaccaacgtgtctttttgggcaactagcagattgagcagagggtcagcacagacaccagcagagaagaacattctcctggcaggactctgcctccaaattcggcaccacttcacaggatctcagcctcacaccttatgggatttatttttttaaaaaagatccaacatttgttcctaattattcttagtaaaactgcctttcttgatgtggcacccattacctcattcattcagtcactcattcattcattcaatgaaacccctgtcatccacgctctgggctctttctacagccccacgagatgatcaagaactctggaaaacaggtaagccattatcatcagtgtatatgaaattatcatcagtgtatacgaaatatgaagaaacccaattagatggagatatctcctaccacacattgaaatcagaactcagacaagactcagatgttctaactccaaattctgagcagtggcccctggataaaggattatggagaaatactgaccagaaaaaatactcttaaatggcatattgtggtgttttaaggcaaggttattggtagtgcttgtaactctcaaaatactgttttggaagtttgtagtgattttgcagaacggctttgagttacctctgggtgttatcaatcattggatagttttcagaagaaatccaccttaatttgagttaaataatatgtcatttagccagatttcctcctgcccccaatccccataggagtgagaagccatggcttggggcattatctcagcatcatgggaattgcagagagggtaccacagctttagagtttgaggtgttgagcctgaacaaaaggaaagggtaagaaacttggggtggatagaacgtggaactactatgaagagcttattgcatagaaaaagagaaatttgagtttaaaaaaaaaatggaagaaagtaaagggagcccaaatgggaacagttaccagaggagattccctggaatttgaaggaaccaggttgaaggatggtttcccaatttgaataattataagaatcacctggtactctttttaaaactataagttcctagagccccagtcttagacattgcatttagtgtgtctgggttgaggcccagaaatctgtatttttaacagaaacccaggtgatttttataatcaggaaagatttgggcaatgtctgcatttgaagatgctgtctctcaaaatgaagaaatacctggacaaagccaagtccaagacaggggctctaagtcaaaaaggcaagagcaaaaacaacatgagcctttacaaaatgtgaattggcaaaaaagcagctgtagctcatatttaataacctcccatggcttccaaagaagcagctgggtctgcagagtcctgtttgtgcacaggatgaatggagtctgtgtgccactcgggatgcccccacaatacccacattatcactgaggtgctccagcgaggcattcattatgcactcccctgccacccaaagcctcaggtcaggtttgccttggacactctcccttctcccttctctgaggctgaggggctgcaggggcgggtgcctgaactccctccctctctcagggatgcctcagctctatgggacttcctctggttcacatgattgcattttcctgccttggggcaccctaaaggcctgcctctgggaagcagggtctagaggcatgagcttgtctggacaacagaagctcaatctcagcatcctaaaggcctacctctgggaaggggggggtcacagaggcatgaacttgtctggacaacagaagctcaatctccatctccaagcagttcgatcccccaacactcttggtattaggaggggagcctctgcaagtgtgaggaccgggggcctctaaacagggtttttttctttttctttttttcttgagatggagtcttgctctgttgtccaagctggagtgcagtggtaccatctccactcactgcaacctctgcctcctgggttcaagagatttctggctaatttttgtatttttagtagagacggggtttcaccatgttggccaggctggtctcaaactcctgacctcaagtgatctgcccacctcggtctcccaaagtgctagtattaaaggcgtgagccaccacaccaagccctaaacacagcctgaggctggtatcccaggaggccttgaaaaatctcaggtttgctgctgacaggtgtgccaggaagagacctggctgctgtctgcaagtggccaaaccctgataatcccggaaataaacaataaaataaactcctcaatggtgattataaagtactattgtttatcagccaggacctgtgctaagcttttcacctacattatttcatttatatttcagagcagtcctttgaagcagtcatgtttatatcagttttatggatgaggtcagagacttctgctggttaagtaccttgccactatcacacagctagctagtaaataaactttaaaaaattgaagtattatgtacataaagacaggcatagtgtacaactaagtgggttatcataaaagtgaacatacctgtgtaaccatccacccaaatcaagagctagactattaccagcctcagaaaaatcccagaccctctccaataacctcctcttccccaatggtgaccatttttgtcaccgagtattagatggctagtttgtgaattttataaaaacagaattctacattatatgttctttttgtctgacttttttctccactcagtatgacatctgtaatgctgatctaatgtcattcatgtacaagtagtttggtcatttttaatgctataaagatgttcatagtatgaatgtatcacaatttatttatacatttttcattttgctggttatttgagtagattttaattttgccccatgacaaataatgctacttggaatgttcttggatagttgacccttgaacaatgagggtcggagcagtaaaaaattcatgtataacttttggctctcccaaacttaactagtaatagcttactattgaccagaacccttactgatgacataaataattgattaacacatattttgaatgtatatactgtattcttacagtaaagtgagctagaaaatagaaaatacttttaagaaaattataagaatgagaaaatatatttactattcattaagtaaaagtgaatcatcataaaggtcttcatcctcaccgtcttcacattgagtaggctgacgaggaggaggaagaggaggggttggtcttgtctcagggatggcagaggtggaggaaaatctgtgtataagtggacccacgcagttcaaacccatgttgctcaagggtcacctgtacatgtgtcttggtgtacatatttcggcataggatataccaagaaatgtaattgatgggtcataaggtgtgtggattttcagctttagtagatactgtttacatagttttgcaaagtggctgtaccagttcactttcagctatgagagtcctgggggatccacatcctcaccaacacttgatactgttggtctctttttacttttgccatcctgatgaatgtgtttcagtttgcatttccctgatgactaatgaaattgagcagcttttcaaatgctattggccatttggatatctactggcttattcaggtctcttgcctgtttttctactgggttttctgtctttccaggtgatttgtaggagttctttatattttccggttatgaatcatttgtcatttatatggattgtaaacgtcttctctatggcttttcttttcattcttaatagtatcttttggtgaaaagaagactcaaattttaatgtagtccaatttttcaatgttttcttttttgattctgtttttgtttctgttatatataagtacaactgactttgtatattgatatttcaatccaagaaccttgctgaatttacttattaattctgttagtttttctataaattattttgtattttctgcatatgcagtgatatagtctgtcaataatggcagttttttttctttctatttcttaaaattttatttgttttcttgctttactgcaaaggctaggacctccaaaacaataatgaatagaagtggtgatagataggaagcatctttcttttattctcagtattaggggaaaagtatcaatatttgaacatttatatgatatttgctggagggtttttttgtagatactctatcatgttaaggcatttcccttttagtcgtactttcctaaatacttcttttttccttttactatcgccaggggttgaattttatcaaatgccttttctgaatctattgagctgatcaacgattttcttctttattctgttactgtggtaaattacatagactgatttccgaacactgaaataatcttgcatttctggaaaaaaatatcatcttgtttgtgatgtattgtcctgtttatatattgctgaattcagtttgataacattttgtttaggattagcatccatgttcaggagaaagaaatcaccattttctttccttgtcaggtattaaggttataaagctctcaaaaatgagtcaagaagtcatttttattttctagaagagcttttgtaaagactgatgttatttcatctttaaaggttttgaagaattcactgatgaagccatctgggcctggaggtttgtttttgtttttgttttggtggaaaggtttttcattatggattttatttctttaataggtacaaggctattatatcagatattctttttttatttgggtcagttttaataagttgtgttttccaaagaatttgtctatttcacctagatttaaacatttatcatcataaattggttctgaacagctttttgtcttatttaggagccacagattctattgttagggcttcctttccattcctgataatatttgggactcttcttaaaaaaaattaatcttatgggcttatcggttgtattaatctcttttgttgtttgtttgtttgtttgagatggagtttcgctcttgttgcccaggctggagtgcaatggcgtgatcttggttcactgcaacctcagcctcccaggttcaagcgattctcctgcctcagcctcccaggtagctgggattacaggcgcctgccaccatgcctggctacttttttgtttttttagcagatttctccatgtcggtcaggctggtctcaaactcctgacctcaggtgatccgccccaccttggcctcccaaagtgctgggattacaggcatgagccacagcacctgtccctgtatttgtcttttttaaagacttgtttttatttttattttttcactttgttggttttctttgttgtattattgttttctactttattaattcctgctatttattatttccattcttatgctatcttaggatttaatatgctgtttttttattaaaatcttgagatggaaacttagttcattgtttcttcatcttttcttcttttcttgtaaagcattcaaggttttaaatttctcttaagcattctttggctgcatcccttacattttgatatgttttagttttattacctttttattgaaatatttcctaatttccacggtaattcttattttgactcatgggttgtttagatatgtattagttcattttacatcaccttaatccgaccaagaactgagctctttaaagatggttcaggctttctgcaggctgagttcttcctggatcacccctttgtggggagtctcaacagaagaccagtggtatttaacccagctcttcctccttgctgggctctgaattcctttctgtgcctcagccccatgagagtcctggcaactctgctcaacttctcagtttccgagccactgctggggaatccatgcacgccaaggagaaaagtggctggcacctctccgctcacgccttgtttctgggatcttagtgccttagtttctcattgcgttagtagtttttttttttttaaattcttattcatttatttaggagacagaggtcttgctatgttgctcaggctggcctcaaactcctgggctcaagtgaccctcccacctcagcctcctgagtagcagggactacaggctactattagctggtggtttttgatgccttcaaatagatttgaaaaagatgttttgtccacattatccagtgttcttggcacgaagggcgtctgataagccaatctatccttaccaccaggggacatcccctggaaccaggatttaggcacaggtctgtgcacacccagactccagagcccacaccgctgcgtggcagggggagttgccatgttggagtacaggccgccaaatgcggagtagaaaaggaatgtgaagccctcttgctctccagctctcttcttcatcatcttcattattctggatctagtcaagcattgccatttatctaatctcagttctaaaatgtgttgaacacaaattttctagtttcttagtaaaattaatcttttaaatcacttactttctaacggttgttcacagggcatctgggacctctttttcaagttcaccttctcctggtctgaaaccaaaatgaaaacaaatagaatccaagtgtgctgtagctcctgacatccctccgtgggctccgccagcccctgcatggaagcctccacatgggttcaccaggctgttcttcgggctctcccaaagtggctgcttttccgtcaatatgaatggcatgactggccacatctcccttttttcttcgggtgccaggaagcctggactgttgagctaactttacggtccaaccatagcaactatgtcagtgtgcagataactgaaggtgcctttccctccctggcttggcttctccctcttacttctcttcccaagctctcaatttgctttatttttgtatattttaccacgatattgtctctctgtgtgtctttatataaaacttgagttattccagttctgccaatctgtgtaatcacttggcatttttatttgtgttcataattttcagccatggagacatttgaaagacaacaaaatcgatcctggagaaacagagatgtgggcactattgcaatttatagaatttattgtaaaattggactttgatgaatctttgccatacatattctgttgcttaagattttttgtaacaatttatgtgtctattgctttatgtgaaagacgcttttcaaaattaaaatcagtaaacagtgttctgtgattaaccaggaacaaaagtagatggacaactgctcaatgaacatgaaacgatgaagatcaatttttcttctaggtcatggacaaattaaagtagttaagtgttaaaaacagagaccatgatgtcattcctcatgactacaatagaccaatatttaactctaagcgtatttcctttaaaaaaaaaaaaagttaactacaaaaatgtagttaaaggtgctaatctactacttttttggtactgtaatatttactgtattatttatttttctattttatgggcataaccatccacagaagggtcagtaagagagaaatatcactgctttcctcttctatccattatttttgttgtttcgtttcatggctactactaaaaataatgttgtcacagagaagcaaggtgataaaaggattctctctgggggtcaatccatgaagaaagctggagaaatatctgctgaacagagttcatggcttcatgttctatctgagcaagtctcatcctgcagtcagctctcttgaggctgagccaggtctttgcacacctttcctctggctgatgcttttaaattccctctgtcttcgtctctgctattgagttcggtctcctccgtgagtcccccacggggcctggtgaggacaggctctgtgggagcagctttctgttttgagcctgtgatgtctggccaaggagcgcctgtcagctgcttgggctccatctcagcccagagacgtcgtgctgtgtggtcttaaagcaggtcacttcacctctcggtatctctctctgtaaaacccagataataatacttcccaaataaagaaagggttttctttaagccctttgagctcctcagatggagcgcaccacagaaatgccaaatgcggcattgtgatccgcgctgcctccatgtgattaggtaatgtgagattgtggttcattatgctttgtctggaatgaatgcgagccctgccacaaagcactgggaactctcagttacacagaaaccccatggtaagcttggattggcttacacttaaataaagcacaccagaaaagagcagtagttttgacgaacccagctctgaattaacactcatttgatttcttctgctgagtgcgggcgataagtaagagatgacccagttacaggtgcggggggcacaaccaacactgaggtgactgagtcgggggaagggcagcccctctgcaaaatgcttcaggctcccaaggaggcaggcccagagtgggcaggtctggacttactgctgtacagacaagggggaaattcaatagctaccatttattgagtttctgctaggtgccaggaactctgcaatgtatgccattcttctaaaccctccagacaacggtattaaaccatattaatattctgaaaaccaaaacaaacacccactacacttgacacatttttttttgtaccataatgaaagcctatgtgtttgggcccacagtttcagccaggattttgacctggggcctcctcactgatcctgaggctttaagaccacacagcatgggtctgcgaattgcaaatgggaggcttacttttcccattcttatccaagcctccagaagtggctctggagctggatccagcctcctttcttacgaagccttggatacatcccacttagcttgacaaacttttaccggaattctctgatcccatttcacagctgttgcaaaggtagggtcttggttgtgtcttccttcaagctgcttatgaaccaggggtggagactaggaagtaaggaaccctggaatcagagaagtcaggagcaagcatcttgttggcttgaggttctccaggcaccataaaccaagtagtgcgcatactaagaaaacaagctggacaacaagaggagagcaggagggtccttaggattggctgcttgtaccatggcccccagtggctcagtagagacaaggggaatcccaggtaagtagactccttcgctccccagagaggaatctattgtgtcaattgctgggaaacacgctcagttgaactgaccctctatagccgtatgtgcatgtggaatccattgttagggaaaccatggtgagaagggaagtgagatgctctggatgggtgctgagctgagtgctgatggaacagaccttccagaaaaggttgcatattatccaaggaaatatcattgcctggagagtcctaggctgacttgctctcttgggagctgatgtttagggaatgggagaagcagctggtttaaagcatcaaacaatgaaatgaacttcagaatctgccaaatcctaaacatttcttgctaagcaccattttttctgtattgtgaacccatctgtgcttcaaaagcaattttgtttaaatggcttcttccccttactcctaatccttgggaagctgtaatacacaggtggtaaaggggactccccaagagatgctcactaggactgctgtgagccagatactgggctaacactgcatagcaccgagggtgtgggagatcagaagtcaggagcctgcattctcaggggagggactggatccctgcaaggaaacaaagtgtggtgtgtgtggcttcatgatccactggcctaggtctaatagcggatctttttgcaaatttatttatttttcttttcttttcttttcttttcttttttcttttcttttcttttcttttcttttcttttcttttcttttcttttctttcttccttccttccttctttccttccttcccttcttttttctttctttctttccttgcttttttttttttttgatggagttttggtcttgtcacccaggctggagtgcagtggtgtgatcttggctcactgcaacctctgcctcccaggttcaagcgattctcctgtctcagtctcctgagtagtggggactacaggcaggcaacaccaagcctggctaattttgtatatttggtagagacagggtttcaccatgttggccaggctagtctcaaactcctgacttcaggtgatcctgaccttggcttcccaaagtgctaggattccaggcgtgagccaccgcacctggcttgcaaatttctatttctaattgagccagtatttcttcccaaaggttcactggaaaatcactgacatgaagaagattgattaataggaaaaaaggcatacacatttatttaacgtgtatacacaggagccttcagaatgaagacccaaagatagaggggaaattgtccacttttacacttaggttcaagacagtatggatagtcacatagaaatatgactggacaaaaagggtctgatggaatgctagactagactgagtggaaagcgcagcaaggcctgtctgcctagattcttccaggcatccatgcagcattccttccttctgggtatgggacaggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcagcaaactttcagcaaacaattcattgtgatggcaatgagctatctgagaagtaaactgacacaatgatttcatttataatagcacctgtaaggataatatgcctgggaataaatttgttcaagaaggtgcagtacttgtacacagacaactacagaacattgttcgaggagactaaggaagacctaaatcaatggaaagacatcttgtgtccacgggttggaagttgtaacatggttaagataaaaatacaactcaaagcaatccacagactcaatacaatcctatcaaaaagtggctttttttacaggaatgcctgagaagaacttcatgttcctaaaaaacagcaagtgtccccccaaaacaaaagcaatcttgaaatgcaagaaggaacgttctctattccaaaggtctttaactgctctcagtaatacgtggtaatcttcaatatacaggctttcacacctttttttttttcttcttttgtttctagacacgatctcactctttcactcaggctggagtacagtggcaagatcacacagctcactgcagcatggaattctcaggccgatgacatcctagggcctcatccactgagtacctgggactacaggctcacaccaccacagccggataatttttctgattttcagtagagatgaggtctcactatgttgcctaagctagtttcaagcttctgagctcaagcgaccctcctgccacggccttcctaagcgctaggatttgaagctgagcctggctggctttcacatctttgctatgtagtttatatttcttggtgttattgtaaatgtttatgaaaggaatcttttaaaaattttgtattaaaattatatatttaaggaattacatatattatatatatttaaggaatacaacctgaggactacatatacatatacacatacacatacacatacatacacatacacatacacatacacatacacatatacatatacatatacatatacatatacatatacatatacatatacatatacgtatactatacataatgaactaatgcctactaggtgaggggctgccttgtgagcaaacccaaagtccttggctcacaaagccttgtctagaaagatggagggatcagcaaagtgggcacacagcaggttctgtctttagtgcgggcacctgcccactcgggtctctggcaatcctgaccaggcttcatgatgggtgaggtgagctaggaatgggaaagtggatgacctcagatccagagactgcagttgtcacctggggacctggcatgtgcgtggaggagtctcccactgatttggccctggatcaatgcccaaacatgcacaaggacaggactgttggcctcaatgttttaggagccaccagtcttctaaagagggtttgtggtggggaagaatgttcaacaaaacagaagagttatgggtactctagcttggcaacagagaatacttccttgtgctactaaatgacaatatttgacaattatggatgacataattgagcaacagctttcactgtttaacaagcagggtctctggaacactaggttagtgctgtcggaagttgactgaaaagtcggtggtttgagcccatccagtcgcattaatgtttctagctgatgtgaccttccatctgaagagtctcttccttggaccaaatatatcttcaagcttctcctcttcttgtctcttgtctattttccaaggtgcctctttgttgcttgaggcaaaaaaagttcattattaatccacacccagcaaacatctacccttacttatcccggtttttagagttttgagtttgtttgttttctcagcttctcatatttggaatactgggaattcctaaagtggagaacaacagaacctgaatcacacctatggtgaagccacaggccctgggtgaaaaacctaatctgctcgcgtttaaagataaacccattaattttctgtgcttccatttctatctgtctaatgggctaaatcagaacacttaatttgtccaatgtttaaacgagcagtgcaggaaaagcgtggagccaatgcctgtcacgtagcaattggtcaacacgcatgagctcctatcagcgtcacggcctccagcatttccatcaggctttgatctttgaaacgtccttcctgatatgaatgggtcattcttcaaacattctctaaccgatggccatgacattgttccaatgtgtattattacaaatacaactgcagagaccagactgacacatgtatctgtcgtgcatcacttgtctatttctccgtagatacctggagatggaattgtcagaccaaagtatttatacatttctgattttgctaatttctatccaaattactatgaaaagaagctgtaacaagtcatacttttaatattttatgagaattctttttttctccatcttctggccaaaactgggaagtacttgcctaccatttcctctgaacttacttttgccaacatttctgtagtcacacagtgggatcacattgcatgcatgacatcaaactcaaatcctaattgaaaagaggggttcacaggactctataaaaatttatattcaaaatacaaaaatgcaaacatatatgtgtatacaaatacatatatatacacatacatatatgggaaaggaatttttttatttggataccttatcaaagttatatagactggaaaatttgtttagtaaaacagcagtccccttgtgtactcccagagtttcatcacatagaagcaagtatttagttatttatctccttatgtctaaatagatattattcctttttgattttcaagcgtaggcactatctctccttcacatacttgctcatcaccaccacccccaaacatgcctctcactaccttaccctctaacatgtttgtgtcctagtttgagggccaactactacattattataacttgtatatgttattcagagttcagtcacactggatatacatagcaggaaatgaaaggccagtatcttcagggactctctctcaagtggataagcttcagagatttttgtaatctttggtcaccctctccatctttttcctattccgggtaagtactggatctgatgggcccagctcaggtcaggcactctctccttgagaaggggagagcaggacatcttcatgtgtagtaccaagaagacactgtccaaagagggacaggtagttctgagacagaaaagtcaatctggggtatgggtaggcaaaacgaggacacaaaaaaaaacccatgtctgttctgtgaggggagcatgcagtagagggtggattcagagtgggaggggagagttttgagagatatgggccatggatagccctctgtgggctggagccacgcaaggctgttggggtctctcaggggcagggagctgaggagaatctgccctccccaacctgggagactggtgaggggactgtcctggtcaccagacagaaatggggtctgggccagggcagttctggtgggaaagaaagaacaggacatcttctccttaggtaaggctctgagttcaggtcttggtagggagggaggttaccttgggcattggccactgaagatggttggccagatgagcacactgaaatctatgttctataaacttgcagttctagtaaaagaatgactgcagtaaagggtctttaggaagaggaggtggaagacctgatttgggttgggggctccaagaagaatgtctgccttgctgtgcagaagcctgctacacaacctccctggtccccttgctcagtctcccggccagacccccagagtacctgccctgtgcaccctggaagtacacagtgagttcagccaaggcatctccagccgggactcatccctgggcatttctgtggccttgggtgccctggccttctccaggccctgtcttgcaggcaatcgtcctgcaggggaatgggagaaggaggctacttgacagttgactctgagtggctccacaagttcctgacttagctcctagtcacttgcaaacctatatacccccatctcatcccccaaatggtgaaaaagaaactttgccaggactcatgccagacaaatagaacagaaccgttccatagagccaaggtcttaggacatcaataagagatggaaaccacctgctagaaggtgccacagtgggaagcttgttggaagggagcagtcactgaactgtcagggtgaatcctggctcctggccctcacacgccctttctccccttccttccttctctcctccctcctgtctgctctttcccctctctcccctgcatccctcaggtaccttccatgggccctcacccctccttttcagaggctccaaagtgagccctcaaaatacttggtaaccttgggcatttccaaaactggagagatttggccacaccatttttaggagctaggaacgtcctccagagctcttgcctaaatttttctgctgatgagaagagaacaaaagagtttccatctgatctggtcctaaggcaactgctccttggagcagagtctgggcaggaagaagggggttgcccagggccccagacttgcccctcccagctgctgtgctcctctccccttcactgcgggaggctggccagggatcgggaacctctgttctccacagttgctgcgatcccaggcccaaatctaaatattggctgatttaggaggctaagggaggcaattccctggagagaggtgtcaggatctgggacaagagcagcatctggttgccatccacggagaccccaaggacaggaatccagtggtagcctgttggaggggatcccatgacaataaaatgaaacgtgtgcattagaactggagccaagaccaggagctgaaaaaccgcgccgtcctaagggatgaaggaattagggaatcccggaagtaaagtttttcatataggtcatttcttccaaagagacacagggcaatggcccaatgacatgtataaaagaaaactcagggtctaggattgaggggaggcagccttttcagtggaggagacctgtcacctggaggcccagggtcaccctgagaggggaggggtcttgctgggtcgctgggtctaggactccaattgcacacagccagtggcctggacggtgggtgaccatgactggggcaatttcccccattccgcttagggagcaataggaatatcattggcattatacagaaaggtcccactgagacttgaacgctgatcaccgtactcagagtccaaagcgctcaccattacatcatggaacctcacaatagctcgtaactggagggcactgagttcacagagcagccgtagttcccacgcacctctgttcatgtatttcctctgatccctcaagcaacaccgaggaaggtggacctgagatggaggagtcgtcctctttctttctctgccctctcctttgatcaacttttaccatttcctttgcatcttagaaaatgaggcaaaatccagtttgggcttagggccagagaagagcccttgaggcctccctcatggaaaacatactctctcagtttaccagagtttcctgtaccaaggggaaatttctgcaaacagtaatgttatattctttttgccttccctcttttccctttgcccagggaggccagatgattgtcagaacaggacttgggccttcctgggtgcctcgcccccttcctccatgtaataaataatagctgacaccaagcaagtgggattgggaggcagggaagctttcattttctttttgatatacttttatgcatttgcttggttggttatggcaagattttctcaccagaaatggagatttgttggattgaaaataaaaagtaatcagccatgttttacattcaacatttattgaacccctgctgataaagcacttgccagcttcagtgggtctgctagagatgagagtacacaatccctgacttacagataccttgtcccaactaaggcctaggttatctgaaggggagattatcaatggcaaatgcaggctcctcctgtggaaagaaattctgcttcctggagctggtggtctcttctcccaccagttcaaagaagcttctctcgcactgtggatctgccctccctgccccacaaggttagggtatgtgccattggggctcagggcatatgtgggaaattcagacattctgtaacacctgctgtctcttcccacgcaggtgaacccttgctgaagcaggacagcaagcaggtccaggtggacctccacgacctgggctatgagacttgtggtcaaagcaagaatgaggctgaacaggaggaatccaccagtcccggtaagagcacagggtgtggggctcaccttccctccctggagtcagctgtcacatttgggtgctgttggccaattccacacctgacaagtagtggggaagaggaggacaggaggttaataggagaactcttacccaaaatgaggctgagtataagtttgaatttctacaatgagtttgtggcatactgctaataataataataatcatatgaagttctatccaactgattattatagaaatactaaggcctacttagagaccacatgaggttttggaaacatgcaaaccataagttaaaaataattttggtttgcattataaaaggactacaactatagggccacccaccacattcaaaacgagaagagaagaaaaacacagtctctctcattcttgaggaagtgtactgtggcagttaagagaaaagatcctggggtcagacttgttgcttcaaatcccaatttgtaaactttcctatgctccagtttcttcaaatgttaaaatagtaataaaggaactacctaccccatcaggtactaatgtcaattaaatgagtaaattcttataaaatgctttagaacagtgtctggcatcgggtaaaatgctgtggattagttctcattctgactaccactgccccaatacactgatgttaacatgctgatatatttattcaaactcttattttcctttgcctatttttcacacagttataacccaataaacttttaaattatagtaaactttagagagcattaaacttgcagcatgcagaaatagcttgtcctacattcttgtggctatcctaactagataaggccatgttaataatgtcttgagaaacatcagtgtgtgtggaatgaacacaggatgttggaggatttgaattcaggctctgccacgtgctagtttgagtgatctagaacaagctggtttaccacctctctttaagttttggtttccccagtcagtaaaatagagagtggtgaaacctaacttgtgggtataaggaggataagaaatactgtatttgaatgcctagtacagtgtcagggttgaataaagtacgacttcacctttttccctagtaattattatcctcatgaccaaacctgcctcctctcaaaggcagtggccacaacagcacatccaacttttattcaggaagacatctttgtcttttttcagagcatgaggagcacagcagccgcaaggaaatggtcctggtggaggggctgtgctctgagcaggggcgccggggctgaacgctggctagttcctctgagaggaagcccttggagaatgaactagggaagcaggaagagttctgggtatatggaaagtcagaaaacatctgggtcctatgaaaggacatcaaagatctgaaggcccagctgcagaatgccaacaaggtcattcaaaacttcaagagccaggtccagtccctctcagttacaagtgattattcatctagtctggaaagaccctggaagctgagagctcctgacaccctggaggggtcttcacctcatagtgtcactgatgaggatgaggtgtggctgtctgatggcactggggctttctactctccaggacttcaggccaaaaaggacctgaagagtctcatccagagagtatcccagctggaggcccagctcccaaaaaattgactagaagggaagctggctgaggagctgagatcagcctcatggcctgggtaaggatggcactgtctgggcactttctggattgaaaatgtgtaagtttgtgcttggtgtagggtagctcaggcagttggaagaaacaacatgtctgggtattcacaaggacactgatttaaatggtagatataggtctgtggaaaagacaggtaggcaagcaggagggcataggatgatgtcccagtatctgggagataccagatctcagggatttcctcttagggatatatcagtaaagtaatagtacatatggtatagtatagtatagtatagtatagtatagtatagtatagtatagcatagtatagtggtaatactggaatcagactgcctagctctgatgcttactacccatgcaaccttcttaacctttctgagcctttgtcattacctattaaatgaggatgataacagaacccatctcaaagggtggatattaggtttaaatgaattaatacaagtgctggccaggtgtggtggctcatgcctgtaatcccaacattttgggaggctgaggtgggcagaacacccgaggtcaggagttcgagaccaggctacccaacatggtgaaaccctgtctctactaaaaatataaaaattaggtgggcatggtggtgcacccctgtaatcccagctactcaggaggctgaggcaggagaatcgcttgaacctgggaagtggaggatgcagtgagccgagatggtaccactgcaccccagcctgggtgacagagcaagactctgtctcaaaaaaaaaaaaaaattagtacaagtgcttagaatggtgcccagcatacattaagctctcaatgctatttgccatagttatcagtgttattgacactttgtgttgaaaacacagacattcatcttggtatgcgtcctggttatctactgctaagtaagaaccactctaaaacttagtgacttcaaacagtactttattatgcttcatggttctgtggtttgactgggctcagctgggtggctctcacttagggtctcttgttttgggtctcatcagttgatggcatgagagtttatgtgatggccatgattgcaaaatacagtcagccacagtatcacaacacagaagaaattcagacatcaggtggtggttaaaacagaagacatgaaaggtcctatctagacttaggatgagatgagtctaattattcattgagtatctgctgtgaatctctgtgatgctggtgctgtaagggatgtgaaacgcagaactatcttcattctcacagaccttacgatttatctagggacatataattaacatatatagaacagttgaagaacagtggcatggtaaattttttgttttgttttgttttgatacagagtctcactctgtcacccaggctggagtgcagtggtgccatctcggctcactgcaacctctccctcccaggttcaagcaattctcctccctcagcctcccaagtagctgggattacaggcatgtgccaccatgcccagctagtttttttgtgtgtttttagtagaggagggggtttcaccatattggccaggctggtctcgaacttctgaccttgtgatctgcctgcctcagcctcccaaagtgctgggattacaggcgtcagtcaccacgcccggcccatactaaatttttagtgcaataatttatcagggtagaatttactcttaaatacctcctatggcttacgtgccagaattcagtttgggggagttccttagagatgttctcatagaaatctctacagaagccccataacttatcatccaccctttcctcttctgtcctgcattaggaaatatgattccctgattcaggatcagccccgggaactgtcttacctacggcaaaaaatacgagaagggagaggtgtttgttatcttctcacccagcatgcaaaagatacagtaaaatcttttgaggatctcttaaggagcaatgacattgactactacctgggacagagcttccgggagcaactggcccggggaagccagctgacagagaggctcaccagcacactcagcaccagtaggttggccacagggctttggatactctcagtcaccccacagttccagcccctggtggccaccacatctccactgcaactttttaacgtagggtcctgtttctatttcatttcctggggctaatacaggatcaagactgctcaatggggagcatggagaggaacacacagggctggagatgccatggttacaactctagaaacttcaccactcatggaatgtgacctgtggggcaggggcggcatctctctggtgctaagagggagtaggggacatgacatggaagggccttgttataggaggaagagccgtgagctaacaattgcaagacgtcgaggcgctgaggccaaagggtccgtgaggaaacaggcgcagctcgcgcccctcggcctacgggagggagggcaaggagagtcctacggttcctgggaggacgagaagagccaagagccccgacggccggcgccggggaaaaggccccgaggcggggtccgcatccctggaagggcggcgtccaccctcctgagaggcacggggcgcccagggctcggacgctcaaagcccgccggctcctgcagcttctgggagccgaagagtgtcagccgggaggatcccgcacacggcgcttagttctggaactgcatacccaggggaggatgcgggagcccgaagcccgggtatgtgtccccgaagcccgggtgtgggtccccatggttttcgtgttgggggtgggcgcggaacgctaagcctgggcctattgggagccatagtcttcttgatggctggtgcttattgggcttttttcagtcgaatttcgaaatgcagttgaatttcttactttggaaacgataatagaaatggctgacctaagattttcatgatgatattttgccttttttggtgtatatgcagtttctgtggtgtagtggttattatgttcgcttcacatatgaaaggtctctggttcgagactgcgtgggaacatcgtgttttgttttgtttttttgtccctaaatttagtgagtttaatcgaggttgggaaacaaacagaaaagtagttgaacctgtggctacactttagacctcctcaatctagacagatcgttgaccaggctacagtttccactggtctgccagcaagaggcctgcttaatattagctttggttccagaaattccttcaggttctcttcattctcttctatcgcctgtattttcacaggctgacactgaaagtggatgacatcttagtgcatttcctaagggtcccgcttggcttcgctttactctggtaagttgcagatctggctgatttgcaagacaacaaaaacaaaatattttttaaaaaggttctaaatctgcatctggaagtcatagagtcaatattcctaaatcacatgaattatgtgtatacatttgcatgcataccccttccccaaataatcctcagaaaaccggttaagttttagcatctgtgactctgagatgcatatgaggcctttgtaaatttagaagttaagagtagaaagtacaggtttgtattttagaaggagatttgggaataaatatagctctggtggatatagatcatatgttaaggtttgttggccagagctggtttgtgtcttgggtgttgggcaaagaacagagaacagccaaagctctgcgaggtcaatgtgaagggtgatttccttggtgggctcaagtttatgacgcagcctggacctagcttggcttctcagctagagaagaagcatgattccatgtcacagctcctgtctttgaaaaagtcataatgactcccagacccaacatatggagaaaactctggatttgtctcttcagttgaatgtttccagagaaaattgaggaaagaaatctctctactatttgaacttcatcaaaagactaatatgctaatatttgaccgtcaatatttccttaaactagtctactccttacatagctaatacatcaaagcatattaacttaggaaatgggattctcccaaacaatgaaacattgacggcaagcgttcttcatcttttcatatcacatttccttcaaatgctttatacatcttcaagcagacaaataatagtattataatgattacgagactgatcgttactcttttgccaaaaaaaccagcgacaaaagactaacttagtggaccaacctttatttcttcattttctctaccttggttctgtccttttatttcctctttcttctaattctgcttctgctactgatttcctccctggatttgaactttacttacctaaactaccagttaggttaccttcttagaacctctaaggcagcagtttgaggttgacgatggaagatttaggattagaaaaaagaaacgtgaatgaatttctgatgttttattataggggtttgtaatgcaggtagaaagaaggacctttttcagagttaagagtttgatccgacaaatgagctattttgatatttataacgttgtctagtaaaagtttcctgtaaaaacacatttggtttggatgtctttgttagcttttagtcgacacttgaaaaaaccgcttggaacggtttctaagtctttgtggatactcttttctgttatcctccaggcggtagttacgcagaggcattggtggttcagtggtagaattctcgcctcccacgcgggagacccgggttcaattcccggccaatgcaaaagggtctttttcaccccgctgttgctctttatctgtcttttacgctgaaaatcatactgcataacctaatagtgcatttaggggcttggccaccacaaggtaaagtgacgacaacactcacgaaagtagcggcaggagacattcaggagactaactcaggaccccatgcagttgttggactcaaacagcttagcaagctgacaagcatgaagtgtttccggtgagtcactgcagttttcatactggtacctgtgactttcatctattcactggaaggatccctgcaaacccgaagaaccatcaggttcctgattcgcgtgctggaccttgggcttaccgttgagccactatggagaggatcaagaaatgacgctcttggaaggagagaagctgcgggcaggacagtcacctcagaggtccaagaggcgtcagcggcccaaagaaaggggtggtgtgtgggcaagagtctgcgtggagatgaggggagcggcggagactggtccttgcgcagaggtggccagtagaccctcagggctgtaccccagacaccgtgaaccgaatttgctaacatcgtcagcgaccgcggcctccgcgtgttttgtgggcccatcggtgttccccgagaaattccgtgtgtctggcaatgtgtgtcaacaggtgttggcctgaaatttggccgggcacggtggctcacgcctgtaatcccagcgctttgtgaggccgaggcggatggatcgcttgaggtcaagagttcaagaccagcctggctaacatggagaaatcccgtctctactaaaaatacaaaaattagccaaatgtggtggcatgcacctgctattccggctacttgggaggctgaggcaggagaatcgcttgaactcaggaggcggaggttgcagtgagccaagatcgcgctactgcagtccagcctgggcgacagagcgagactccgtcaaaaaaaaaaagaaaaaaaaaaaggagcgaaagaaggcagagatgtcaatgggacaaagagacctcccaggaggcttgttgtagaggcagtggccggatcctgagagatgagattttttatttaattatgtagcagaatggggagagaaagggagaagcgcatgaaagacagaaaagcacgaaaatctgcggacgtccaagaataaagcagataaaatagtgtgagtgtttttacattcaaaaaatagaagaagtgcaatgcttgtcagcaggctttgtggtcgtgtagtggttaatacttgtagttgtggttgccacaacctgggttctaatctgagtcacagtagtgttttctagcctgcgattgtggctaatagacctgtcgtttgctttgcctttaatcctagcagcctccagagagcagagtaaacctctggccccgaagggcgccagcttctggagtttagcccacagcgcagaaactagggggcggcctggccgataggaaaacttggacatgctctttgtctcacaattgagcaggaaaaattcccgtaggtgaagatgctgcctctcaagggccctttgtctgtagcttccactgatgaaataatgcggttatagtcttttctggtagagaaaacggctgtatcagtggaattttttaaaaacacaaaacgagaacgagtttttaatgagctgacaataaaatctaaactagttgtcatggtctgcaccggcttgcctccattccccatctgctaatttttatgagaacagtaaattattactattatcattatttttgagacgtagtcttgttctgtcacccaggctggagtgtcatggctcaatctcggctcactgcaacctctgtctcccaggttcaagcaatgagaacagtaaagaaactacagttcacataaagtgcacaaatctttagtgcaatttgtttagttttgatcaatgttatcaccacccagctcaagttatagaaaattgccatcatctgagaaaggcctgttagagcccctgtccaggtgattcccaccctgtgtcctcttagttatcactattctgatgtctattcccacaggttacaattgcctgttcttaaagttcacatgagtgaatgtacatgttttgtgtctggccttttttctgcagttacattcattatactcatgagatatatccatgtagtttcatagatcacttctcaattttggggttattgatttcttgtgctgaatattcttataacagtctttgtgtgcacttgagattcatggaagtccttcaattgctgggtcatgacctgagtataagtttaacatcagtataaattgccagtcttctagaatgttttttcaccagcgatgacagttgaagtggcaccaaattcttgtcagcatttggtgtacgaactttgttaaatgtagctatgctctcagaccaatctggccaacatggcgaaaccctgtctctactcaaaatacaaaaattagccgggcatggtggcatgcacctgtagtcccagctactccggagggggatgttgcagtgagtcaagatcacagcattgcactccagcttgggtgacagaatgagaccctgtctcagaaaaaaaaaaaaaaaaagtagccatacactggtgagtagttagtgctatctcagtgtggaattaatttgtatttgcctaatgagcaatcctatgaagcatactttcttgtggcttccagcatataagaaactctcctttgcaaaggcctattcaaatattttgccctattttatttggcttagctctatattactgatttacaaaagttctcttgtatattcaagaattgagtctttttttttgactttttttattatactttaagttttagggtacatgtgcacaacgtgcaggtttgttacatatgtatacatgtgccatgttgatgtgctgcacccattaactcgtcacttacattaggtatatctcctgatgctatccctcccccctccccccaccccacaacaggccctggtgtgtgatgttccccttcctgtgtccaagtgttctcattgttcaattcccacctatgagtgagaacatgcagttcttggttttttgtccttgcgatagtttgctgagaacgatggtttccagcttcatccatgtccctacaaaggacatgaactcatcaatttttatggctgcatagtattccatggtgtatatgtgccacattttcttcatctagtctatcattgttggacatttgggttggttccaagtctatgctattgtgaatagtgccgcaataaacatacgtgtgcatgtgtctttatagcagcatgatttataatcctttggcatttataatcatttataataatcatttatttataatcatataaatcaaataaatatataatttatttataatcatttggcttttagcagcatgatttatatacccagtaatgggatggctgggtcaaatggtatttctagttctagatccctgaggaatcaccatactgacttccacaacggttgaactagtttacagtcccaccaacagtgtaaaagtgttcctatttctccacatcctctccagcacctgttgcttcctgactttttgatgatcgccattctaactggtgtgagatggtatctcattgtggttttgatttgcatttccctgatggccgctgatgatgaggattttttcatgtgtcttttggctgcataaatgtcttctgagaagtgtctgttcatatccttcgcccacttgttgatggggttctttgttgttttcttgcaaatttgtttgtgttctttgtagattctgatgaatctacagatgagtagattgcaaaaattttctcccattctgtaggttgcctgttcactgtgatgatagtttcttttgctgcacagaagctcttaagtttaattagatcccatttgtcaattttggcttttgttgccattgcttttgctcttttagacatgaagtccttgcccatgcctatgtcctgaatggtattgcctaggttttcttctaggctttttatggttttaggtctgacatttaagtctttaatccatcttgaattaatttttgtataaggtgtaaggaaaggatccagtttcagctttcaacatatggctagccagttttcccagcaccatttattaaatagggaatcctttccccatttcttgtttttgtcaggtttgtcaaagatcagatagttgtagatgtgtggcattatttctgagggctctgttctcctccattggtctatatctctgttttggtaccagtaccatgctgttttggttactgtagccttgtagtatagtttgaagtcaggtagcgtgatgcctccagctttgttcttttggcttaggattgacatggcaatgcgggctcttttttggttccatatgaactttaaagtagttttttccaattctgtgaagaaagtcattggtagcttgatggggatggcatggaatctataaattaccttgggcagtatgaccattttcctgatagtgattcttcctacccatgagcgtggaatgttcttccatttgtttgtatcctcttttattttgttgagcagtgttttgtagttctccttgaagaggtccttcacatcccttgtaagttggattcctaggtattttattctctttgaagcaattgtgaatgggagttccctcatgatttggctctctgtttgtctgttattggtgtataagaatgcttgtgatctttgcacaagaattttgtatgctgaggagtcatttttaaaataaatatattgcaaatgaattttcccagtcagtgaaaagtctgactgaaagctgtcaactgaaaaatcacacaatttataaatttagaagggagattttattttttataaatggttacagcctgcaaggtggccattcccacagactgggaggcataccctcctgctgaaaccgaaaagtaggtttccagggaggggaggggggaacagggatttatgttgatctggtgggccacatatgcatattcaacagggaataggaggagctctgaatattcatgaagggatcgtgctgcatgcatgctgagtaaacaagcctgttacatgcaacccatgttcactttggggtggagatgacatttaaatacattataattagtccctatgcttcaaaaggggaagcagggacacaaaggcagtcaagtgcacagcctctgtaaaacgtccagaacccgtccacagccagtgctctcttatcaaggggaagttactgaaatcagtctcttgtccaatcaaagctgtagttatggcttgtgtagggagggctcagtcagtttatggtaatgggtgagctgcaagtgcttcagcattgcttatctcaaggccagtgcttgtttagctagagaaaaaaaggaagaagaaaaaaacctgtggcaattggaacatagtttattctttaagttgaggggtgcatgactccaccttgcctggcgtggccttaggtctcgtttatcataccatatcttactactgcaaggagtctgttctgtcagtcttaggatctctattttaacaataatgctggtcagttgtgtctaaaccacaaagggagagagtataaggagaggtgtctgagcttccaagtactggccaggaactcagtatttaagacttctctggggtctccttggcaaagaagccatctgtccagctagttgggtggcttcagattttaattttagttctgaaagcatttaatttgatgaaattttgccatattttttctttatttttaaagcccgtcatgttctataaaaatctttctactcaggatgtgaatggattctcttaattttatctctctatgagttccagagtttcagttttaatttttaaattgatgacatctaaaattctactcctaaccaaaacatttttgggggtgactaaggacaactccaaaaatcttccataaatggaagtaagacttactccttaaagaactttctgggatcctgagctgcggggcacagtggctttagtgcacctctgctcttaagactattcagaaattgtctttgtgaacccatcaggctgtttcaaaatcagcaatttagggcttgcttgcaacacgcagttaagcagcagctgttttttggatctcatgagtgcctgcatgcatacttccctgggaattttctaaatttgaattctcatggtatttcaagtggcatagttgtctctttcttttgcctacagccacatacataccaccaaatcctgcactccaagcttctccttcctcaccctgaactcccaacctccagttagacaatccacatcttcccacacctgcctcaggctccatcaggccactgtgcctcccgcagcaaccaggccagggggaatctggattcctattacacttctgaggaaggtgatcagggggcgtggaggatgtgggtgggaaggggtgagattgagggcaggagtacactgtggtcttctgtcttctacctcattggcccaggtgctgctcttcctccggttgtctgctttcagccctgtgtagggaatcaggtctgcgccctcatcttcctgactctcattttctgaggaacctgaatggatgagccgtcgctcttgtcccacacattgtgtccaaaggtgccctcctctctacttgctccggtgcctgctctctgagctctgacactcaggctgggatgccgcccagtacagaagctctgcagccctgcagggctctgactgttccacaccagcaggataaaggccacagggcatgctgtggtcgaaaagcattcagaggtgtgggctgaaggcctctctttccacagtccctttgaacaccccatggaagtcagcacccctttgaggaacgaggtggcccaaggcctggcttcacatgcaggccgttgggtcccagtgggtcctctctgtgcctggtatagccaacggcttcatgcatcttacccggtttcctctcctccaccacccaagctcctccttgacccccttgctcagctgttctcaggacagcaagatccccagcccttggaaaagcccatctccagtgcttggggagggagttgggttcaggtcgtctaaccacagaaggacagagaacttgaggcaggaggaaatcccttcccttgctgggtctcttggcacagcccatccaggggtctgggtcagggtccaggtatactctaccctcctataggacctggatttttaggcccccgaggttggtcaacgtggagtctttcccactgttcacctgggaactgaaggaatatcccatggggccctctcttactcattagagacacccagaaaatactccattcagcagaaactgcgtgcagtgtaccagaccactataattataactgcagggtgtggaggtcagacacgttttgtggctattttctctctgtctgtgacttgcttgccttttcactttcttagtggtatcttttgatgagaaggtgtggctaatgttgatgaagtctcatttatcatgtctttcttatatatgtattttttgtgtcctgcttgttggtagggtgatctttgcctaccaacaagtcacaaactatccttgaaatgctttatatctttaacttttacgttttggtgtgtaatgtacctgaaattacttttgtgtgtagtgtgagggagaataacattgttggtctccccacattcatataaaagtccattaattgaaatgatttattttcttttattgaactgcttttattgaaaacccatttattgaccgtatagctgtggatcagtttcaagtctcttaactcagtctgtttatctatttgtcactcctgatgcctcgtctgtaatagcttatagtaaaccttaaagtcagatagtacaagtccttgttcttttttacacattgcaataatttttgaaataggtaataactcataaaaccatcacacacatcaggatatgctgtcacttcatccctttctgacatggtttggccgtgccctcacccaaatctcaacttgaattgtatctcccagaattcccatgtgttgtgggagggacctaggaggaggtaattgaatcatgggggcgggtctttcctgtgctattctcctgatagtgaataagtctcactatctgctgggtttctcaggggtttctgctttggcttcttcctcattttctcttgctgctgccttgtaagaagtgccttttgcctcccgccatgattctgaggcctccccagtcatatggaaatgtaagtccaattaaacctctttttcgtcccggactatgttatgtatttgtcagcagcgtgaaaacggactaatacactctcatttctgagtgggacacatgctgtcactcacatatgctggttgctgacttgtgacggaagattctctattgtaccctctggggacaatacatctccagttgcctgcggggaggatgaacatgcaaaaaatccacaacactcagcacagagtctggatttagtcccattagtctgaatgggactaatgcccttataaaagggacctcggggagctctctcgccctctttctgccccctgaggatacaatgaggaggtggcagtctacaaccagaacaaaaggccctcaccataaacctaccatgtcggcaccttgatctcggacttccaacctccggaactgtgagaaatcaatttctgttgtgaatcagccacccagtttatgtatggtacagtgttagagaagcccgaactaagacacagatggaatcccatggagagtctctaatttgctaagctggtcatcaggcgggatgttgccagttagaaacaggaagagctgacattttgtgtatatgaaagaagatagtggacaggcccattgtgtcggctttgtctgccttggcaaactggagacggaaactcgattcaccatcgccagccacgggaggactgggaggacctccagaggaggttaggttgacttcatggtaactttagatcctgaaacctcccaggatatttcttgtcttccctttgatcgctcttccgcctacccaacaggacaggactcgacgcctttctttcctggcagcaagaggtccgttgcggacaagaccaaagtgagcagctggtttcccctacgtgtccttccgggcctgggcgtctctggagctcaggctgacccgagacctgactcccggccagtgggaccagcaggagcctggaagagcgcgcccaccggggtggaggttggtcgccgggggtcgagaaccgcagtcaaaccctcttcttccccgggcaccgcgcacctgcccccggggatgccgaaggaagtggcccataaagcttctctgcaaccgaaagaggcctgaagctccaggagggccgagaggagcctcgttgagcgaacccagccctctgcctggctggccctggtcaacaggctcggaagaggctgatttggaggacagaacggaagaaaagacctaaaggtttcgaatctcatgatgtagagatgttaaaagcctccaatcctaaggtctgactgtgcgggggagcgagggggtctcaagctggatggacccctgagccttcatctggagagtcctctgcacaagctcagacagcaggacaacgcgcatcagtggttctcaagagggggcaacttcgcccttacacgcctctcacctccacgctgggacactaggtcacgaatgggggaagcggggagggagaatgctaaccccctggcatgtatctagtcagcagaggcgacggctgctgctaaacaccttacaatccacgggagggcccctcccctaccccgaagtagccattccgcagaggtggagagactctcgtgtagctcaatgcccacgcacttagccgatgggaaattacgaattgatgaccagttggctcttggatctgaggaaaaaactccagagtcagagggaactctcgaagttttgcccggagcaaacggaagggtggctttgccatcgcctaagatgggaaaatggcaggtgtcacaggttgcaggggaaggtcggagaccagctgagggccccggagccttcctggaaagagtttcccatccagcccgtctcggtttccgcatccgtctgattccttatgatgttgagggtgctggcgtctgggtcctttatgatgcagagggtgcccccgtctcaccctgggcgcctccgcgctcccgcctcctcctggcaacctggtgcgcggctccggacctggcgacccacgaccggctggtcacttgctgccacctcgcaaaggcgcatctctagttcagtggtgagctgcggccgggtcgctgcaactcgctccaggcctccggactcgtggcctcggtgtccctcgcggagccctcggtgtgtcgcttgcaggctctttttttgaagaaagcagggagggaatggccttgtgagagactccaggagcaaagagcgaccctcacaaggcccaagtcctcccagagctcagggaagctgtcgcttctgacagaagaagggagacaaagctccctcctgtgtgtccctggtggtctagtggctaggattcggcgctttcaccgccgcggcccgggttcgattcccggccagggaattgttttacactggccgccctcccgcaggaatcttccttcactacgctgtcagccggcctgctccaagggccagaagcagaacagtctccgcagcggggttaaagccgggcgaaggagggcaagtgctggtggaccacctctcacgacacaccgttcctgtttatctcagtgtccgtcatccgcgggagcagctttagagagcgactgagcgtctcgctccggtgtacacagcccggcaaagatgccagcccccgtggagctgcacccaataagcccaccttctttcccgtcgccaccccggagacgcccatcgggctgagctgcgaataactaagagagaggccaagccaagtcgtggcgtttgtggcagccccggacacgggcaccagccagtcagcggagcctcctcacctccgttgccagcgaaggcgctcgttaggccttgggaagaggcgaccggaggcgatgcccgcgaatttgttaggggggtaagcggcgggtgaggtcctcgagggcggtcccgtttgctgattgagcggtagacggaggcgatgttcgctgacccaacaaggacagcaggtggagtaggcacagatggaaaactgctgccggtgccctaagcagaaggcaggtggaaaaatcagcactaggacgtcgaagcgatggtaccacagtcaaatcccacgacgtctacactctaccaagcacttgcgcacgctcccccttttccattcagtactcccaagaggggttcggaagaaccccgagtccattgtaagctcaggggagagcgggagccagggaggtgaagtgcgcagactcggcagcggcggcgggcagaaccgcgggggggtgagagggcgcggtggctgcggggcgggagccgctgctgagaggcggcctgggttgtcttgtggggtgactgtcggtggaatctttggtggagagtggtttggaagaatggcgaggggcggcagtggggagggtggtgaccctgagcgaccggccagggcgaggaggctgtgctgtccctgcaggccatgtgctcatttccacttacctggcaggggagagaccgtggtcacgaagggggttctcccagagtgaagcttcttcatctcactctagagttgctgatccctgtgatttcctccatgtgggaaacggtgtttgtgctagaagaggctgcgctctttacctgacataacggggttcaagactgacaacgcctcacgcccacccgaaaacgtttacatggcttccttgtctctttttttttctgtcctaaagtcgcctcatcttcacatcccctcttttttttcttccacactcgagagtgtctctctctctcagtaaaagctccaccaaatatttgaaatatctcaaccagaaagactgcaataaatacattatttcattcgtggaaggtacagaccagctagattgagagttgcttgatattttctgctaaacggtgaggcatagagcacttggaaggtttctctttgggccactgtttgtgtactcttgggtttccttcttttccccagacagtatggcgctgtggggccaggggtaaaccctgctttccggctttctggctgcagataaaggcctcagctggtgcaggaatcaaaagcaaaccaaaagacacgtgggttcgccccagtgggtccaagatagagtctgactgtaccaggattccgattagaacagaggttgctgcaggcacaacgcagactactaaccactagagaatcccaaggcgccccacacctactgcccgtcgttttgcttccccacccctctattatttatttgtatatttttttgagagacagaatttcgctttgtcgcccaggctggagggcagcggcacgatctcggctcactgctacctccgcctcttaggttcaagcgattctcctgcctcagcctcctaagtagctgagactacaaacgtgcaccaccacgcccagctaatttttgtatttgtggtagagacgagctttcaccatgttggcccggctggtctcgaactcctgacttcaagtgagtgatccacccacctcggcctcccaaagtgctgggattacaggcgtgagccaccgcccctggtcccccgattttttttattaatgtaaaaacattatgcgatttttacttctttattcttgggcagctacaggttcttgtgattttctctcacatcttctccccatttccccctctccattctgatacatgtcccatcttctctgcatccagccggtgccctctgcacgggcatcctgggctgtcccattgtctagtcctggtctcccctgcttctccctcctccttgtcacgttttcccttttgactcccctgcctctttcccgctcccgccccaccgaccccatctactgaagccgagttgagtgaagggagagcaagcggaacagatgattgcctgaaggcggcgcaaaagaacagaaagagctaccgtgagagccgtcggggagttcagcttcccttgggccctacttggctcaggctggggtcgcagatccaggcatttccagaggcactggcttctgaagcaggcgagggtgaacgcagggtgaaggccattcggccgcccttctggcttcagagtcacgcaatgcacgcgtttctaacgtgcagcaagacgattagtcgactcagcctctccggttttctgaagctttgtagtctgcacagttgtcccgcagaaagcgaatggcaactcctagggtttagtgattgcttaatctatatagagatgaaagcaagcgattgaggttgtctctgtggtgcaatcggttagcgcgttcggctgttaaccataaggttggtggttagagaccacccagggacgtgattttaaatgttggttgtgaccaggcgcagtgcctcacgtctattaatcccaacgctttgataggctgaagtaggggaagcctccacggagctcagaagttcaagaccagtgagaatcccacctcatttaaaaaaaaaaaaatgcagttgtatctatctcctcagacccttcaatgtatttaaaagtgaaagactgttcccttgtgtcttgtgcatcccatgaggacagacagcagaaggtccccctccaagcctcctagaaaatgagatctctgcagaacaaactagcttgtatgtacgggaaacggaaagtatttgaaggaacaaacttcaaaaattctgccttgctttccacaaaaattaacccatcacagtctgccttcaagtggcatcatacctcttcccatgactcctccccctgcctttatgctattgtcatgcattttactttacacctgttataaaccttacaatccatctctattacttttgtttcaagagtcagatgtgtttttgtttgtttgtttatttttgtttttttgttgctggtggtggtgtttttaagacgagtctcactctatcggacaggctggagtgcagtggcacagtcttggctcactgcaacctctgctttccgggttcaagcgattctcctgactcagactcctgagtagcagagactacaggcttgggccaccatatcggactaatttctgaatttttagtagagaggaaggttcaccatattggccaggatggtctcaaactcctgacctcaagtgatccaccttccttgaatcccaaagtgctgggattccaggcgtgagccatcgtgcccggctaaacagtcagatgttaaaattatatatttgcctatgtacatgtcatttctagtgtcttttttttttcatccagattttcatctggtgtcagtttccttctgcctggaggactcctttaacttgtctattaggtgtcttaaacttgcactgtcattcactgatgctctgttcatttaaaaaaaaacttgttggccgggtgcggtggctcacgcctgtaatgccagcactttgcgaggccgaggtggtagatcaggaggtcaggagatcgagaccatcctggctaacacggtgaaaccccgtctctactaaaaatacaaaaaaattagctggctgtggtggcgggcgcctgtagtcccagctactcaggaggctgaggcgggagaatggtgtgaacccaggaggcggagcttggaacctgtcaaaaggcattcttagccttaaaagaaaagccagggacatcccttgcctcaggactctcgaacttagaaaaacctttcaccctctatgtggatgaataacaagggacagcttcaaatgttctaattcaaaggctgaggaattgctttggaccagtggcttatttctctaaacagctagaccaggtggcagctaggtgactaggaagcttgagatctgtggctaccatcactttattgttagaagaaaccagtaagtttaccttgggacaaaaattacatgccataccaccccacccccaccccctgccaccccatgaagtacagtacagagggtcctagaggcaaaagtacaccaatggctaacagggagccagttacttaaatatcagacccttctgcttgacaccccagatgttaccctgaaagtatcctgattttgaaaccctgctactctgttgctgcacctcacatctcaagaaacagatcccaaactcattgactcctgtgtggaaaccacggaagagctctactctagaaggcccaaccttgaagacaagctgttgtctaacccaaatgttgagtggtttagagatggaaatagctatattcatgagggagtaagaaaggaagcttagccaacaagaagtcattgaggccaagggtttaccttctcagacttctgttcaaaaagcagaattagctgctctaattagggccttccaaccatgaaaagacttaagctggacacggtggctcacgcctgtaatcccagcactttgggaggccaaggtgggtggatcacctgaggttgggagttcgagaccggcctagccaacatggcgaaaccccgtctctactaaaaatacaaaaattagccgggtgtggtggggtgcgcctgtaatcccagctacttgggaggctggggcatgagaatccctgagtttgcagtgagctgagattgcagtgagctgagatcatgccactgcactccagcctgggcgacacagcaagactccgtttcaaaaaaagaagaagaaaaccaaaacctcaagagtcaatgtgttgactgactctaaatatgggttcctggtgctccatgctcatgcagccatagggaaggaaaggggactatcaagagccaagggatcccccacacaactttactcagatcttggaacttttagatgctgtccaactcccaaagaaataacaattactcactgcaggggacaccagaagggagacacttttattattagaggaaattccctggtggaaagagcagctaaggccacagctaaggaaaccctggtatttcaggctgctgcgctactaccaggtactgcatccgtgtcagtgacaccatactatacccctaaggaaattaaagggactgagtaaaaggcttccagggagacccctctggatggttgctagaaaagaacaaactctattcctgaggctgacaaatgggaaataattaaacattttcatgattcctcacatttgggacaggattttccatttaaattagtttcctaaatattcttgcggaagggactgttccaaactataaaaagggttaccactcaggaagccaccccataccccgatccctgcttaaacctgtacaacaccaaggaacataccatggtgaagactggcagacagacttaacccagatgccaccttacaggggagtacaagatttgctagtatttatagacactttcaccaggtggatagaagctttccccacaaggacaggaaaagtactggaagtgtctaaattcttaaagaaatcattccaagatttggattaccaaaaggtttgcaaggtgacaactgacctcacttcacagctaaggtgacccagtgaggtcatgcctcagccttaggcattacctatcttcactcctcatggagatctcagtcttcaaataacatagaaagccaatcgcgacattagcaaaactctttcagtttgggggcttgcctgccctgcgtcactatcattgtttccttgggtttcccaggaatgtacatgtgtcagactgccgccctgcttatagatctgtttccctgcaaggaaacaggaatatgttgcctgtggcttccagagttggagatacatgtagttgcacccctgagggctaacatttaattttggaatcaagtgatgcattcagactggttgttatcattctgtggtatatatttagtgaacacattctgattgagtttcctgcttttagctggagcaagaaagtttaataattgtgatttgtatgaaaaaaatcataggcaagggaatgggtgtaaaataaactttattgtcagaggtttctaaaggctcatccttcaaggaaaacggacatatgctgaagagctgataaaccgtctacagcagtgttattctaagctaatcttgattccaagttcttgccattttcctccagctgctgttgactccagttatatataggatgggggaaaggggattatctatgaatgtaggcatcactctctcttgggcagttatcacattggcagactgaagggatgtgatttctacagtcaaactatccatttggagtacaaatctggagtggctgtaaaattcggttctcagagatgaacttgcagattcagactttcaattgttctgttgttttagtttttctcatcaactggggaactgtttgtgactaagctttgttaaaagtagagaagagtttttcatagttccaacattagttgttacccgaaacaaacaaaaacacacacacatacaattaaacaataatctttggtgaggtcttgctgatacctgaggctggagtgagagctgactggtgatacaggccaggtgcaaactgagtgcaactaagtggataatctccagtagtgaactacagtctagaagaagatagtaataatagattaaaaaaaagtctcctgaagtgaaccagctggcgtgtggtgtaggacacaggaccccacccaccttatgattctaagagccttgctcaaagccactgcagttgagttcgctaggtctctaccacctcctcagcatcaattgactctccataatactcctctggagagaaataagggtctttcaacctcccaggaagggatttgcttagcctcaaatatgcacattcaggaatagcttgtcgtaagaaagagaggatagtttgcagagaaataaccctcctaagtccacatcctattccttttaaataagagagtggtgacaagggaagagccctagaatgtcaaagccaacagggtgctcagataccacccaagtacagttccatctttggccataaggagacaatggtgtcaagaggttaaggccgtatgatctgtaggtgaaaaatctgggatgggaatcaagtcctcaaaccttttccactacatcacagagtttaggagcagttagagggaaggcttcaatctggagaacactaacaggctctagagattattgggtcatggtggctgggacagaaataaggattcacagaaagatgtttatagtaaatgttcttttgggattttgcttgataaaaaggctgagcaaaagtaaaaatttatttcttttcttttcttttttttttttttttttgtttagacagtttcactcttgtttcccaggctggagtgcaatggtgcaacctcagctcaccacaacctccaccccctggggttcaagcaattctcctgcctcagcctcccaagtaggtgtgattacaggcatgcaccaccacgcccagctaattttttttttttttttttttttttttagtagagacagggttcctccatgttggtcaggctggtctcaaactcccaacctcaagtgatcctcccaaagtgctgggattacaggctccagccaccacacccggccaaaagtaaaaattttctaattgcaattctgaaccacttaggggttgtgaaatcaatatagtggactgcttattactacaggctttatttaaattctaggtagggtggattacacatagtaaaagattttttaaaaactgatcacaggacaggcgcggtggctcatgcctgtaatcccagcactttgggaggctgaggcaggtggatcacgcggtcaggagattgagaccatcctggctaacacggtgaaaccccgtctctactaaaaataaaaaaaaaaaaaattagctgggcatggtggtgggtgcctgtagtcccagctactcaggacgctaaggcaggagaatggtgtaaacccgggagggcggagcttgcagtaagccaaggtcacgccaatgcactccaacctgggcaacagagcaagactccatctcaaaaaaagaaaaaaaaaaactgatcacaaagaattgtatatttctcactgcgtcttgtggtcagaaaagtttgagaaactactctacataggcaaattacaggtccaatctctccatctacctctttatctcttctctatttccacgctatgcagacaagaccacggagagaggaaggcaaattccatcaatgggtgctgttaagccttttctatgaggtagctgcacatttggggcacttcaatactggttacttgagattctagtagacagattgtccttttcatctctagccacatggtaaaattacttgggagctttttaagactactagtggcttccacccacctggaagcatttaaatcagaatctctatgtgtagagtccaggcacttgtgttagttaaaacctcaccaggctttataatatgacagagtggtttaaagctacggagtagacccaccctatttcctacctttctctttgtttctctttcaccataggcttctttcccatgagaaagtaaagattttagtctctgttttcagagtctcaagtaaatcactctctttctcaactggacttccaaggcaaagatttctttctatttatctatctgcatttttacaaagttggcctctggattcccttttcccaaacctaattcaccacaaaggtgcccctcaagtcaaggagctgggctttcatacacctgcacctgtcaatcatggtaaatattttgcaggcagggttgctgggtgctgtgggattgacgtaaactcccaggtattgccagctctgagcctcaggcaagcttgtgactaaatgactccagtagtctgaggatagtccttactcagaagggtctttggaagcaaaagcaaacataggcatgagagggtaaaaaaaaaaaaaaaaaaaaaaaaaaaaatctcatgtcatcttggcttatacctaacagaacttgtgcaagaatggatattaaggtgggtattgtacagagcagaacttaataaataccaagtctggagtttaagggataggctgaagagattttgcaggcttgtaaacatttttgccaacttgaacacacttttgtttgggtttggtttttctcctcattggtaagagctacgcacaatagggtagctaagatattataatttgaatcgatacatttgtattttgccaaggatcaagatgaactatgatgatttccattttttagtactttattttcatcagtttgaaaattaggacttttgctccttttttggcttgtggcacctttttggttttcacactttctcaaagaccagtaacttagaatctaaattatgattgcttattctttcagtactctaggggaaagttgatttaatcttgacaaaatgtattcagttaaaataattgttctcttaaatctttctttctttctttctttcttttttctttttttggagatggagtcttgctctgtcacccaggctagtgtgcagtggcacaatcttggctcactgcaacctccgcctcctgggttcaaatgactctcctgcctcggcctcccgagtagctgggcctataggcgcatgccatcacgcccggctaatttttgtatttttagtagagatggggtttcaccatgttgttctcttaaatcttttcaccttttaagtttgtccttcctttctccaatttgcaataggggagtgtggctcgcagctaaatagtagacttctcagagctacttattcctggagcctggcagtctgcaggcctggagggggagcatctagaaagcagccctctctaagttgagaataactatgagaattgtgggttataaggctttgagcagctctggcctccccgtcctcttttgtttctactgtgggatgtgacaagagaaggaactcatctgagagagacttcatattgtggcctttcaccgattacttctggaaatttgattcaggcaagccagggagagtgtctggtattcttctctgagaagaagaattcattatacagctggacaatggaatctatgatctgcctgtagaggttagaggtgcatcctgttccgggaaataattacaatttaggcaagttatacatgtttgcttaagagaatgctttctgcacatttcatgttcttcctttctatcttagcctagggagaaaaccgtggggactcagggctggaactttagtgtgatggggcagaagcttaattttcacatgattctcaacaaatggcagcatatcccatgtattatcatgtccaatggctgcaatatgaaggaggcttttccgaaatagttgctgctttggtaaaaaattaactagatggattcaaagtcaaatttgaagaaagctgagcaggcagaagaaacaatcagtgaacctgaagataaggcaatggaaatcatccagtttgaggaacagaaataaaaaaagattgaagaaaagtgaacagagcctaagtgaccatcaagtggaccaccatgtacattgtggaagttcttttttgttgttgttgttttggggggtgggaggggggaaggagtttcatttttgctgcccagactggaatgcaatggcgctatctcagctcaccgcaacctctgcctcctggtttcaagcaattctcccacctcagcctcccaagaggctgagattgcaggcatgcaccaccatgcctggctaattttgtatttttagtagagacggcatttctccatgttggtcacgctggtctcaaactcctgacctcaggtgatcctcccgcctcggcctcccaaaatgctgggattacaggcatgagctactgctcccagccttgcattgtggaatttctaaagaagagggagagaagggcaatagagaatatttgaagaaatcatggctgaaaacttcccaaatttgatgaaagacatgaatacaaacacagtagcctaacaaactccaagtaagataaacctaaagagacctacaccaaaacgcattataatcaaactttcaaaagtcaaagagaatctttaaattggtaagagaaaagcaactggtcacatgcaagaaatctttaataagattatcaacagatttctcatcagaaactttggaagctggaaggacaggaaatcaaaagctgccaacaaccaggaggggtggctcatatctataatcccaacactttgggtggctgaggcaggcagatcacttgaggtcaggagctcaagaccagcctggccaacatgacaaaaccctgtctctattaaaaatacaaaaattagccaggcgtggtggtgggtgactgtaatcccagcgacttgagagaccaaggtgggagaatcacttgaacctgggaggcggaggttgcagtaagccaagatctcgccactgcactccagcctgggtgatagggtgagactctgtattaataaacaaacaaacaaacaaaagctgcccgtgaaagggaaaaggatcaataaatgggtattccaaaaagtcaaaagtcacacaaatatcaagccaaaataaactggtttcctgactggaaatcgaccccaggctatggcagcaaaacacagaactttaagcactgaactgcaaggtagagcagactttattgtgcatcctggaagggatccagagcaggcagtttgagcttatgaagaattttaactttgtttcgggtcaaattttgctctttaatttagttaagagaattttttttccctacacaacacacataatattgtcaagagaatttttaagggtagccatgacactattatgtgtgtttgttttaatttgatcttcctatgaactgttaaaataagagatctctaaaatcttttttttttttaattcaggtgtctaatttaagggatccatcttcaggccattggcaagtagaatttccaatggtgtaattattgcaatagcaattcaaccaaatagcccctttgtggaaagcccaggatgtcattttccaggttaacctcctgggaagggcaaagaagaagcaatcccaaagattcccctgcaagaaaaaagttcaatgcaaggagtagaccacagatgggtaaggatgatgttggcctccagtaacccagatatttatgggggcttccagtcacagacctctgaatctataataccaggtaggccctcttgggattgagctttcctaggactaaccaggcaacaagaattgagatgacaaaagcctcaaagggatgggacttcttaagacaaaccccaagagcttgacatggtcagaacaaaaagtgtgctggggttcccagccattttcagacaggccacctagtatgacctgatagttactgcctctttccagatagtggaaaccaagagaaagcgctcccacttgctcacaagtcaagctctcaaggacataaaataagatgagaaggaacctcaaccggtacccccttttatgacagaataacacatagagacaaagacaaaggaacagacaatttctgggaacaaagggattaaacaataggaattggtaccacaaagtaccaaaaagcacaccagagtcactacacccaagactagtcacacaaatccttttctccaattaatcaagattttggagagggaaaagaaagaaacagtgatttttactgtccacttgatgagattccacacagagaaggaggccaggagcctggctggtaaaaaaattcttacccttatgacagctgatcagatcctgggttcttcactgcagcttccagaagagcagagctttcctatcctgcttacagctccaaaactgtaggggccaatggaaaccctccctcttaaccctctgaagtttcactcaaaaatcaagtcgcaaaaggcagattaattggaaaaaaggcataaaatgtactaacatgtgcatggggagagtcacagagtgattaccctcccctacccacaatgggatgcagaagcttatataccatcttgaggtaacagaatgaatgagggctcaaagcatggccaaaaccaggtgcaatcagagtcagaggtatatccaattattgtggacaagataagtgatggtagggagagaagaggaggcttggctagcaaaggtggtcttaatatgtaaatgaaaccctacagttagcagctctcagagagaataaaccctaaaaatttctttcagacctttacatgtgtcagactctcagttaatctttcctagatctgggcaaggaaagacttggctgtatcaatgcagattccctacagatgcaaatctccccaacaaaagacaactttgcagggctacttctgcagctggctttctgaacagacatctcaaaatatgtcaaagaaatgtagtttggggtcaaatatttttaattccttcacatctacagcctgatgcatcggccgtttcaatgcaacattgttggtggcaactccattcttccctatactcaagccaaaaaaccaggttctccttgaggctagtctttttctcacagcacacatccaatttgtcagaaaacttatgtttcctgtttggttaattacagattttgatctgcccaatctttctctttcttggtctctgaattttggcaaaggagtctcctgatacaggcaggatagattctactgacgattctcaaaaccgtcagacacttaagagccttaatctcggggtaggggtttgggccgccctcgaaccttttctttgggcctccccatcaaaatcagtctggccaggcctgtcttcaaggcccaggggcagggccaggtcctcccgatgcttcttgaagcttctcctgccgggtcagcagccaccctccccttccctctgacctgcagagaagcttcagggggcatttattcaatttgctaggagctcacggatgcaggtgcgcggtgactctgtggttcccaccgcacccaccgccctccttggtcctctcactgtctgaagcgggcagtaatgttcagggtgagcttgggctccgaagacacccagtcaaggagggaccagtagggaagggcactggccccttaggtccttcccagctagggatccgaaaaagttcttgaagaaatagaaagggagagttggaagtagatcaaagggaaagaaagaaaatcctagatttcctatctgaaggcaccatgaagagaaagtccgcctcctctgggccgcgtcctcacgtcgctggtgaaccaagttctgttctccattggagaccaaatcagttgactttggcttgactcctagtgaaggagccccgctttgtcctcccctgtttagctcttgatcctgaagcacttgattgtctctcccgggcttttgatggatttcagggatgcaactgagaaatttgtttttaatgcacttaattgaagtaagaatattttaaagtattttggcaaagaaaaacgtttccttttgcaatgaagacattcagatgtaaggaaaatcactaggctctcacaaacacaaattccatgtcagcaagtagatttgaccctcaggttgggcacactttaagtgtactgttggaacttaagatgaatctaggacattcatgattaatatttttagttttttagtacaatttaatattttaaatttaaatacacattctgaaaattgtataaccagcacaagaaaccggctttacgccatatttacaaacataggaaagaaagatgatattttaaatgacaatgcttcataaatggcaacatttttaaagtacctagagaaaaaaagttaatctagaattctatgcaaaaataaaatttcataactgtgagtgaaataaggacattgaaaaaatacaaaagctaaaagaattcaccaacccatgctgcaagaaatcttaagagtcctccaggcagaagcaaaaggataccagataaaaatgcgggcctacacaaagaaacgaatattggaaatggcatttagaaaacatgtactacacgttttcttataatttaaatctttcaaaaaatatttgacgtaataaataaaagtaataatgaatcacaaagcttatagtgcataaagtaaaactacataacactaggataaaggccagaaagggaggcataatgacactagaaagcagactatgataaattaaagatgtatcccggaaaccctaaagcagcctcttaaataagaaaagggttatagctaataaagcaacaaaggaaagaaaacggaatgaaataaaagctatgtaaacactatgctggaacaactactctccaggcctccaccctatagaaatacaccagtggccaatgagagtgtacaagaatgatgactgcagcattacttgtaatcataaaatgataaaaccaacgtaagtttaaagatatatgaaaagggttttatttatttaacagacagacaatggaacaagcaaacaatgggagcaagtcctttgccaaaaggaacacagagggtcatgatgatgctactcctccaaggatttcagagttcccagacgcctagttttctgtctagttcttctggaagatgttattcttggggagcaataggtcctcgagtttggggctctttcaggttctctctccatttccccattctgctacaataaacaaacaaaaacaattctcacttccagaagatcccgcctgtgcctctgcatgcgcctttcaggaggtctggatgtctggtccaccgctcccgggcttctttcccagcttttgcttttccctttacctgctctcgccctacggccccagggccggaccacggcccagctgagccccgcggctccaccgcgcagaaggtgcgccggaggccctgccagtttcccgccctgcagggtactgagaaatcaacgatttgtaaaaagaacttccccatggaaaaaaatctgttgatttccgctctcagggctcttcaaaggactaaaagctaaaggcgacaatgaattcattcgacaagtcctagtcgtgagccctggtgagtgccagaccctgctccccccgaggggacccacgagcgaccctcaccaccatccctgccctggtggagcccccgtgcggaacacaggatccgaagatggcagcggaagctcctccgcggccccgagagcgactgggcagggtgggcacaggctcttcaatgggtgaaggcggcgcaaagaacgggaagaaccatcccaggagcccacagggcgttcagcttcccttggggccccaggcggctcgggctgggtcgccgacccgggagttcctggaagcttctgaagcaggcgaggggcagggcgggcgaaggcaattccgctgttctggctccagaatctcctaacgcgcaggcgtccaacgtgaccggcgcgactcaccgctctaatctctctggttttccaaggccttgctcggtggtcctgccgggcgggctctgggagtagagggaagggagttagttcagtgagtgggcccttcccatatcaccagtagaagcggaagcgcttgtctctgtggcgcaatcggttagcgcgttcggctgttaaccgaaagattggtggttcgagcccacccagggacgcttattggaacttttgaagcattcatgcattgtcaatcactaggtaaatggggaagattttatcttcccgaagtcccaagccactcatttatgactgatccatgtcaagggccgcccacctccccgaccagattcttaaccggctatctcctgaaatgccgggtttacacctgtgtaacttaggaatcctgaaacagagacctaggaacccacttctggtgtgataaaattctaattcagtcccttatacgcttaaacaagtaattcacgtgcctccattttttcatattttagtaataggagtccagtattacctccaggatgtgcctgggtttcctgattgctctatcaataatgtgaccagtggaatctttcatcatgatagtgatcctctccatcatttttgaaaacagtatttttcctcagtctgtgcatgatttatttaacccttttcaaaatgtttttgttagccaggcatggtggcacacacctgtaatcccagctactcaggaggctgaggcaggagaatcgtttgaacttgggaggtggaggctgcagtgagctgagattgcaccactacactccagcctgggtatcagagtgagactcccatctcaaaaaaaaaaaaatgtttttgagatgatgttggtttcatggttttaggattacaaagaatgctgcagtcaccattcttgtacagatatctttggtcattgtggaaatgtctacactgcagacatttctatagtgtagagagctggatgcgccattgctacattatagtgcttatataatgcttctaatttgagtccattctgcaaatgtgtctttcacgggagcagtaccaaataatattccaatatgaatatttataaaatgaaaatgtgcagatgtgcagttgagctgcatgcctctccatggggcccatgttcataaaatggtggcgttagcaatcatctgagagtggagtttgtggccctctgacgtcaaaatctgaggcaatggacatgaaaaccctcactgtacatcctccgtagtctggccagaatcattcctgggtcggtggtctcttatcaggagggaatgctgcttgctttttttgtcaaaaccacaaaagggagggaaagcatcaggctgttggttgataacagtagtgaagcaagtctctccaaaggcttggtttgttaacccttaggaaaaaaatcctaattcttgccagatggtgccatgcatttccaggctcttggtgtcccaaacaaagaactgtacatgacacacacaaagcagcaaagcaaagcaaaagtttattaagcatagtaacactctcagagtggggagagtggactgacctctgggatgtaagataagtattagtttggtgtactttgggtcgttttatgtgtgtttttttttcttctcttcacaaggatgcctaatcgttagccagtgtttgccttttgattgataggtgggttgcttagttactttggcccttgtgtgcttgcacattggctccatcccataattttaagtacatgcatgatgtgcagtccatatgcatgagttttaatgagctgattatcatacggagtcatgttaaggatactttttttctctcatgcacatgcctatctctgaggagctgcccctttactggtttggatctcgctggccatggggtccttgcttgcttttcttttttttttttttttttttttttgagacagagtctcgctctgttgcacagtctggagtgcagtgatgcaatctcggctcactgcaacctccgcctcccgggttcaagcgatgcacctgtctcagcctcccaagtagctgggagtacaggagtgcaccaccacgcccagctaattttttgtatttttagtagagatggggtttcaccatgttggccaggctggtctgaaactcctgacctcaggtgatctgcctgccttggcctcccaaagtgctgggattacaggcatgagccaccgtgcccggccttgcttgcttttttaaatcttactttttgttttggctgctcaacttctgccttttatcttgcttcttgctctcccaccccatcaccttgcttctgtttctgcttttactcgttctgccttttatccaacttccaattccctctgctgttctcctgcctcataatggcagttagtgagcgggggttttgaggtggcatgtccaacctcctagcctgccacatccagaaactgctttcaaggtttctctgtggtcctgtcagccaagagggagtccgcagttgactgtagggactagggcttattttcatttctcaatcctgacaaggtaaggctggattaacgcagattctctgcaggtgtaaatttcccctacagaagacagttttgcagagttccttctgtttgctggttctctgacagccatcttaaaatatgccaaagaaatacattctggggtaaaatattttgattctcttcatctatctacagcttcaccatgctggcagcctccaatccaagcatacctgaaaccttcttttttttttttttttttttttggtttgagacagagtctcgctctgtcacccaggctggagtgcagtggcattatctcggctcactgcaagcttcgcctcccaggttcacgccattctcctgcctcagcctctggagtagctggtactacaggtgcctgccaccgcaccagactaattgtttgtatattttttagtagagatggggtttcaccatgttagttagggtggtcttgatctcctgacctcgtgaccacccacctgggcctcccaaagtgagccaccacgcccggcccctgaaacctttctttttaaaaagctttcccacctttatgactgccttcaagtctctgccaaaacacaagtaacagtgactgactccctgctataccaagctcacagtaaatagcctttgctgtttttcatttggttggtctttgtttatttgcagaagcttcaatgtagagttgacaaggactccaatctttgaccaaaccttagtagtttcctctgagcccttttctctgttacttcttggcctgccaagtccagctttaggaaagaatcctgttgagtctagtttagcaagagtcctcgcaaccacctttgatagctaatcaagttcctcttagtaattttccatccactgactttcttatcttgccaattggctataatcctcaactcctcctgctgtatttgaggttgagcccagttctctgggctcaacctcaaatacacgtgtccagtgcagcccctcagaaactacctttgcaaaattatgacaatcagagaaagctgacatggctgactccatcttggttctagcctcacaggcttgctgtctttgctcattcctgtgcaatttctcccaagctatctttgggaaaaattgagtttatagtttaaatcagggctccccaatccccagggccataagacaggtactggtccatggcctgttaggaacccagctgaacagcaggaggtgagctgcaggctttcgagcattaccgcctgagctctgcctcttgtcagatcagcatgagcattagctgctcatcggagctcggaccctattgggaactgctcatgtgagtgatccagattgcgcactccttatgagactgtaactgatgccactgatgcctgatgacctgaggtggaacagtttcatctggaaaccatccaccacccccttccatggaaaaattgtcttccatgaaaccagtccctggtgacaaaaaggttggggacagccaaaaatctggtttaaatgataaccttccccaaaactaaattacccctgtaaaatgaatgaaaggccaccaagttagaaggatgaaagcggcctgatttctagtaagatgtatgcctccttaaataattaccagccattattccagaagtcacaagattggcagcttccccagttactgctgtgaagaacatcactattgtagaacctaagattggcctcttgagatgtcttttcaggctttggcatttctgactgctggatggcaccatttggcccgaaaatcaaccagtcccttagcccccacccagaagctgactccatgcaggagggccattttccatgcccctgtgatttcatccccaacgatcagcaccacgcaagccctagccccctccccaccaaactatctttgaaaaaccccttacctccaagccttcagtgagattgctttgagtaataactcttgtctcccacatgtcgtggctggcctgtgtcagtgaaactctttcctgcagtgccatggtctccatgaattgattttgtgtgtacattgggcaggaagaacccatcaggtagttacatctgcaggatggtgccagttctttccacaaaggctggtcagatacccagaaaacatttctccactactacctggacaatgtgtctccctgtcaatctccagggaatggggcctggatcaagtatttagtattcagcagttactacactgtcacctaatccctcattttcaatatcttgccatgccttccagtggcctaactggccaccatgccacagaatctttatggtctccaaggagaactctctacttgatgttttgtgatttgagcaatggaatagaatctgatactggtgggctgggggaggtacccggacactggtgggatctcgaccccagccgtggtgtccaggctcttgacaccatcgcgagaacaaagtcaaagatgagtcagcagatagtgaaagaagagatttattgcaaagcaaaaagtacacactcaagaaaggggagttcaggcatacccaagagagaacaatggattctggggtttcatcttgatgggtttctttaaccaaggagtggaatgttcatgaaaattcctgggtaaaggtggagatttctcggaactgtggtgccatccatttttacatcaaatattggtctcagaactgtcatggcactggcgggtgtgtgatttagtatgttaatgagcatataatgagggcctaggtaaaacctccgtcaaatccagcaccacattgggtccactcagccttagccagcttggtccacaccctggtttttcagcgtcttaacagcccacagcctcaagtcatgtaaatctgctgcctagaatttgttatcctgtgaccaccctgtagtattcctgtctgaaatctacttgtaaatattcaaatggtctttcacttgggcattccaactttgcttacttcacagtgtttcctgcgtaatatataagaaaagatgatccagacattgttaaacatctcaaataagatgtagcccaggtatttgtgtcaaatttggattattttgatttcgtctttgcagaatataaaaaactaacatgaggtaagcactaaggtgtggagatggctgtgcaagagatgacaaagtccagcaccacgcttgagagtgtccaatcatctcttctggggcagcatagttttctacaatactgattttggaaaaaaaatcaaaaaaaaaaaacctacaagattcatgaaactggacaactgtctttataacattaccagtgataaaaccagtaaggaaggctggtttgcagtcatctgagcagcctctttactttcataaacatggtttctctcggcttccaattgcaagtggaatgctgcatcacagggataaagatgtgaagagaaccggtttcttctgtaatccgaaacattctagtctgcgaattaaaagccattatttgaagaaggatgccccggctccatctggccaccgaaaggttgctccttaacacaggctaaggaccagcttttttgggagagaacagacgcaggggcgggagggaaaaagggagaggcagacgtcacttcctcttggcggctctggcagcagattggtcagttgagtggcagaaaagcagacggggactgggcaaggcactgtcggtgacatcacggacagggcgacttctatgtagatgaggcagcgcagaggctgctgcttcgccacttgctgcttcgccacgaaggagttcccctgccctgggagcgggttcaggaccgcggatcggaagagagaatcccagctgtgtgtcagggctggaaagggctcgggagtgcgcggggcaagtgaccgtgtgtgtaaagagtgaggcgtatgaggctgtgtcggggcagagcccgaagatctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttctaaaagtagactgtacgctaagggtcatatctttttttgttttggtttgtgtcttggttggcgtcttaaatgttaatcctacagtggagggctggcgaataggaagtaacatgtcgcctgcacgccataggagaaaaagcgagcatcagccgtatcggctttgtaacacaaattagctatcgtgaagtccgctcagctcttccctttctaccctggctgctttttgcagggattggtccgtggtctccagtctcttgggttctcaccctgtgtgaaaatcttcctgtttttccctaccccccaagtcacctcttacacagcctctgcttccaagcgcagcccccacaggagtttgtaggatttctgtgctagcggggagtgtgttctcacctcatagagccaggtagaaactacgcagatgggtgctgttctccaggaagaaagcagggcctttggggctctcagtgtccccgttgggttgtagacataacacgcttactttgcgtaggggaacggctctgccggcccccaggtgccctcgcgcatattcatggaggcccgtaggtcagaaccgcagtctcacctgtcttggcggaaatgccctgcgatcctcccggagatagaaggcgggaagttttatgaggagccaggtacagtttccctactatctccggcagttcatatatctagtgtttcttcagactttatttaagcgacagcttcttgtttgatgtctcgctcccacatcctacatccattgccaggcaactttctagatagcacccagacccatccttcccacccccaagcagccgtttcctatttctggtgccagtgtcctccccagtccctctttcttcaggccctcgcttatcaccttcatggacagaaaatacttagctctctctcaacctgcggtttatacctgacacgcgtcagtaccctgacaaattccttaataccctttctcaaatggcactgaaaatgcatttctttttaactcccagaagtatctaattggttttgtccctgaactacatgaatactagtattccactacagaggaaaaccccaggcctagcgatggcggttctgggcattgtgccagcctctcccagggtatgttttctgacatcacctacttttgatcaactgaggtcaggagttcgagaccaccctgaccaacatggcgaaactccgtctctactaaaaataaaaataaaaataaattgccgggcatggtggtgtgggtctgtaatcccaactactcgggaggctgaggcaggagaatcgcttgaacccggcaggcggaggttacagtgagccgagatcgtgccattgcaccccagcctgggcaatagagtgagactctgtctcaaaaaaaaaaaaaaaaaaattagtccatctgagacattgttgttggagacagtagaatcctgcatccaacaggcacttggtgcagatctgaacccattgagctattggctcatgttccctatgttctattaagtatcatgagcagaaattgagctctttggcttttacccactgagtatggctataggacaggtctctctctctctctctctctctctctctctctctttctcattatttgcatcattattttttgccatcagtgtgggtttttggttttgaggctatgaagtgaatttctggggacaatctctgttgggtcgtgttgacaaggatccagtccctgtttggtgatacatgacagctaatctggtctgtgagtcttctttattgtctatttattgtcctgagaataatggtatttcctgaaatttgagactgcagcaatgataagttgttcagatcttgtctttccaatgtttggtaaaaattttataggcccaattgttgtcaatatctgcaagagtggcatctctattacaagagtgatcttactactcaatgtcccccctcccacccaacttcatttcctaggggctcttggctttaacgaatttactgtatctaaaagacatcttagtacaggaagaaaactaaatctgtagcatgtaaggagcagttttctttgattggtatattcaggtttctaaccagctgaaaaattcaaatacatgtcctttaaggattaagtttaaactacactacagaaagaagagaaaagatttatatgatcacatataagcaatggaatcagcaatatgagcacttttcacaactatataaatcaaatttagtaatctccagaacattaaggaagttcagcccttaatgaaaatgaatgaaaagaaattattcacccactgttacatgccctggaaagagaatgccctgcaggactcaaaagggtaccacaatattactcagattttcagcaatgaaggccctccaaggatctaatgatactcatattttcagtttatttccttcactgataaacattgttaatagataccattgcctctgttttcactttaagtgatgttacttagcacaattcatttctttagaatgccccctagtttagtgaaaggaattttcctgctttataaatataggatattttctcatgaaacaagttggcgtactctttcagtgaagggactagaccgattaggtctctaaaatgttaaaggagtcactgcctccattatcttaggaacaataataatcacttatataaaattaaaataagaaaattaagccaggaatggtggctcatatctacaatcccagcacttaaagagttggagaccagcctgggcaacatagtgaaactcctgtctctacaaatttttaagtattagctaattttttaaagttggcagggcatgataatgcatgactgtaatctcagctactagggagactgaggcaggctccagtgaactatgattgtgccactgccctccagcctgggtgacagagtgagactcccaactcaaaaaaaaaaaaagaaaagaaaatatagaatttgttgaaaattgttttactacaatgctaggctgcatgtcttgcacctgtactcccagcaactcaacaggctgaggcggaaggattgctttaggccagcggttggagaccagcctggggaacagggcaagacctcatctctaaaaaaacacaaggcaagctgagccaggaggattgcctgagcccagaagttccaagttggtcagctatgattgccctgctgcactctagcctggataacacagcaagaccctgtgtcttattttttattttatttttactacttatgcttatttatttatttatttttgagacagagtcttgctctgtagcccaggctagagtgcagtggtgccatctcagctcactgcaagctctgccttccaggttgaagctatttccctgcctcagcctccagagtagctgggattacaggcacacgccaccacatccagctaatttttatgtttttagtagagacagggtttcatcatgtttcccaggctagtctcaaactcctgacctcaagtgatgcacctgtctcggactccgaaagtgctgggattacaggtgtgagccacctcgcccaggctccttatgcttgaaatgtgaggtttcattagggaaaaattttcttgttgaatttctaacatgaaaaaataatagatttagctgtagattaaattaatggtcttgatagtttggtacaataaaataaatgaaatgaagttgatagcagagaggaatttttgatgcttttggacaatttaaataatgtaatatttaatatataaagacatgaaaaagttcattacattattatatttatttatttatttatttatttatttattttgagacatagtctcactctgttgcctaagctagagtgcagtggtacaatctcggctcactgcaacctctgcctcccgggttcaagcaattctcctgcctcagcctcgtgagtagctggaattacagacgtgcgccaccccacccagctaatttttgtatttttagtagacacagggtttcaccatgttggtcaggctggtctcgaactcctgacctcatgattcacctgctacggcttcccaaagtgctggggttacaggcgtgagccgctgcatctggtctattatgttattttttaaaagtcagtgtgactcttttgacaaattagaatggtttaataatcttggttaggctgggcatggtggctcacacctgtaatcccagcactttgggagcctgaggtcaggagttcgagaccagcctggcaaacaaggtgaaaccctgtctctactaaaaatacaaaaattagccgggtatggtggggggctcctgtaatcccagctactcagaaggctgagtcaggagaattgcttgaacccgggaggcagaggtttcactgagccaagatcgcgacattgcactccagcctgggggggcaacaaagtgagattcggtctcaaaaaataaataaataaataaaaataaagtataaaaaattaaaattatgtgttcaagtaaattaaatatatggcaatgaaaaggaggcccagcatgactgactgcattttgctcctaacccttcctaccctgtggtgatgtctttcaggctaactgctttttcttctttctgcacataggccaagctatctatgggagggatttagcttacagtttaactttaaagcacagatgataataatcctttccccaaactaactcctgagaagataggcaggttgttgaagatttataagagcagtgtgacctgacaaaggacaaagaattttcaccatccccttgggctctcactgcagcccatatgtctgtcattgtcagacctcttcacctcaaccgcctccttcttcctcccttccctaacgtacaaggaacctgaaaatcatattaatttaagatggttctttaggatgttagttcaccatctgttcagtttggtggctctctggaataaagtcaccttccctgcccctacaccttatccctggacttattggccgtcatgcagcaagcggtgagtgcagtaagccgagatcacaccactgcactccagtctgggtgacatagtgagaccttgtctcaaaaaaataaaaataaaaacagagaaatttggttttagaaccagacaaattaaatgggagattacttccagtgagacctagaaatttctaaatttctaaaatttctaaaaaaactgagaaaattgcctccattgaggaagtaagctgaaggaggtaaactgtcatgttttctgaattgagaaatattgaggaggctttgtctctttcacctccagctgctccttctcctcctgcccctgcacctgcatagtctttcttacctgagccttcctgtcctgccttgcttcttcttccatcaccaccacctggggaaagtccccagggctctggccacttccccaaaacttctgttctgacagcccctttaaaggtaaaacccaaacccacaggaagaggggagcctaccattgtgtataccacttcaccaaaacgtgaattaagaatattataaaggacttccctgatctaaacttaaatacatttcactcttctgtttctaaagcaggctccgagattctataggctctggcagaaaatttgacttaactgttgaaacctttgagcccaaatattctgacctttatcaatcaattcacatgctggtgaagaaggcaaggccactaactggttgcaaaggcaaattggaaggattttcaaaaagggactgaagcagaacatgaaaggttcacattttcaccaaatatctccatgttgccactccccaggtccttcctaaaaatatagattggaggataattcagcattgtactaaaaagccagacaaatctgtctttgcttaattaaaatggtttgagagccaggtgtggtagctcatgtctttaatcccagcactataggaggccaaggcgggcggatcactcgaggtcaggagttcgagaccagcctgccaacatggtgaaaccctgtctctactaaaaatacaaaaatcagccaggtggctactcaggaggctgaaggaaaagaatcgcttgaacccaggaggcagaggttgcagtgagctaagatcctgccagtgcaatacagcctgggtgacagagaaagactgtctcaaaaataaaaattaaaaaaaaaaagaaaaaatcagcagcgtagtagaagtataatgcacacaagaatgataatcatgaagacaatctgattctagaagagtaagggaacctattccattagagagccaactgaaaacatcaaatcccagttcacaccccagggtgtgggggcacgtgcctgtagtcccagctactcgggaggattagtaaggaggtttgcttgaatatgtgaggtcaaagcagaagtaaaccctgatcatgccactgcactccagcctgggtgacagtgagaccttgtctcaaaaacaaacaaacaaaaaacccacaaaaccaaacaacaacaaattgtcacctcactctgaaatgacagtggcaaacatcactttgctattggaaaattaaaagaaaaacactccctcttgctatcaacctgccctcttgctctaacatgtctgacccatggtttaaaatgcccaaaagctgatgtactcaaattataatacacttacctgttctgcaccagcatttatttttgtctggaggagatcaccatccatggtcctgtaaatgtctaacggcatggaatgatgaagggcagtgtcttttaggatatttggttatatctatatatatggctctgaagaaacccaacattgggcgagttccctcaaacttttcactaggcatgaccactgctctattttagatagagattctgtggggcaaaacctgagaattatctgcctggctatcaagaagatagctccttgcatttttttggggagaacacttgcttcaagggagtgtttcctcccaggattacaaatctttttgtaacctcaggaaacattgctgatgaaaaccaggcatggtggctctggcctgtaatcccagtgactcaggggctgagacaggagaatcacttaagccaaagagtttgaggctgcagtgagctatgatggcgccactgcactccagcctgagccacagagccagacactgtctctgaaagaaaaagaaaaagaaagaaaaacattgctgatgaaactgcggcctcttttgcagctctataaaaaggtatttagtcactggctaaggttgtactagataatcacatcactttaggtgatacatttagctgagcagggagatgtgtggtggcaaataccttttgttgcatatacatatacatttcccatgtagtagaaccttctctagaaaaaatcagaaaagaagccacttggctgcaagaaatcactaaagaagaaatggggtttgatgttttccctgatgttttcagttggctgaaacatcaaatcccagttccctggttcccttactgttccaggatacagattctctttgtgatgatcattcttgtatgcattatatttctactactcaaattattaatgttatgtatttctcattgttttacttcttttgagaaactaaattcatggtactctgaaaactagagatgattcaacaagtgacagcaactatagaattggccgagatatctctctctctctctctctctctttttttttttttttttccatgttgtgatgccacaccagttcagcttttggacgctgttaaaaagagaggtctccttccctcccctgacccccgtgtgggacaggactatctgggaatgagccattctggcaaggagggacacagcttttgatcgacaatgctttcaagaaatactttttttttttttaaacggagtctcgctctgtcgcccaggctggagtgcagtgggcgatctcagctcactgcaagctccgcctcccgggttcacgccattctcctgcctcagcctctgcgagtagctgagactacaggcgcccgccaccacgccaggctaattttttttttttatttttagtagagacggggtttcaccgtggtctcgatctcctgacctcgtgatcggcccgcctcagcctcccaaagtgctgggcttacaagcgtcagccaccgcgcccggccaagaaagacttttcatctaaagggagaatggggaaagaagagaacttttttattttcaaattctcaggcccagcgaggcattacattgagacagcaaccacattctgcttcctttttgtacactactgtatttgaaaaacaaaaaaacaaacctacaagactcataaaactggacaactttctttataacactactactcgtaaaaccagtaaggatggctggtttgcagttatctgagcagcttctctagtttcatagacatgatttctctctgttattaaagggctcccaattttaagtggaatgctacttcacaaagataaccaggtttgaaagggtccggtttgctttgtaatccgaaacgttccagtctgctattaaaagccattatttgaagacgggtgcacaggcttccagctgcccgccagaagggtcctccgcaggacacaggttaagtaatcacttcttcgggggagactagatgcagggtctcggcgcacctccccaaaagacaagggcgagacagaaaggagggacaggcggacgtcacttcccccgccggctgcggcaccgggttggtgggctgagtggaggagggtggggcggaagaacagaaggggactgggaaaggcactgttggtgacatcaccgatagggcgtttctatgtagatgaggcagcgcaggggctgctgcttcgccatgaaggatttcccgtgctgtaggagcaagtccgggaccgctggctggacgtgagcgtcctagctgtgcgttagggctaggagggctcagggtgattggggattggctggggtggtgctcggggcaagtgaccgtgcgtgtaaagggtgaggcgtatggagctgtggcggggcggaagttcacatgtgtggtatgtagagcacatgttatggttatcaaagtggtttactgtaaggctgagggctatgcattctatggctatgttgttgtctcttatttttccaaacgtggaaacctctgttttgtaacttgtagtaataaggtagaaattaaaaagaaaaagtattttcctgtacttgcttggctgcaaggtcaggaacagatagtttctgaaaaaccacatcgctgagaaatgagttctggagactctcttaacagtctgttatccctaggaaggataagagcaagaaacagcaaatgcttttattaccttctcttttccctttaccatttctcactattcaagttttgttaagttcttgatttcccttcagtgcagctgcaaggtcaccagctattcttgcctcgtgagacctgtcacagtttgactagctgcctttgttctgcttctgtaagccctcttgcctgccccgcgagtttggtgccatcatagtcccaccatgccattcaaactagccaaccccctttttgaagtgtgtataaaagtcaaaccctgtctttgttcggggctcagcctttggattttaatcctctgggcctgagggcactcaataaaatcctcctgttccacccattggtctctctgttctcctgattcccacaacagtagtaggggactgtgtctgcactttcccctggtctttcacggtatgaataatagccttttttttttcgcctatagtcgcaggctcggtctcagtgattttatggtgtggtcagctgtttttgtttttgtgagaccttgtttactgtcctgggacagatgtctgtagtcacttgtttccttgggaggcaaatttcagtctctgtggcagaggtctctcatgttagctgtggtggtacttggcaggcggagctcagggatctaggcttccctgctttgtagactgctcaatggtccccaaggcctactggcttttaccaccacttgaaaaccttagtgtttttccactgtccccagagtcacctcttacacagacttattttgtttgtctttttccccgagacagagtctcactctatctggtagcatcttggtttaagcgatcctcccacctcagcctctggagtagcagaggcacgagtcaccacagccagctaatttctgttcttggttttgttgtggtggtggttgttttgttttttaagagttgaagtttcaccatgttgcccaggttggtctccaactcctggactcaaataatccgccctgccttggccttctaaagtcctgggattacaggtgtgatccatcacacctggccagcccctgcttttcactatagcattcatgggagtttgcaggatttctgtgctggggggaacgtgtactcagctcatacagccaagtagaaattgtacttggaactggtgccgttgggttgtagacataacatgcttgctgtttgtatgggaagggctttgccagtgctctgtgcccctgtgcagggcatccaggcctgcaggtcagaacggcagtctcacctatgagtttgtgtaatacgcagcaattctccctggaatataagatgggtggtcttgtgaggttcctacaagtaagaagacaaatttcccttcagtttgtattgacaaaattcaaaattaataataacagcccaacctcttgaatgataaatgtcctttacattgacagaccagaactgccctgcttgcctcagctcctctgtgcaggtgcagctcacaattccccccacacaggtcatttcctccctgctttctccaaaagagggagacagcagttctgcaggaccacagggctcaaggccttccagggccaaaaatctcagaagaagttgcccgttctgcctgtacctcacgactgacctagaaatggcctttgctaggagcaaagtagggggaaatggtcgccagagctggggcctgggtactgggccaggttaccccacaggaggggaagtactcagggttagagggggccaagcaccaagacctcagcatcctcaacctccaaaaggactcagagagatgcagaaaccgagacagggttcctctttcaaggaaagagacttttgaggaagaccccagggctctgaaccaaaatccagatttttccccatctgcagcttaattccaccttagttggtgcaacttcatccttcccctatgctcaggacaaaaaacagttcttctataggctggtcattctctggccccatacatcctattggtcagaaaattatgttttttctttggttaactgcagactttggtctgcacagtctttttctttcttggtctgaaaaccacccagtagtcccatatgtagcttttttggataaacctagaaattgaccctgctggtcttaaagcttgaaacttaatatttgtttcgtctgagttccttcctcaggaaacaaccttcaggcctctcaaaaaagccatcaaagaactgaaattcatccagacaatgagatgctgggacccctcattcatcatgattgcttccttgctcctccctagttcctgttttcttacacattgttacatttcttccctgccatataaacctctggttttgttggtcagggagatggatttgagactgagttctcatctcccccactgcagcaccctattaaagcgccttccttggcaataatcatctcggtgattggctttctctgtggcaaccagcaggaatcccagatctctgaattttggcaaaggagtctcctgataaaggtgggatggattctactgaccaacatcaaaacgatcagacatttgaaagccttaatctcagggtcggggtttgggccgcccttgggccttttccttgggcctaaccattaaaatcagcctagccaggtctgtcttccaggcacaggggtagggccagatactcctgatgctttttgacgcttctcccactgggtgggcaacaaccctccccttccctgtgacctgcagagaagcttcagggggcgtttattcaatttgctaggagcctacaaagcacaggtacacggtgactctgtggttcccactgcacctgccactctccttggtcccctcactgtctctggcaggcagtaatgttctgggtgagcttgggtgctgaagacacccaggcagggagggtagggaaaggcaccagccccttaggtcctgcgcattagggatccaaaaaacatctgaagaaacagaaagggagcgttggaagtagatcaaagggaaagaaagaaatcctaggagatttcctatctgaaggcaccatgaagagaaagtccgcctcctctgggccgcgtcctcctgttgcaggtgaaccgagttccggtctccattggaaaccaaagcaggtaactttgccctgactcctagttaggaagccatgctttgtcctcccctgtttagcacttgatcctgtagcacttgattgtctctccctggctttctatggattccagagatgcaactgagaagtttgtttttaatgcacttttccttaaagtaagagtatttcaggccgggcacggtggcttacacctgtaatcccaacactttgggaggcagaggtgggcattttacttgaggtcaggagttcgagaccagcctggccaacatggcgaaactctgtctctacgaaaaatacaaaaattagccaggtatgttggcaccggcctgtagtcccagctactcgagaggctgaggcaagagaaacctgtgaacatgggaaggggaagttgcagtgaactgatatcaaaaaaaaaaaaagtatcttttggcaaaggaaatgatttctgacaggttttgcacttaagacactcaggtgtgaggaaaacatgaaaaccactatgctagggaaagcaaatgctgttgagaatgtctcataaacacaaattacatgtcagcaggtaggtttgaccctcaggttgggcacattttactttaagttcactgtcggtggaacttaagatgaatctaagacattcacgatgtatgtatgtatgtgtgtgggtgtgtatacatatacatatatgtatacatatatatacacacacacatatatatatatacacacatatatatatgtctctcatatatatatgagagacagagtcttgcaatcttgcccatattggtctccaactctgggcctcaagcgatcctcctatctccccatcccaaagtgctgggactataggcatgcaccacctcgtccagcccattttaatgtttttaatttaaatacacattcccaaaattatataacaagtacaggaagcccactttcagccagttttacaaaaacaaagtggcaacatcctaaagtactgaaagaaataaagttttcctagaattctatgtcaaagtgaaaaatctttcaagaatatgactgaaataaggacatttaaaaacatataaaaaatgaaagaattcagcaacccacactacaagaaatgcaaaaggagtcctccaggcctaaagataaggataccagacagaaatctggatctacacaaagaaatggagactactgcaaatcggtatgtacatagttaaatatatatgttcttattatttaaatcttttttaataatttatttattttaaattatttatgatttaagtctttttttaataattaaaaaaagcaataataatggattctgggatttataacatgtctgaaatcaagttacatgacaacactagcataatggccagaagaggaggtataatgccactagatggcactgataaaggtgtattcaggaaaccctgaagccctcactgaaaaggcaaaagcagggaaagaagtcggggagcggtagaccagaagaaagaaagagttatagctaataagccaacaaaggaaagaaaatggaatgatataaaaaccatgtaatcattatgctggaacaactgctcttcatgcactccagcctgggcgacagtgaaaccctgtctcaaaaaaaaagcccacccctagggctgggcatggtggctcacgcctgtagtcctaccacttggggaggccaaggcaggttgatcacctgaggtcaggagttcaagaccagcctggccaacatggtgaaaccccgtctctactaaaaatacaaaacaattagccaggcatggtggtgggtgcctgtaatcccaggtactcaggaggctgacgtaggagaattgctagaaccctaggaggggaggttgcagtgagccgaggtcatgccactgcactccagcctgggcaacagagcgagactcatctcaaaaaaaaaaatcgtacacttaaaaggtcacggaggcaagcaaaaatcacctggtggctgcaaagcagaccatcgagaggcaaaactctttatctggggaatttagaggcaattagacttccttattatttaaagcaagaatctagttccaggcttctttcccaaaaatttataactaactagaatttctggggttttttttttgttgttgtttgtttgtttgtttgagacggagtctcactctgttgcccaggctggagtgcagtggcgcaatctcggctcactgctacctccgtctcccgggttcaagcaattctctgcctcagcctcccgagtagctggaattacaggtgcccgccaccacacccggctaatttttgtatttttagtagaaacggcgtttcaccatcttggccaggctggtcctgaactcctgacctcgtgatccacccgactcgccctcccaaagtgctgggattacaggcgtgagccaccgtgcccggccagtaactagaatttctatacatctctggaatacgtgcttatcaaaacttgtgcaacccttgctgacattaaggcaccaaaatgtctacaaatgtagtattctgtgagccaccgcacccggcctacaaaatgtttttttaaaaaattattgtgttgggagtgaattattgggctggtggctcatgcctgtaatcccagcacttcaggaggccgagatgggtggatcacttgaagtcaggagttccagaccagcctggccaacatggtgaaaccccatctctactaaaaatacaaaaattagctaggcgtggtggcgggcacctgtaatcccagctacttgggaggctgaggcaagagaattgcttgaacccaggaggcagaggttgcagtgagccgagatcgtgccattgtactccagcctgggtgacaagagccaaaaaaaaaaaaaaaaaagaaagaaatcattattatttctacaatatgggcttatccctgtattactcttctgaacttttcacttaatatatcgtaaccatctctccagtcattgaatgttcttctataacatttggaatgatatcatagtatcccattatatgaataacccatggtttattatacaagtcccctactgctgaacgtttaggtctttctaactttttgctattaaagtctggcatgatagactctgcaagttagccttcagatgcccagcaaatccagttaaccagagcactgtcctctaagcctcctggtgaatgtggttttgctgatggtgggcagagtccaccccagccgagccgctggatttggcaggcacttggccttagcaacctgagggtggtaactccaatcagttacttgtttccctgttacctgagttgcagatttagagccctctgcagtgagcaggtgagcacctggcatgattcttttctggtgagtggtcctgggggtcactgggccagtcaccacctggtgacaggacagggtgaccggtgggtggcagcactggggattcaaatgaccgcagcccggtcaggctgagctgagcagagccaaggactcagcacagcaaggaacctaggctcttcacagagaagggagctggaggaccccccaaggagatgagtatgtgccaccctgcggcagggtcctgtgggctttgggagtgagagggtcaaggggagaggagctgtgtttgccaccccctgttaaaaacctcaagtgaagcagcatggtagagaggaaagagcatgggattggaagccattgaacttcctgctgtgtgtccttgggcaagtgactacatgtctctgatcctcaatctccccttctataaaatggagatgatcctagaacctgcttcacgggagtgttcagaggggactgtagacagagcgggaacatagaagaggaagtaggcggcagtgtggttcacagccagcgcaggctgcctgcagggtgcaggtactgtcaccaagggagacccaaggtgccctggagggagtggcaaggacacaggcctgagcccagccctggtgatatgaacactggagtgggcttcacagggacaggcagcatcagaactggactagtgaggtcatgagcccaccagggcctgggtagggacatagcaagtctggggactccagacagggtcacacagacctgggccatgctgggcatccagggactggctgtgcatactggcagatgtcagtcagccctcctgcagttgggccagggacacctcagggaaactgtgaccttccttccaatcttggtaacatcacccttccaccccaaatcccagggaatggcccgaatctctcctgacaaacagctctcagccctggtccaggccacagtcttgcttgcaccgggccgggtttcagagcccgaagggcacactggcagcctttagtgcagtgtttcagatgtcacagacaggttcctctttgacgaagatggaacttccactgcttccctcctaccacgcaggaaacacagaagcaaccatcagccgagggcctgctggccgttctctctgggtactgtgtttggaaaaagcacaaaatcattaacttaaacatgctttttcaaaccaaacacatccctctcttagccctggagattcagagctgcctctccctttgaaaatgaatgatctcgcccgggtgcagtggctcacgcctgtactcccagtactttgggaagctgaggcgggtggatcgcgaggtcagcagtttgagaccagcctggccaatatggtgaaaccccgtctctactgaaaatacaaaaattagccgagcgtggcggcgggcgcctgtagtccaagctactcaggaggctggggcagaggttgcgtttagccaagatcatgccactgcactccagcctgggcaatagagcaagactccctcaaaaaaaaaaaaaagcatgatttcatccaatgccttcaataacagaaggaggtccaagtccagtgagagggtggaacgaacatactgtcacagtggaaaggacacgagacaggcgcgccaccgggttgagtctcgcgaacaaactgaggccagagtgccttccccagggctgcacgtcagtcaggaaaaaaaaaagcattctctccgacaggtcaaatcaccgaagcctcgggatcgtcgctgggggctgtgacggggctggcatgaaacgtccctctgtctggctgggcgatgggtcagtgctcaggagtttcaggcctttaaggcccggccagaccgcagggggactctgcagccgggtcggggtttcgatcctgcgctgcggccttgcaactgcgaggacttgggggtcgtgcttcgttcgcctggtatcctcgttcgtgcgtgtaggaggcgcctggcttgccgggcggtgccaggcggcaagagggagggcgcacggagcgtgtccgcccagggcggcccctgtaagcgctgcagaagcgctgctcccggcgcccggccccgccccagcctccgccccactaccgcgcagcgcaggctccgcccccagttttccccgccccgtggcggggacgccccgcccggtccggcccgctcggcctcggcagcagcggctgcggcgaaggcgcgcgaaggtaggtggccgggggcgcgcgcgtgcgcgggggcgggacggacgcgctcccggcggaggaggccgcgcgcctgggggcgggctggagccacgtaccggggctgggggcgctgtgtgttccgcgactgccgcggcccggcaccggaggccaggagagcgttcccaacaggctccgcggatgccccgccgcgtcctgccgcccatcctgcccggattgtcgcgggccgggggcacgacaggagactggggcctgcagggcgcagccgtccctccgccggccggggtcccctcgctccgcgggcggccgtgggaggccctcgcgacggcctctgccccccgcagatgccctctgcagctcctgcgtgcgggccccgccctgcactgccctcctcgtgtgggatccggtttcgtcttcattgcagccctgccgagtcggaagcatctccattgtgcggatggggaaactgaggcccagagcgcatagttgggctggccacggaggcagggccgccggatgctgtgcggggatggggccctgcaccccttgcgcctctcaccatgcggcctcaggcctctgtgcccggcagcgtctctggagtgggcattttgaacgagctccctcctgattttcacacagacttaagcctgacgaccatgctggggcggatgtctgcccctctggtgaccaggtcacagctcccttgggaagacgattgactggggaatggggaccctggggaggaggacttcagggtgccatctgtctgtttacgccagaaaacagagatttctgttttctttcgctgggctcacagcaggtgcttaataaacagatcttgtggcgggagcagacgacagcgaggttcaggcaagactccaggagtcaacccctggatctcggaggctccccacccgcgcacatttccctgacttaaccctcccctccccaagtctttcagccctttccacccaagtggcccctgtgggggtcactgcctggttttcaccctgatcttctgggatgcggcagatgctggctggatatgtgttcgctggtgtccttccgtgatccccgtctgtggctgacaccatctgtggcccaacatgaccccagccagagccaaggggaatcatttctttttccatttaacatcctatgttattacttggctcttagcattcattaattcattcagcagctcttcatggagctttggccttagcccatgcactgtggaagtgacagtgagctaagccaacctggcactttgggaggctgaggtgggaggaccgcttgagcccaggagttggagactagcctgggcaacatctcatctctacaacaagtaaaaaattagccagacgtggtggcacgcacctgtggtcccagctactcaggaggctgaggtgggaggatcccttaagcccaggaggtcaacgctgcagtgagccatgattttgccactgcactccagcctggaaaacagagcaagaccttgtctcaaagaaaaaaaaaaaaaaggaggagacagacaacatacatgttggagaaaatggaacagccactggagggacctctttagctgagagtcggggtagctccctcagaaagtgatatttttgagccaaaatctggccgacaagcgggagtcagctgtgcaaaagaagggggaagtgcgtcccaggcagagaaagtggcagtgcaaaggcccagaggtgggtgcctgcctggtgtttgaggaatcaagaaggccatgagcagccaggtgtggtggctcatgcctgtaattccagcactttgggaggctaaggtgggtggatcacttgaggtcaggagtttaagaccagcctggccaatacagtgaaacctcatctctactaatacaaaaattagctgggcgtggtggtgcatgcctgtaatcccagctactcgggaggctgaggtaggagaattgcttgaacccaggaggtggaggttgcagtgagctgagattgtgcaccactgcactccagctcaggcctgggcaacagatcaagactctgcctcaaaaaaaaaggccatgagagaaggggagagaggagatgaggtgggaaaagtggagtggggccagatctggtgggccctgtgggccatggaaggactttgaacttcattttaggtgtggtaagggctagtagagggccttgggtaggggaggggtatgacctttactgtgtgaaacttgagtgggtgaggggatgagcagggaagcatagagaccctcggggagccatctcagcagtccaggcagtggcttatataatacacatcggcgtcctggggtggtgccaggtacacagcaggcgctgcaggatggaagtcattgctgttactgtttttgtttatttgagacagggtcttgctctgtcacccaggctagagtgcagtgacacaaccacggctcattgcagcctcaaccttccaggctcaagcaatcctcctgcctcagcctctcaaggaactgggactacaggaggtgcatgccaccatgccaggccaattttttttatttttttggcagagatggagtctcactgtgttgccagggctggtctcaaacgcctgggctcaggcagtcctcctaccttggcctcccaaagtgttgggatcacaggtgtgagtcagtgcacccggcttgctgttattatttaaaactctgggctgggcgcagtggctcatgcctataatcccagcactttgagaggccgaggcgggtagatcacttgaggtcaggagtttgagaccagcctggccaacatggtgaaaccctgtctctactaaaaatacaaaaataagctgggcgcggtggcgcatacctgtaatcccagctactcaggaggctgaggcaggagaattgcttgagcccaggaggcggaggttgcagtcagccgagatcgtgccattgcactccagactgggtgacagagccagactccatctcaaaaacaaaacaaaacaaaaaacaaaaaccctttggaatcaggcacacctaggtcgcggctgtgacttgagctctttgtggctgggtgcattggagccaattatttaacttcgctgagacttcacgctgtcatctgtaaagtgagtagggtggtgccaggagtgttaaagcaggtaagggacagatgtaacgttttgggcacagggcctggctcgtggttggttcaatatttttgtcataatttctagtcagcagcaggaggataacgaaggggtaagcggataagagcagctgctatgtttgaaacgagtaatctttgaggggctttttggctagttcctgccgctagccctggcaaaaggcaagtttggagggtggtagtggggagggaagggtacaaagggtgtctcctctgtatttggtcaccaaataatgtctcagcatctagaacaaggcacagggttctagcttggggactagaaagagccaataatactcatgatagtaatgataacagtagtaatagccaacacttacccgctgttgaactgcaggtagtaattaaggtaacactagctaatgtgatagtgaaaccctgaattctcagaggcttagcgcaatagaagtttatttctcattcatgaaaagccctgttgggtgtttggcaggtggctttctatgtggcgacccagggaccgagatcccttctgtcttgtggttgcggcatcccctaggaccttggagttatttccttctagctgatggaccaggaaggagagaaataattttatggaccaagcctaaagtggcacgctgtctttctgtcttaattctatggaccagaacttgaccacatggccgtatctgactgcaagggagtctgggaaatggcttttagccatattcctaagaggaatcggaaatgctttgtggtgagcacattgcagtttctgccacaccatatccaggcatatagcttagcacggagtattttatttaatgctcatgctagaaacaggcaccattattatcccattttgcagatgaggaaactgaagctcagagaagtgaagacactggtgcagggtcacacagctggtgaggggctggtgagccaagattggagtccaggtggccagatgctgaagctgttagcatccagatttctaagaggaattcagtctttttttttttttttttttttttggagaattgggtggaagcagtggacacatacacgaggttcagatatgacttcctgggacccacagaacccagcaggactctgggggagaactttggggatggagccaagggtgaatgtcacctggtgccaggggctgacatcctgtccccttcctccaacccttagggccgtggtcaggagaaggcacagaataatccagttcagtccctcaaggacatctggggccccctctgctgagctgggcatgcagggctggacatgctggtccaggggtatttttggcttcccccctgttctggtgggcaggtgtgcagcctgtagaggggattttttggaggctgcctagaggtagaagagtgggcgtccctggggtttgtagtggcagctctatctgctggccggtttagttttttgtttttgttttttttttgagacagagtctctctctgtcacccaggctggagtacagtggtgcgatctcagctcactgcaacctctgcctcccagtttcaagtgattcttgtgcctcagcctcccgagtagctgggactacaggcacccaccaccatgcccagctaatttctgtatttttagtagagacggggtttcaccacgttggccaggctggtctagaattcctgacctcaagtgatcgacctgcctcggcatcccagtgttgggattacaggcatgagccactgcacctggccagtagctggtttagttttgcccaaatctggcttgcttgccattgcaacttggcaacatttatcttttcagacctgtttcttggttttccatttgcagggcagtttccttagttgggcgtgagcggtccagcctggactgatgagcatttatacagcaccgtggcattctgggtctgacctggatacagaagtagagcctcaaagcgcaaatgcctcggccttgcccttcagtcactcattgggaggctgctggtctaagtggaatgagctttgggctcaccacttccctgaagcatgtcgccttgaataggtgagagcccaatgtctctgagcctcagttttctcatctggaaataggttgaagtaaggatttaatgagataatgtgaatatgccccctttggggcacagcatggagcagagggcacccagggacggagggctgaggcatagcagtgtagcaggacaagccgcaggcaaaactcttcagtcaccaggttaaagaaggaaggaactttattcggctgggaacttcaggagacttgtgtcttaaaagccgagctcctcgagtgagcaattcctgtccttttttagggcttacaactctaagggcaggagcccagacacgtgatgctaatgacaataggaacagtggcccccattggctaatagctcaccacctgccaggtgtggtaggtactatcagtcgcatttttttgttgtttttggtaggacagagtctcgctatgttgcccaggctggtctcaaactcctgggctcaagcgattctcccattttggcctcccaaagtgctgggattatagacctgaatcaccacactcggtctagtctcattttattttattttatttttttgagacagactcttgccctgtcacccaggctggagtgctgtggcacaatctcggctcactgcaacctcctcctcctgggttcaagtgattcccctgcctcagcctcctgagtagctaggattatatgcacatgccaccacgccccagctaattttttttatatttatttatttatttatttatatttttgagacggagtcttactgtgtcgccaggctggagtgcagtggcatgatctcgcctcactgcaacctctgcctcccaggttcaagcgattctcctgactcagcctcccaggtagctgggactacaggtgtgcaccaccatgcctagctaatttttgtatttttaatagagacggggtttcaccatgtaggccaggatggtcttaatctcttgacctcctgatccgcctgcctcagcatcccaaagtgctgggattacaggccaattcttgtatttttagtagagatggggtttcactatgttggccaggctggtctcaaactcctgacctcaagtgatctgcccgcctcagcctcccaaagtgctggaattagaggcttgagccactgcacctggcctggtttagtctccttttagagatgagaaaactgaggctcagggaggtaacctgttcaaggtcttactgtcttgaacaccatagttgcaagtgacagagctgagtctcacatgcaacctcagacctgatactgactccagagctgtgcgcctaagcactagagcacatagcctccttgccccagggaaagaacaatgggaggtggtgggtgacctctgggtctcagggccctgggatatagggactgtgccttttttttttttttttttgagacaaagttccactcttgttgcccaggctggagtgcaatggcgcgatcttggctcactgcaacctctgcctcctgagttcaatcgattctcctgcctcagcctcccaagtagctgggattacaggtgtgcaccaccacacccggctaatttttgtatttttggtagagacggggtttcaccatattggtcaggctgatcttgaactcctgacctcaggtgatccacccgctttgtcctcccaaaatgccgagattacaggcatgagtgcctgcgcctggctgggactgtaccttctggattttcaaatgaatgaaatgagtatttcttgagtgttggccacgtgaccccccagcaccatgtcatgtgctgggtatgcacacacgatactgtttcatccccggacggctccgagagatgagtaccaatattatcacatcttacgtaagaggacactgagtctcagagaggcaaagtcagtgtccctggtgcacccagctagtgggggctggggtgggtgtgaaggggccagaagcttcccaataagtgcctgaagggcaaggctagggcatttgtagttcgaggctctaccactgtgtctaggtcagacctaggaatgccgcaggtgttgcataaatgctcatcagtccaggctggaccgctcatgcccaactaagtgccaagcctggcctgggtgatctcacagcctgcattctttgccctacacctgttgtgggaaaacatactcccagcatgctgtaaatcctctcattcttagctaaccatgtgactcccgttctgggccagaaagatggtcacaaatacttaggactctggcctttcccgccgcatggctactgaccccaccccctgggcttggagggctctaggacccagcaacctgcgcagggtgaagagtgtgtgaggtcctgacctccaggtgtctcccctgtttcctcctcccattccctcttctctctcctccctccttttctctcccttctcctcccctctcttcatccttcctcttcctttggctccctgcctctgcttccctcctctcctgtcctttcccatcccctccctcctcagcccacatcctgctcctcccaccgcggtggtcacatgggggcgccgccggatttaagcttaatctgcctggtgctcagcacagcatcctggctgtggcgcgtgctgactgagctagtcttggggtcctggagaagggggctggaggcatgcccacagcctcccccccatgagcttggggctggcgagggcacaggaggtggagctgacactagagacggttatccaggtgggtcctgggggctgtgcccaccctgtctggggcggggcagcgtggacttaacaggagtggtgagaggtgtgtgcgtcttggggatcaaggggtgggagaggtgtggtggtggtggggtatacaggggccccccgcttgcagttcctggcaagatggggggcagaggtacacacagggtgcacctgctgtggctccctcatcccagtgccctgggttgggagaagggggtctctactgccagattttagggcttgggggacctctggcatagccagatcctcatccatctagggtcggaaccggattggggcccccaacactggactgcctccagtggggtttgggagttacccgtagggtttggttctcatctctggccctgggccttcttcctggggcagtgagcacacaagaggctctttgcatggggattttttggattctaactcccaggcttcactccatcttgagggggctcctggggacctgtatcttgggcagtaggattctgtggctctccccacgaggccagggagccccgggtcccatgtcccctgaagaccctctcgcttttcccacagacactggagagcagcgtcctgtgccaggagaaaggcttgggcgcgcgggacctggcccaggacgctcagatcaccagcctgcctgcccttatcagggagattgtcacccgcaacctctcccagcctgagagcccaggtgccacccccatccgctcccctccacaaacaccacccacattttacctcttctcatgtccctttcctgagcagtcaccatgatgatcatgactgtaactcactgtggggcaggcacagctttatgacagaagaacccattttacagatgaggaaacagaggctcagggatgtaatttgtccagacttattccgcatgtggtgcaactagaaggaagggccgagcatctcctgcgtgcttgcctgtagcctgctgcagagatgtgaaccccaaatcccgtattcccacccggggaaggtgtgagctggctgaacccaagatacaggaagagggcagctcagctcagaccagggttttgcggaagtctgagtggatggcgccgtccatccgtttcccacgtgggcaggaaggcggatggtccctgctcctctcagtgggtggcgcacacggtgtagttatgtggcttgaggatctgggaaaggcacactcagttgcagctggtgtgctggcgtgtggcgttttggtgctctaaccattgtctgtgttcaactcccaagctacagacgggccccctccttgggagcgccagggatgttggcgccctggagccccagacagggagagactcagagggccctcaccctgacacctggggtgtatgtccagttctcccagggtagaaggggaacccacaggaggtggacaaccccgcttctcccgctggcctttctttccctcttctctctttctccttctcctcacaacctgacctatgctatgctctcctgagccctagcctttaaagttccatgaagcccttctcttgagcgaggctttgatgcttttctgggaggatctggttactactattctaccttttttttttttttttttttttttgagacagagtctcgctgtgttgcccaggctggagtgcagtggcgcaatctcagctcactgcaacctccacctccccggttcaagtgattctgctgtctcagcctcccaagtagctgggactacaggcatacaccaccatgcccagctaatttttgtatttttagtagagacagggcttcgccgtgttggccaggctagtctcaaactcctgacctcaggtgatcctcctatctcgactcccaaagtgctgggattacaggcgtgagtccgtgcccgccccacccatattacagataagtaaatctgaggccccggagaagaagactaattggaaaaggagggagcaagaactcaggggtctcctggctcctagactgagtgtctctcctgcacctcccaaacctgctgggccacactttagctggagttgtgttcactttacgtccagctttgtatcccctccttgccttcctccctgttctcagctctgtttgcaggcctggtgctgcagccattcccatctggactcctcccaggggcctggatggttttcttgccctccctgttggggggaggatgtcccactggacccagaagccaaccatgtgcccactgtcccttgccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagagggtgggtgccgcccaggtggtggactaggccagggttcccctcgttcaagggcagggaggcatctagaccaggcccacacacggggcaaaagatgggccctggagtcaggttggcctgggcttggattgaggctctgccaccttgagtggcgttgagcaaatcactatgctctttaagcctgttttctgtagtggggattgtaatgggacgtggaattgtaggaatcaaggagataatagaataaagtgcctggcaccaggggtattttgttcccatctgtcccaggcctgttaggggtgtgggacacggagaatgagatccctaaagattcctgccccttgagtttctgggcatctcccattgccacgggccttggggttgaggcggtggctggatgctggctcgaggctggtgtgggcacccgcggtgttctgcagcccatctggggcagccacaagacctgccgccactgcctattggaatgagttccaggcagggaaggaaggagaagcaggcctgtcttcatgtccaggcaggattcacatcacccgtgctgcaggcttgtgggggtcccagggtgtggggcgggagctgggtgtgagccggtgcgaggggtgcgggatgctcttgatgcactgtctgctttgggcctccgggtggccgggaggtggccctgggaagttggtggtggctgaagattggtaagggacactcgcagctgggacagagtgtatgtgtgcagatgagaggcatgcaggtggcaataacgtattaacagtagctactgtttattgagtgcctactatgtgccaggcgcgtgctgagtgtttcacatttaatacaccaaggtcgggaccattatgatgcccatgtaacagaggagaaaacagaggctcagggaggggaagcaccatgctgggggcacacagccagttaaagttagacaccaggtcttccaactcccagcccagggctctgtttggtttctaaactaacccagtctagaaacaaagttctgaagtttcatttcctgtgtatgggaagagacactgggctagggatttcagggcacagctggcccccacaaagttggaagggacccagagaggcaggggctggcccagggtcccctgtgtggtagtggcagagctagggttggcatgggacccctgagctggacttgtccaggctggagcccgcattggcaggagggtgtgtgttcctgtgtatgactgtggggtgtgcccgtgtcctgggatttgcctggctggacaaacccacgactagttgggacttgtagaggagcagagtaggcggcccgcagtggcccctggcatgaggacagtggagagctcgtttccccagggtctgcagcgggtgtgtagggcacgctggccccagtcatgaattgtgggtggtgatggggccctgagccaggcacccctttcttttggtccatgcatggcacagtgccacacccccagggccgcctcttaaatgccaccttctgaagctagccctgcccccaggttggcagggaagggaagaggtgggaggtagcaggttcctcctctgctgggacacagctgctggggctgggactgcagcacagggggtctgggttagtctagaaagctccctcctgtggttagtgggggcccaaatggcacgcagagggcgcccgctgcttcagttgtcctctatccaccatggtttgaatgaggccccacctggaggcaggggtggaacaggaatgacctcaaaggcctttcctggagggtgggtccccagagaacttcagagcctagagatcacctcatcacagatagggaaagtaagtccgggagaggggcatgataggcccaaggtcagtggtggtcctgggatgagacccttggtccagggctctgcagttgggcaacattctctttccctgccacccccttgtccccatggccacaggtggcagtgcctgcccctgtggccctcactggcatgttgggctgggttggtgggcagtcagcgagattgttctgatctttccaaccctgcagcacccctggcatggggagcggagggagggtcaggtctgtgtcctgttaactgcatgtcctgcagggaaactgaggcactcccagaggccacctcccagccgagagagaggacctcagggcccccatgggggtccccccttcttgctgtccctgagaagcagatgtaggcgcagctgggaatggaaaggagggagtggtcacgcctcccttggctccagaggacagaccccctgggctccctcgtgtccatagcaacctggaaagagtaaattgaatggcggtctgagggcagcagttgctaggggagacagtcaacttctttcatctctggcttagtggcagcctccttcccttttgaattgcaagtaaaattgaaaggctgttttgctcacggtgaagtttgtggaaaggggtgaggtgtggccgagagggccctggctctggttctgagcactggagaagggggaggagaacccagcaacggcctgaacccctctgtgtcccagaggcaaacagcacctgcttcacacagatatgcagtgtgtacacgacatgggctacactgggccccacacagacacacagatgcacaaaacattccacaaacaacatagtgagaccctaaaaccaggccacacagaaacactccaattcacagaatatgcacagtgttagccgcacacacagccagatgccacacaaccccacacaggcacagaacagtccccccaccaccggggacctataacaaccatatgcagatgacacagcacgctatctcccacctcatgggtgcacacggacaggaaaagcatacagttcaacacagccaccaatcggcccacaaaggtatgcccagatgcacaaagtgtgtatcacacataccagggagcccaggcacaccccccagacccacccacatgcggttgtacacttgcctcaccgacacacagacatataccctgatacacacagccaggcccaacacccgcgccacaacatagaccttcagccacagatgccgccttagccgttcacgggaaggctcagatgcaccaaacagtcgacgtgaactcagcacccacacactacacacacagtgtcctgcgtggagacaaatgacaaaatacaccccactcgcacctagtgagagccaccaacatcagtgcacagcctgtgtggctgcctcaggccaccgccaccacacacagatgtggacaccgctcaccattgacctcagtgggcttggcacagacgcttgacaggcctgcagccgccatccaggcagaaaccccctacttccacctcccctgcacagccttggactgtgttcctccagactcagggggaagcccccaagtagtcacagttagctcctccctattggtggggctgccatgcacgtgtcccgggggtggggtgggtagagatgtccttgctttgtctgtggctcatagaacatctctcagcatatggggtcaatgcaggcctggagggcaccttccctaccgctaacctggcctggacccaagacccgagatgagcgtgggtgagagcagctgccctcctgttggcttcctgtggctggcgtggccctgcacgggtgggcttttgaatgccctgcctgggctgtagcaggccaggtcctgaggatgcagatggtgagtgcagggctagcatcagagtaagctgggctggggtgttgtcgctgccaggtgcccttgacccactgtgtgctctcccactgccctgctcctccctcacctcccttcccccaacagctggggaagatgaggggccacctggggccagcaggtgccttaagggagttgagagggttctatggctggtagggacagccagagcccacaggggtctgaggatgtgcgggatggaagcttcctgggggtggaggaagggcagcagcaacagaggctttcctgcagtgaggatggaggggacctttttttttttaagatggagtcttgggccggatgctgtggctcacacctgtaatcccagcactttgggaggccgaggcgggtggattacgaggtcaggagttcgagaccagcctggccaacatagtgaaaccccatctctactaaaaatacaaaaaattagccaggtgtggtggcgtgcacctgtagtcccagctacttgggagactgaggcaggagaatcatttgaacccgggaggtgtaggttgcagtgatccgagatcgagccattgcactccagcccaggagacagtgcaagactctgtctcaaaaaaataaataaataaaataaaataaaaaataaataaataaagatggagtcttgctctgtcgcccaggctggagtgcagtggcacgatctcggctcactgcaacctccgcctcccaggttcaagtgattctcctgcgtcagcctcttgagtaactgggattacaggtgcatgacaccacgcccagctaatttttgtatttttagtagagacggggtttcatcacgttagccaggctggtcttgaacccctgacttcaagtgatctacccgccttgacctccaaaagtgctgggatcacaggcatgagccactgcacccagccagaagggggcattaatatgcaggcgccgtatagggcaacacctgtgtgcacctcttacaaatcttaatgctgtgtatatgagggggttccttcgtgtcctccgggaatgtttgaggttgcctgtatgtgttatgtgtgtgcatatctttaaggtcagatatgcatagacagattgacacctctgttttgaatgtattcccatgagctcatcccattaattcactatcgcaacaaatatttactgagcgtgagccatgccattccacagccaccattctagtactaagatacaatgaggaacaaaaaatccaggctttcctgagctcacattggggtcggggcatggtgggaagacacaggcatcaatgtaataaacagaaaccacgacagggctaagtgttctggaggagaggcacatggtgtactgaggcccctgaggttgacccaggtgcacctttgagctttgcctgcgtggtttgggtttgtgggctcacctgcatgtgtccatgcatgccccgtctgcgtgcccgtgcatggctgcatcaccccatacacacgtgcactgcccctgggcttgcccacatgtgctgctccccagggcgccaggctatcagcctacaaggcattgtgggtctgggcccagcctgccacgccctacagaagcctgagcctgccttcccaggaggcccaggactctcacccagggcccttccctgcagctggagcaggctctgcggctggagcctggggagctggagacgcaggagcccagggggctggtacggcagagcgtggagttgcggaggcagctgcaggaggagcaggcctcctaccggcgcaagctgcaggcctaccaggagggccagcagcggcaggcccagcttgtgcagcggctgcagggcaaggtcaggaccacccactcctgctcctgtcctcccacctgttcactttgccccgccccaacccctggggctcaccatcagctccccatccccagattctccagtacaagaagaggtgctcggagctggagcagcagctgctggagagatccggagagctggagcagcagcggctgagggtgggtgccagtgtggggcaggggcaggccctgccctccacctgcccaacctgatgctttaacctctctcccacccaggacacagagcacagccaagacctggaaagcgccctcatccggctggaggaggagcagcagaggtgagggcgcagcagggagggccagggctggcaggatggccccctgcgcgagcgcctactgatcccctgtgccccattcaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggaggtgggcatgggggtgcagggaggccagcctgacccaagaggaaggggcactgcagaggagggaggactcagaagcctggagagggagagggagcactgtccaagggagcctgttagcagaagtaaatagccgtcatcacaatagctggtctttatcagtgtgtagcatgtaccacgtgcacggtgtgcgttgacctttattcctcatgataactgcatgtggtaggtgctatcattctcctcattttaaagagaggttaaggccggtcgcagtggctcacgcctgtaatcccagcactttgggaggctgagagatcgtgccactgcactccatcctgggcaacaaagcaagactctgtctccaaataagtaaataaataaagagagtttaagtaacctgcccacagtcatgcaactggcagctgggatgcaaagctaggtcccttgcatttttgcccttcgttgctgcctcttgcagccaaaagaggacttgaaacccaggtccctgtgcaggagggagccatgaggcttgggaggctgagcatggccgctgcaacacagctctgtgcacagacccacaggaagacccaatccctgaacgacggtgcctcccaggatggtcggagatgagggaagcagtgggagggagtaaacccgctctcacaccaacccttccctcggcatgtcttccctccagtccttcaacgcctacttcagcaacgagcacagtcgcctgctcctcctctggaggcaggtggtggggttccggcggctggtcagcgaggtgaagatgttcactgagaggtgaggcctggccggggacggggcagcagctgagagccagccctgctctttatgtccaactgaactcagttgaatttcagttcaactcaacgcacttactgtgcacaagggccggtgaggacacagaggcaacttgtaataaccattaccacagtcgtggcagtcagcatttattagatgtttactctgggctaggctcattgtatatttcatttcaactaatattcatagcttccctgtgaggtaggaactgtgttcattcacatattacagatgaggacattgtggcgcagagaggttgagtgatcttcctgaggtcacacagtagtacataagtggctgagtcagagtttgaagttcctgattttttttttttctcagacggagtcttgctctgtcaccaggctggagtgaggtggcacgatcttggatcactgcaaccttcacctcctgggttcaagcaattctcctgcctcagcctcctgagttgctgggataacaggcacatgccgccacacccagctaattttttttttttttttgtattttagtagagacggggtttcaccatgttgcccaggatggtctcgaactcctgagctcaagcaatcagccagcctcagcctcccaaagtgctgggattataggcatgagccacagcgccaggccgaagttcctgattttaatccactagaatattcagctttgctaccaaggacctcacagcctcttgtgatgaaaagatgtagatccccaaaattctaggctgggcacggtggctcacgcctgtaatcccagcacttgaggaggccgaggcgggtggatcacctgaggttaggagttcaagaccagcctcaacatggagaaaccctgtctctactaaaaatacaaaattagccgggcatagtggtgcatgcctgtaatcccagctactcgggaggctgaggcaggagaattgcttgaacctgggaggcagaggttgcggtgagccgagatctcgccattgtactccggcctgggcaacaagagcagaactccatccaaaaaaagtaaaataaaattctagactgaggaagcgagtggtcagtgatatgtacgtggaacagagggaatgtcctcgaggctcagaaggatgggaggggtggggaggtcagaaaaaccactttgtggagatggaatttgcacagagcctcaagggatgggtagggttgaagcagagcagcaggcgctccaagcaggagcaaggcatgagcaaaggcatggaggtgggagcccatggcagccaggggggttgcaatgaagagctggtacagggaaaggagagcctgcctcagcgggggagcttgggcctgcctgatccgtgtgagcagtcagctcaacagtagtgtcagggaggctgcggagagagccccaaggcaggaggccaaggtatttcatttagtgcgttaaaaacattttagttagtaatcttttcttttctttatggctcactacagcctcagcctcctcgtctcaagcaatcctcctacctcagatcctgtgcagctgggactacaggtgcatgccaccaggcttgctgatttttttatttcttgtagagtcgaggtctcactttgttgcccaggctggtcttgaactcctgagcccaagtgatcctcctgccttgacctcccaaaatgctgggattacaggcatgagcaaccacacctggtttaataatcttttgttaatatcatcaaatagccagtgtctaaattttccatatgtctcataaatgtcacagatagaccaggtgcagtggctcacgcctataatcccagtacttcaggaggccgaggcgggcggaccacctgaggtcaggagttcgagaccagcctggccaacatggtgagacccctatctctactaaaaatacaaaacttatctaggtgtggtgacacatgcctgtaatcccagctactggggaggctgaggccccagactcgcctgaacccaggaggcggaggtttcagtgagccgagataacaccattgcactccagcctgggtgacagagtgaaactctgtctcgaaaaaaaaagtcacagatagtcttgctttagttttttctttacaatttgtttgaatctcgatccatagacatttacaaaacgtaaatgtttgctttgtcttttttttctttttttttgagatggagtcttgctttgttgcccaggctggagtgaagtggcacgatcttggctcaccacaacctctccctcctgggttcagcaatcctatggcttcagccccctgcgtagctgggattacaggagtgcgccaccacgcccagctaacttttgtatttttagtagagatgggggcttcaccatgttggccaggctggtcttgacctcaggtgatccacctaccttggtctcccaaagtgctgggattacaggcccaagccactgtgcccggcccctgctttgtcttttaagtcccttttaacttatttgttcaggaaactgggctagttgtccttggagattctcatggtctggattttgctggttgcatccttatggtgtcaattaacatgtttctttatcccatgtatttcctgtaaattggatgttggatctaaagctaggtcagattcaggttcttctgcttgcttttttgtttgatcaagactccataagtagaatgtgttcttccagcaggatgcccctatgccagctgtctctcttttcaagatccaacccactcatcaaaggctgcaaaactgtgagcttctcatttagtcactcctgtgtatattaattagaattctggaatgaggcactttctctccttactattagataaccagtggtactgttcattcaggaaaggaaaggatttaacctgtattatggactgaaaatacatttttttttttgagacagtctctctctgttgcccaggctggagtgcagtggcacaatcacaactcacattaggcttgacctcccaggctcaagtgatcctcccacctcagccacccaagtagctgggactacaagtgtgcaccactatatctagctaatttttgtttgtttgtttttagagacagggtcttgccatgttgcccaggctggtcttgaactcctgggctaaagcagtgcacctgccttggcctccgaaagtgctggaattacagaaatggcccaccatgcctggccttaaaatacaaaacaaaaccaaaaattttaagtagcctttaaaatttttatattttacttttgattaagtcacatgttcacaaggttcacatttcaaaagggtacacagtaaaatggctccctctcacctctgaccccagatattcctcttccctccttggaggcaagcagcattatcagcttctttttctttttatatatacagattttttcttttttcttttttgcttcttcttcttctttttttttttggccaccaagttaccatgagaagcattatcagcagtttcttttttttttttttttttcttttttgagatagagtcttgctctgtctcccatgctggagtgcagtggcacgatcttggctcactgcaacctccacctcccaggttcaagcgattctcccacctccgcctcccaagtagctgggattacaggcatgagccaccacaccccgctaagttttgtatttttagtagaggtggggttttgccatgttggccaggctggtcttgaactcctgacctcaggtgatcctcctgcctcagcttcgcaaagtgctgggattacaggcatgagccaccacgcctggcctatcagtttcttaagtgaccttccagggttatcttacataatcaaataaagcagatcacacacacacacagagacacacagacacatgcacacttttttgcatatacgcctggtaaaatttcatcttcacagttcttgaagatgcttccctaacctactagttataactgggaggtggctctgtgtcaggccaggaagaacttctccactggtttttttgttttgttttgttttgttttgagacatagtctcactctgtcgcccaggctggagtgcagtggcccaatctcggctctctgcaagctccgcctcctgggttcacgccattctcctgcctcagcctcccgagtagctgggactacaggcgcctgccacctcacccggctaattttgtttttgtattcttaatagagacggggtttcaccgtgatagccaggatggtctcgatctcccgacctcgtgatccgccctcctcggcctcccaaagtgctgggattacaggcgtgagccaccaagcctggccttccactgctttttcttggccacagagtgttccacagaatggatgtaccatcatgtacttagtagcagtccccttttgatagacatttaggttgtcaccaggatttcttacatgagcaatgctgcagtgaacctccttgtccacaagccatctcctctgtgctggggtatatcgttggatacgttcttagaggaggagccggtggggaaggtcctatgcatgcatagttttcagagctctccctcagtgccctccgttgtggttgtatcaccctcccaccagctgagtaggggagggcctgttacccccagagcccctccttgtgtattatgtatccctttttttttccccaatctgagagtggacaaatggcatcccagtgtagggttttttttttcttcctctttagtttttgagatggagtctcactatgtttcccatgctggcctcaaactcctgggctcaagcaatcctgcctcagcttcccgcatagctgggactgcaggtgtatgccaccgcacccagcctagtatagttttatttttattttattatttattttgagacacagtcttgctgtgtcacccaggctggagtgcagtgtcatgatctcggcttactgcagtctccacttcctgggttcaagcaattctcctacctcagcctcccaagcggctgggactacagaagtgcgccaccatgcctggctaattttttgtatttgtagtagagatagggtttcaccatgttggccaggctggtctcgaactcctgacctcacgtgatctgcccgccttggcctcctgaagtgctgggattataggtgtgagccaccacgccctgcccaagcatagttttaatttgtagttgggagcaagccccatccatccccagcctgtgctctctcccgaagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccaggtgggtacctggtggatgccgcacgaggcaggcgtccctgcagaaggtaaaactggagagttggggagaagggagcatctgttcactaggggaagggccttcctctgtgagctcagccagtcttcccatgcactgaggttccgaaggcacttgcccagtgtttatcataaacagcttagcctcctatggcagaacttgtggccgggtgtggtggctcacacctgtaatcccagcactttgggagaccaaggtgggggattacctgaggtcaggagctcaagaccagcctgtccgacaggcaaaaccctgtctctactaaaaatacaaaaattagctgggcgtggtggcgcgtgcctgtaatcccagctacgagggaggctgagacaggagaatcgcttgaacccaggatgtggaggttgcagtgagccaagatcacatctctgtattccggcctggatgacagagcgaaactccgtctcaaaaaaaaaaaaacaaaaaaaaagaactcgtgccccttactcctgccacctggacaagtcctcaactgctttcccatgagataaagctggtgggaacctcattcccatttcacagatgagaaatgtgagatctggagaggagccgggacttgtctgaggtcacacagccagggaggtggatgttagggtccctgcctcgggtttggagaagcatggtggacacagagctagtggatttgagaagctggggtggtcccgtattcacctctgttgctcccccaactccagagtgacagagctgggcctggcagtgaagcgtcttgagaagcagaatctggagaaggatcaggtcaacaaggacctcactgagaagcttgaggccctggtgagctgcaggtgcccctgagatggggcagggtgagatggggtaccggccagatccatggacgcaggcttagggctgggctgcctgggtcacccccagcgtcccactcacactcaggttcagccctcacaggtgtgcaggctttgtgggaagcacactcacctccatcccatttcttcctcccagcagccctgtagcataatcctcataacacagatggggaaactgaggcccaagaggggtaatgcttgtccagtctcagagccactaagcgggagagtcgggacttgaactcccatccacgctctccaggtccagatgcggcctctggcaacctagctgccccccacccccaccagtgggacactcactcccccagggtacagcctggtttggtcacccctctgtgtggggcctggcctgggttctaggtccggctctcctgcaatcgactgtgtgacctggggcaggacatagctcttctctgggcctggtctgttcagtgagggcctcgggcctgctgtggggtctaccaggtggctggcctatggacatggcttcagaggccacctggtcagtggtgggccaggtagggagggaaaggggaggtttcagataagacagaaccccaaccaccctttgtctccctaaccgcactccaggaatccctgcggctacaggagcaggcggccctggagacagaggatggagaggggctacagcagaccctaagggacctggcacaggtgtgagcccagagaggcgggaagacagcgccctgccaggcagtcccaggctcccccgccacgtctttcggtgacctgggactgaactgcaaatgggtgggggcctgggacccaggctgtagctgctcagcacccctgctagctcacccagcctctgccttggggagcccccagtctcagaggggaggcacgaccctttgggagcccacctgtgagcaaggccaaatgatgtcttcccaataaatgggaggcctcagcggcgagccgaggactgagctagtggaggaggtgaaatcaggaaggcttcttgtaagaggcagcatttggaatgaggcagcccccagcctcacctgggcgtctttgcccagctaaccccgcggttcctaactcagcagcctccttctgcctccctcccccaccctcaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggtaggaaggggcttgagcgttctgggcgcagccagaggcctgggggaggggctcgcgccctccgggtgggggcgggggcgggggcaggtccggggccagggtccgagggaggagtctgagcgccctggggtgcagccagagccctgagaaatagtttctgagggtgtcaggacccccaaggaggtggccgagagctctgcggtgaagccgagcccagaagtgggggtgcttgggcagctgggggtgggtgcttgggcagctggtggagggaggaggctgcggcagtgttagggtcctggtagagagggagacaggtccctggtcatacagagccaggaccctgggaaaaggtctagcaaggggaatcagagcttgggaactaggggcagagccagggtagggaggagtctgagagtggaaccaggatgcaagggggaggagcctaggagccctgggggtgggatcagaacccaggagacgagtgtgcctgggggtttgtctggcatccggggggctttgataggagttgtccgggaccccagggaggtgagggctcagagggtggcgagggcacataggaggggagcggaagcctggctctcaggcctaggcccctatcctgccccaggccaggtccaggccctggaccccgcctagcgtaggctagtgtgtatccctggaaccagaagagagtaggtggctctggaggcctctcaggcccccccagactctgtgaccccccacaccccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcaggtgccggggaggtctgagctggggggtactgaagaataagtcaccgtctgggcataacaccagtcaagccttatgcgtatggctctgcactaatatggtcgccactagctgcatgtgcctattaacgtttatttatttatttatttttaaaatggagtctcgccctgtcgcccaggctggagtgcagtggcgcgatctcggctcactgcaagcgccgcctcctgggttcacgccattctcctgcctcagcctcccgagtatctgggactacaggcccctgccaccatgccgggctaattttttttttttttttgagacggagtttcactgtgtggcccaggctggagtgcagtggcgcgatcttggctcattgcatcctcctcctcccgggtttaagcaattctcacctcagcctctgaagtagctgggattataggtgcccaccaccacgcccggctaattttttttgtatttttagtagagacggggtttcaccatcttggccaggctgatcttgaactcctgacctcatgttctacccgcgtccatctcccaaagtgctgggattacaggcatgagccaccgcgcccggccaacatttattttttagtattcagttttgttttgttttgttttgttttgctttgttttgagtcacactcttgctctgtttcccaggctggggcacaattggtccatcacagctcactgtaacctggaactcccagactcaagcgatcctcccacctctacctcccaactgcccctagttgggggcctgggcctggcctggggaaggatatgggaccgaagcctgagagttaggtttccactcccttcctctgtgccctcaccaccctctgagccctcacctccctgggttcctgggcaactctgatctcagcctcgaggatagtagacaagccgccaacatttctaaattttttgtagagatgggggtctcactatgttgcccatgctggtcttgaactcctagcttcaatcactcctcccacctcagcctcccaaattgctgggattacaggcataagccactgtgcctggctctattaaaatttaattaaaatttttaaaaagtgaaaattcaggctgggtgtggtggctcacacccagcttgctggccaacatggtgaaaccctgtttctactaaaaatacaaaaattaaccaggcatggtggcatgctcctgtaatcccagctattcaggaggctgaggtgggagaatcacttgaaccccggaggcagaggttgcaatgagccaggatcgtgccactgcactccaggctgggagatagagcgagactccatctcaaaaaaaaaataataataataatgctgggcccggtggctcacacctgtaatctcagcactttggaaggccaaggcgggcggatcatgaggtcaggagattgagaccatcctggctaacacagtgaaaccccgtctctactaaaaatacaaaaagtaaattagctgggcgtggtggcaggcacctatagtcccagctacttggaagactgaggcaggagaatggcctgaacccgggaggcggagctggcagcgagccgagatggcgccactgcactccagcctgagcgacagagcaagactccgtctcaaaaaaaaaaaaaaaagaaaaaattcagttctttagttgccctagccacatttcaagcactcatcaaccatacatggccatagaacatttctgtcatctcagcgagttctattgccagcactattttggactgtatttcttggagttttttttagagatggggtcttgctgtgttgcccaggatggtctcaaactcctggcctcaagtgattcccctgcctcggcctccaaaaatgctgggattagaggcataagccaccatgcctagccttgaagattttttttttctcttaatttgagacagggtcttgttatgtcacccagtctggagtgcagtggtgcgatctcatttcactgcaacctccacctcctaggcttaagtgatccttccatctcagcctcctgagtagctggaactacaggcacacaccaccacgcctgcctaatttttctgttttttgtagagatagggtttcgccatgttgcccaggctgatctctaactcctgagcccgtctcggcctcccaaagtactgggattataggtgtgagccatcacgccaggcaccctgaagatttttaagacaagaaattatccacttcttagctgccaggttgtttttgatattttgttgtttggtttttctcttcataaatgtaaccatctaatgaaaagtttgaaaaataggaataaaaagacagcgccttctcacagcctcatctgcccatcctaattcatttagggcactggttttccttcccattgtgttgcctggcagtgagatagcaaacgtttcctgcacacctactgtgtgccaggctcttggccgagtgttttgtatgtactctgtgatttagtcttcctgtcaaactcatgcaattcggaactctgttgttgtaagcttgagagactggctcagactcatacagcgtgtgtggctgggggtggcagggtgggaactggaattcaggtccatgtgagagtaaacccaagctttccatgcctggaaaggagaaggtctttttaagcagttgtgttcacagcaaacatcccattttgcattctgctatttttacttaacagcacattgtcgactgagcgaggtggctcacacctgtaatcccagtattttgggaggccaaggcgggtggatcacttgaggtcaggagtttgagaccagcctggccaacatggcgaaaccccatctctactaaaaataaaaaaaaattggccgggcacagtggctcactcctgtaatcccagcactttgggaggccgaggcaggaggaccacctgaggtcgggagttcgagaccagcctgaccaacatggagaaaccctgtctctactaaaaatacaaaattagccatccgtggtggcacatggctgtaatcccagctacttgggaggctgaggcaggagaatcgcttgaactctggaggtggaggttgcagcaagccgagatcgtgcactgcactccagcctgggcgacagagtgagatgccgtctaaaaaaaaaaaaaaattactgggcgcattggctcatgcctgtaatcccagcactttgggaggccgaggcgggcaggtcatgaggtcagaagattgagaccatcctggctaacacagtgaaacccccatctctactaaaaatacaacaaattacccggacatggtggcgggcgcctgtattcccagctacttgggaggctgaggcaggagaatggcgtgaacccgggaggcggagcttgcagtgagtggagattgcgctactgcactccagcctgggggacagagcgagactccgtctcaaaaaaaaaaaataaaacaaaatcacgctgtgaagttttttcgcacctatggccagtggggaacgtggcagctcatggcaagtctttggggtcccagttgttcccttctcctccctcccctgccgtggccaccatgtgcctgtgtagcaggaagctgtgggatctgcagactcagctctatcaggcttcccagaattgaggggcatggggtgttataggggacatttcctggtcacatggcctagcagagctggtggcacaattgccgtgtgtcccaggagcctagctcggcctcttctacctggtagggtgcttggagatcacaccagcacctccatccactccaagtgggcggactggagagaaggaaagccaggttcttctgctggagtgtgtgagtgaaatgagtcagccatggacagggtggtcagggaaggcttcctggaggcaggtgccttggaagactggaggatgtagctcatggctagaggagcagccagccaccttccctgcagagagcagccccagcatcccctctgctccccctccccttgtcctgaagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcaggtgagcagcatctcgccaccctgccaggacccttcagatgtgcctcgggtcccctgacagtgcccccctggggttaggtgacacccactgggtcctgggcctcctaccgtctggacccctccgatgtcgggttttctaaccagacccatttcaggaaactggggctcagggaggtatagtcacttacctggagtcagagaactagttaaaaggtagaacttggatgataataacaagaataattaaaataacagtagtaatattagcagtagtattttaaaaatttagttagaagaataataatatccttactaatttcactaagtgccagataccattttaagcaattcagttctctcatttaactccatgataactctgtgacatagaagcggttatctccattttgtggatggtaaactgaggcacagagaagccatgtcacttgccccaggtcacacagttagcagaagagccaggatttgaacccagacattctgccttcagagttaacctcttcaccactgcgctgcttacctctcagggacgtgatcgatgatgatgtttagtagactgtggtggagcatgttattcttgtttctgaaggtccttggggagatgtgtcaggcactattttaagcacatgtgaagtttgtatccttaaaacaggccgggcgcagtggctcacgcctgtaatcccagcactttgagaggccaaggcaggcagatcgcctgaggtcaggagttccagaccagcctgaccaacgtggagaaatcccgtctctactaaaactacaaaaattagtcaggcgtggtggtgagcacctgtaatcccagctactcgggaggctgaggcaggagaattgcttgaacctgggaggcagaggttgcagtcagccaggatcgcaccactgtactccagcctgtgtgacagagcaagactgtgtctcaaaaaaacaaacaatgtcacgaggtaagtgttacctcattttgcagatgtgaaaacggaggcccagggtcatggagctaagcggtagtgggcttggttgccctgtggctcaggctgtttctctccaaactcctgcctcaggcctggtccccagcccagcatctcgctggctacaggaggttcggggcaggaaagtgacatgggccacccacccaccctttgtcccacagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggtgggtccctgtctgctgcacaaccacaaacctacctctgacccccagccccaagccttgtcactctggcacagactggtcccagtgtcaggcagacctctgagcctggtcacagactgaccccttccttctggatacaggctgatctttgtcacaggccacagacctctggacctctggtcccagccataagtggactgacctctctttatggccgtatccctgctcttctggatgctcctgggggcaatgcctatagctcagggtcatccagtgcctgagactcagctcctggggtctgagagttgtggccacagcgcagagggtccttggcaggggggcctgcgctgtccgctgcagcctgggctctgagcagtgctatccctagaccctactcaggggatcctctgaactctggccctgccctgcagcttgagctatttttgcacagctctgtggtgtgtggcttttaaatggctcataagcagcaggctttctgcggtgatttttttttttccatctcacactgtgtcccctccttgtctcccctaccctgtctctgagggtccatctctctgggtctcttcttgggcctcctcacctcctcccgacctttctgcctttcctcatttctcggggcctgaccctgcaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccaggtacgctgtgcacctgcgggcccacctgccttgcccacccatcctccccactcagtgaggcaccccgggcccagccctgtacctgtcttggcccctgcctccctttctgtccctggttctctgtctgtctctggttctctgtctgtctgtctatcccctctaggcgtcaaagcacagaagttccatgggccctcctcatctccccctccccagtgtcccatacacccaagggcactgtccctcattccctgggagcctcccctgggctattgttgctggtgggtgggtggaggaggcgtcctggtcctgggagggacgccctgctcacgaggccccactcctacctggcctccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcaggtgggcaaagctgtgtgtgggggtggtgtggagagcatgtggggcaggccgggctcccagccccctgcatccagtcctgggttaagtcacaggcactggagcctgcttctgggttaaatccagccccacttctgctagctggggaccttggacaagctgcccaatctcccatacctcagttgccccatctataacatggggccagccaggcgcagtggctcacgcctataatcccagcactttgggaggccgaggcgggtggatcacctgaggtccggagatcaagaccatcctggctaacacggtgaaaccctatctctacaaaaaattagctgggcgtggtggcacgcgcctgtagtcccagctacttgggaggctgaggcaggagaatcgcttgaacccaggaggcagaggttgcagtgagccaagatcatgccactgcactccagcctgggcaacagagcaagactccgtctcaataataataataataataataataataataatgatacagattaataataggtggagactttttagaattggaatcttagacttttgggaacatcacatctggaagagaccttaatgtttcagggatccagggaccttcatgcaaggtctatcctggagcgcctaggtttctgggaggggcctctagaggatggggtagggggtgcaggaagcagggtgcaggtctccaccttgaggcctgccgagcagctgcacttgggtctggtttatatattcagcttctctgcaagtttagagtaatacaagggttctgttactcccagagctgagtgagggccctcattttttttgtttcattttgttttgtttttgttgttgtttttttttccagacagagtcttgctctgttgcccaggctggaatgcagtggcacgatctgggctcactgcaacctccgcctccagggtttaagctgttcgcctgcctcagcgtcccaagtagcagggactacaggcgtgcaccaccacgcccggctaatttttgtatttttagtagagacagggtttcaccccgttggccaggctggtcttgaactcctgacctcaagtgatccacctgccaaagtgctgggattataggcacgcaccaccgtacctggctgggccctggtttttgtacacacgtgcattgcagatctagagaaggtcatgacttgcccaagtacatgtagcacatcagggcagaccctgggctcaaacccaggccttctgccaggactgggttaggcccagagttggggtgctgcacgatgaacaagctgggggacgctgggagtgctactcagtctctgggtgggggccagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcggtaaggccttgggctctgcccaacccgccctggggggtcctcctggggccacaccatgaccagccacacgcaggcacgggcccccaggggcagttactaaggagtctggcttgccgactcgtcctagctgtggctcaggcttccccagggagtgtgggcctggccaggcaggtagattggcacttggcccatgcctggccactccctgagatccacagtttcctggggccagggaggctgagtcccagggcctcagggactgtatgtgctgcagcttggagaaggaagccctggagggcagcctgtttgaggtgcaacggcagctggcccagcttgaggcccgccgggagcagctggaagccgaggggcaggccctgctgctggccaaggagaccctgactggtacgaggggctggggacttggggggaacaccaggttccagcccagactgcagcctcccaaggtctggggtctcacagaagttgggagcactggagtaggagtctggctggcctgggttccagtcctgtgccaccacttagatctcaccttcccttgagcaagcccctttcctctctgggctgcagattcctcagctgatgattggaggtggcaatgcccaccttctaagcctgttgccaggatgacgtgggaaaagcgtgtaaggccgtggcacggtgcctggctgagtcaacagtaactgccgttcatcggtcatcaggcctgttagtctgagttctctgtgcttttcagatgactctcttggccccagaatcccagccccacttccctgcaccgttcccatccagtctctgaactcagggcttctttctgctcacctaacattaactaagcacctacttgggtcatggaaattaattttcctgtccatgtacacctgagccagacagaaccaggaagggaaatgctggtgggtttccaacccgggagatggtttttagatggtagctataccatttccattccctgtagtcatttccattaatataaatagttaacgtttgacgggtatgttcatgtcagtcattaaaggagatgctttatgtgtagctgtgcagctgtgggaagttgctgctgatctctgagcctccatttcatcatctgttaaatggggatgaggataaactacataggcatgttatgaagacaaaatgaggttatgtctaaaatacttagctgggcgcttgacccatagtaagtgctcagtcaggaatagggttgttttttgtttgtttgttttgagacagagtttcactcttgttgcccaggcgggagtgcaatggcactatctcggctcacctcaacctctgccttctgggttcaagcgattctcctgcctcagcctcccaagtagctgggattacaggcatgcatcaccatgcctggctaattttatatttttagtagagacggggtttcgccatgttggtcaagctggtctcgaactcttgacctcaggtgatccacccgctttggcctcccaaactgctgggattacaggcatgagccatcacgcccagcctgtttgttttttgagacagagtctcactcttgttgcccaggctggagtgcaatggtgcgatctcggctcactgcaacttctgcctcctgcattcaagcgattctcctgcctcagcctcccaagtagctgggactacatatgcccgccaccatgcctggctaatttttgtatttttggtatagacagggtttcgctgtgttggccaggctggtctcaaactcctgacctaaggtgacctacctgacccagcctcccagagtgctggattacaggcatgagccactgcgcccggcctatttgtttttttgaggcagagtctcactcttgttgcccaggctggagtgcagtggtgcaatctcagctcactgcaacttctgcctcttgggttcaagcgattctcctgcctcagcctccctgaggctgggactacatacgcctgccaccacgcctggctaattgttgtatttttagtagagacagggtttcaccatgttggccaggttggtcttgaactcctgacctaaggtgatccacctgccccagcttcccaaagtgctgggattacaggcgtgagccaaggcacctgacctagggttgttatatgtttgacatccgtcccatttgggaggccttctcatcagtcattttatgcctttaatgccattctaggtaggcaggaaaggggtcagggccagtgggcccatgtagcatatagggaaactgaggcccagagagggcaagccacttcaagaggacccaaactagatgccaggcaggccctctgcctctgggattttgcccatgtggctcacctggcctaagtctgctggcccaaggaaaagtttcaacccaaccctgccctttcccccattcctctcgtgcaggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggttcaggcagctggggaggggtgggcaggactctgagccagtgtttcatcatcgttcttgctctgcctcggtctctacatctgtgaaatgggacttcctctctgttgtggaggtcctggggacagctaggaggactggggggatggggaggttgtggttcttattagacatgcagattcccaggtcccaaatctggtccagccctggtaatcctgatgcagagggtccacaaccacatttgggaaatactgacctaatgtacagcaggaaagcactttcatttgctaagaagtactgtttgcatatgaagagccactcagacctcagcatatagaaaggcaaggggccagggaagttactagaacactgactctgggtttgaattgcctgggtttgaatcgaatcttggtcgcttactggtgatgctacccaaggtgtccgtgccttcatttccccacctgtagaaatagggataggatagtgaaaggtattgaagatgagctgagaccatctgcatagagggcttagcatagtgactggtacttagcaaatgctccataagttatgattgctggcactgacatgctctccagagtggccctcgggacaggggccctcagccaccaaatcctagacagggctgcctctgacagaggtgcaggctatgactgcatggctccagggcatgccactcaccctgcagtacccctggccttgggtggttgttaccacgcttctccaggaggtggcggtaaagctcttttttttttttcttttttctttttttgagacggagtcttgctctgttgcttaggctggattgcagtggcgcaatctcggctcactgcaacctccactttctgggttcaagcgattctcctgcctctgcttcctgagtagctgggattataggcgcgccaccacgcctggctaatttttgcatttttagtagagacgggatttcaccatattggtcagggtgtctcgaacttttgacctcgtaatctgcccacctcggcctcccaaagtgctgggattacaggcatgagctacggtgaagatcttaaagaaggggcggtttggccggtcgtgctgactcatgcctgtaatccagcactttgggaggccgaggtgggcagatcaccaggtcggaagatcgagaccatcctggctaacacagtgaaaccccatctctactaaaaatcacaaaaaattagctgggcgtggtggcacgcgcctgtagtcccagatacttgggagggtaaggcagaagaatcgcttcaacctgggaggcagaggttgcagtgagccaaaatctcgccactgcactccagcctgggtgacagagcaagactccgtctaaaaaaaaaaaaaaagaagtggcagctctgtctgcttctcacagagttgctaggggcaagtgctgaggcaggcacctgccctcaggctccccaggtgggctgctatttgcctgtgggctctgcctgcccgcctgtccagtccccagggatctgaactcctgtgacctcccccttgctcttcttgccctttgcattgcctggcttggcctcattaatgtccccaaatctgtgttctctccagctcctctggcaacccctgacccccttcattcctcacagccagtcctaactcccctccatcccaaccccaatccctcttccacagctgtcggaacatcccctaagctaaaaatcagattgctccttgtcaccttggctcgagtcctctctcccactcccctcactgtccttagaatccccatggcccacacggcctgtcctggccccacccctgcctggggctctggccctgtgactcaccatgtcccgttcccctctgcaccctgcatcctctaggcctttccaggggctgtgttcttggcctggggtggtcttttctctccttacctggctgacagttacttgtccctccgcaggggaccatgttcggacccccaggccagcccactgctgctccttggcactttcacggccctggcgtgtccccgtcatagcccttatcactcccttgtatttacctggtcaccctccatctctgagggtatgggggccagatggctcttgctgccctgatgttttggggggtctgcctgggccccctcctggtgtgtcacaggcatccggtcctggccccctaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggttcgtgagccctggcatggcctctgctgctctctgagctgctccagttctggggccgggccctgctctgccacttggcagctaggagccctggggcaggccactgccctcttgggggcctcagtttccttacctgcaggaggggaggattagaagggggttcgtgaggctttgctgtgctccatgcctggcacacagtgagcacttactgagtgacagtgacagtcgtgacaccaggaaagctgttccatattctcccatgcctcgtcccaccccacgctgggcatggatcctcatggctgccttctgagcagtccccacgatgcccacaggcatcagctgacgtgtccccccaaataacaaatccctaactttcctataatgtaacggagacagggcagactgtgcccatctcctctcctcaccagctgtgtacctgggcgagtcactttacctccttgagcctcagtttcctcatctgtaagatgggtagaaagaaagactctgcagtcagggtgctgtggcgggttagtgagctctatgagtggtatccacgtccgggattcttgtgactgccgttgtgcccttttccagggctgcatgtctgccctgggtccacctgcagtggcacactcaggcctctaagcccccagtgggcacatttcctaggcagcaagaagcctgagcatgcccccaggaccagcccatcccccaagccctttgtcccctgcctctgcccaggccttgtctctgaaggagtctgagaagacggcgctgtcagagaagttgatgggtacacggcacagcctggccaccatctccctggagatggagcggcagaaacgagatgcccagagccggcaggagcaggaccgggtagggcaggctgggcagctgggcctctgtctcatagagaggcacatccctggctgaggagcccccaccacggggcggcatggccctgtcctggagaagcttccaggctgtgggaaaggaggtttagcccttcttttgggagcccccatctgagggaggtggctcagccctgccctgatgaatccttttggcgtgagggagaggctggctacacgggcagcactcactatgcatccaggggttggcagagggtccggcaggccagcgggaggggccgtgtttagagctaaaagtggacagtgcactgagcgggttgggagcagcccggggctgggggacacagcaggaccaagtctgaggagcccctctgtcccagagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggtgagcagccgcccccctcttccaagcagcataccctaaatggcactgtgtgcctgggggcctagttccccagggccc

SEQ ID NO: 323 - DNA, 54619 bp, Homo sapiens
gccactctctatttgtcttaatagatttgcctgattttttttaaaatttcaaatcaaggtcactgttgtgaaagggaatttcagagataatacattgttatgaagggccgggtgtggtggcttacacctgcaatcccaacactttgggaggctgaggtgggtggatcatgaggtcaggagtttgagaccagcctgaccaacataatgaaaccccgtctctactaaaaatacaaaatttagctgggtgtggttgtgcacacctataatcccagctactcgggaggctgaggcaggagaagcgcttgaaccccagaggtggaggttgcagtgagccgggatcatgccacagcacttcagcctgggcgacaaagccagactgtgtctcaaaaataaataaataaataaataaataaataaataaataaataagttcctctgagttatttaccatctttctgttgaaatctttactgaaattataaatctcagctttcagaagaagatgtggtaattaaatcgtatgactgttaaaacatacggagctcagctgtgtggacgcagagtaactctgcgtggggtgtgaggtagggtgtgtgtttagaactctgcaagttgaagatttcagagacaagggcagctgcagaagtcctgagttttacactaggacaaaagagaatagatttttctcttatggtggaaagaacatttaaccccgcaatatgtatttagatgatgtcatactttcttcttgaaatatacaaaccctttgatgaatttctttcatctttaaactctttcataatgaatctcttaaataataaatctttctaatacatttttcagtctttgtattcatacaccaatgtaaattctttttttttttttttttttttttgagacagagtctcgccctgtcacccaggctggagtgcagtggcacgatcttggctcactgcaagctccgcctccccggttcaagcgattctcctgcctcagcttcctgagtagctgggactacaggtgcccaccaccatacctggataatttttagtagagtcgggatttcaccatgttggccaggatcgtctccatcttctgacctcgtgatccacagaccttggcctcccaaagtgctgggattataggcttgagccaccacacccgaccgtaaattcttaaaaagacagcatatttattaagttcatgtgttattgctattggaaacaaagacacagtagataaggagtattgcatgagcactggatctgagttgaaaactatggaagacactaacagaactatcttcaagtccgttaaagggaattatttgcagccaggcatttttttccctgaagtaatatctatgacttcttagtagatgttctgaagtggcaaggtaggaacttcagttattgtaggtgaaaacctcaagctatggctgggcatggtggcacatgcctgtagcctgtactcaggaggctgaggcgggaggatctcttgagttgaggagtttgacgctatagtgcactatgatcactcctgtgaatggctgtggcactccagcccgggcaacatagtgagaccccatctctaaaaaaaattgaaaattaaaaaaactttcagatatgcttagaagcagatttttcaaatcccatggggaagggctttaagaagagtatgatcagtaaccagcgaaacaatgattaaagcattgtctttagaagatgatgaactaaaggaatctaaatcttattgcctgaaactctttgcagtcaggcagcttaattgggtgtctttgagaaaattattgtctcatttatcatatttgtgcaatgaaaataatacctacattgtacgcttgtggaatttaaataacaaaatattttatgtatctacatatctcctggatatagtacaagtttaaaacattgtagtttatcatcagtttcctgagagatggcaccaatggcaaaacggtcaccaaagctattcctttagaattagaggacagtccccacttcatggacaacatgtgagtctaagcacccatagcgtccatcagcctgtcctctctccttttttaaagagcaaaacaggaattctgttgtgattgaaggactttctgtctgtccctggaatcctagatgctttgagataactgcatagaagttgcagacttttttcaaacactgatggaatgaaatactgtcattgcctctcttttttcatagctagcatagaagactgatctttttgggggggattgggtgggtggcaacctcatccaaggaggggctacataagtcgtagaagaccttgccaatccaggtaggttgtaactttaggctctgtatggctggtcagggagtcagtctctggcttgactctgaccttccaggagcctggcagttgaagaggatctcagggtgatcagatagagaactgcagaaggtgagagtcaagttagcctcttccagacttattacagtcccctaaagcattaatgacctttttgcctaaagccgatacatggacatttttagttcattgaccttcaaataattgcagctgtttggaaagctattggtcatagaaactggtagtacttccaaacttttcagtgatgtttatcatttttttttttttgagatggggttttgcttttgttgcccaggctggagtgcaatggcgcgatcttggctcaccacaacctctgcctcctgggttcaagcaattctcctgcctcagcctctggagtagctgggattacaggcatgtgccaccacgcccggctaatattgtatttttagtagagacggggtttctccatgttggtcagattggtcttgaactcccaacatcaggtgatccctcctgccttggcctcccaaagtgctgggattacaggcgtgagccaccgcacctggctgatgtttatcatcttaatagcatctgtcctttaaccctgcacacacactccaaaaaagttaactaaaagagacaatgattaattttatattctgatgttttcttatgaacacatttgtggccactttagtgtccagcaaagcatttctttggcgagtgatttaaggaggggtggaaagtggaatggaagaagtctctggaaagtctttaacactgagacgtattttctccctgtttgactccaaggaatttccactcatggaatctggcctattagaaagaactttttccttttgtacttgattcaacttaataaattatgttaaccagctatggtgaatgatgagcattcctcaaaccacagaacaataggcttcatcgttgaagctctaaaagagcagggatctatctgttccaattctcttctgctgggcaccatcttctagctctgctgcagtctctcattcataattcttcccctagaccaagttcttcttttttactgacctctaggacacctggcatgcattcctcttctgactgcctttgttggcctgaatgctgaaataacatcactgaactaacatctcctaaagaagacatttgtcatcagaggcaaatcctcagtgaggattaacctgtctttaaaagatcatgagtaaccggcatatgagatggcatgagactaagaagtgttcctttgaggcagacccgcaatggtctgtgtgcttgcctctccggtcatatcaccaattatcaaatcttggtgcaccatcgcatcccatttgtcacacatctgatttttcttaaataattatactgttcctttgtgaggattaacccgtctttaaaagatcatgcgtaaatcagcacaatctgaaagattcagagcttttttacctttctctctgctaggcacaatgattaccatctccagccttattcttcacagccactcaatcgtggtccttgcagttttgcttcactccacatacaccatttcatttcccttcccacagtcacttcctagaacagatacagagggaggccctgctttgcatgctaatgagggaccacagaaatgactgcaaacagaaaatggaacgcgatctcgtgcatcaaaggggaatgttctgactgttctgtgacttttaaaaatatgttgtcaaaacattaaaaactattgtaggttataaatgcacaggaacattttcaaaaatactaaaactaatatttagtatagtgtaatttaaaacatcagaaacacgaatcaatattttatttctttgtaaaaatcttaatggagtatagtttgaatgaagctggccctcctcttcttgtagtacttacagtgcagagtgagctataccttgacaaactgtcattctcctaagtttgaatcagcttccaactatttattgtttgtgctttcaatgtcatgaaatacctctgataattcctttaatgtgagttttgtttgttttgttttgttttgttttgccatgtcactttcttgggacatctttatcctaaaatgaatgaacacatctattttcatttatgttgttaagtctgccttccctaagttcctctggaatgcctcaaacagtggcaaattacctccaatagctatttcttccataactccatttacactcaatttgaatttcactttcagagtatattagtcagcgttctccagaaaacagtatatgcacacacagaggcataaatatttatttcatcttatatatatgaagatttttaagatatataaagatttatataggtatacatgaagatttattttattatggaaattggcttacacaattagagaggctgagaagttccaccatctgcattctggagaaccaagaaaaccagtggaataattcagtccaaagtccaagtccaaggctggagaaccacagtgccagtgtccaagttctggagaagatggatgtcccagctcaaacagggggagtacatttgcccttcctccaccttcttgttctatcagatgatgcccacattggtgagggtgatctgatctttactcagtctactcatttacatggtaatgtcttctgcaaacaccctcacagacacaccagaactaatgttttaccagctgtctggacatcccttagcttagccaagttaatgcataaaattaactagcattcagagttctctatttttgtttatttgctgtgcttttatctttctgacacttcactgttggccagttttctcttttgattagccatttttgaaaatgttatgcaggcttatcactggaagaaaaggaaaaaacacagcttcatggtttgctgccagtgtgtgaattgaataaaagatgtggggccgggcgcggtggctcacacctgtaatgccagcactttgggaggctgatgtgggtggatcacgatgtcaagagatcaagaccatcctggccaacatggtgaaactctgtctctactaaaaatacaaaaattagctgggcatggtggcacctgcctgcggtcccagctacttgggaggctgaggcaggagaatcacttgaacccaggaggcagaggttgcagtgagccgagattgtgccactgcactccagcctggtgacagagcgagacacaagactccgtgtcaaaaaaaaaaaaaaaaagatgtgtggtgaccaatcaccaatagatattgaaagaagtgacatgattggtcactgatcataatgcgcctctggtatacatgcagcaatttatgggttgaaggtctagcagtgaagtttctcctttatgcaattattcacagttaatagaccatagcaactgataccagaactgtgttgttgggggactggtgtcattggactaaactgtggtaactgaaatctgcgtaatattggagctgtgctaagcaaggatggactggttattactaggacaactttctggcttctctttttatttttagtgcatctaattcatctgacatttaatcgatccagattttcttccaggatgactaataccttagtcatctaaccactcaaggacctcacaatatcttacatgtagttttcacctaaactagggtataacaattataaccatcttcctggtcatcctcagcatgtatactgcagttatatcctaagatttcatctctattaagctccagggagtaataggtgttctttagccctctgcaggattagagaattgaggctgctttgttactgttgttgttcacaataaacttccataggaagtgagttacaagactctagacctttgttaatcctgaactttctgggcatcttgtctgagtgatatatcttcagtaaagtgtatcctaagagctgtcctttctgtttccttggccttcttcacaagcctgctctccaaatacccccactctgggagactgactagctcccaagttggaacacagagttctcaagcttgttgctttgtaggtgacaccaacagaggaacttctgcctgatgttctatctgctaactcccaaattagagtctggaaagagtaatcttgccttgcttatttagtcaaggatacctctcttcttagtactgctatagagggatgtaaatgcctcttcttcacagttgacttcggtagctgggaaatacgacaatatctctaaatttttatttgtatgtaacacaaaactcccgcaaaagaataagagataaacaggcagaggctgttctgcctttttattctgagcccccaaagaaaaacctgtagtgtcatgctgggcagaattttgtaactattttgaccaatagagtataatggaagtaatgccatggtgccctccaagctagatggtaagaacaccttgcacttctgccttgcctacttaggacatttgttcttagaacccatctgctgtacatgctgtgaggaggacagaataacccgtgtgcagaggctgtgcagaggcactttggccagtagtccatctgaggtcccagccaataatcagcatcaactaccaggtatgtgaatgaagatacacacaggtgattcctgttcccagctgctgtcacacctaaactttgagtcttccaagcaaatgccccagatgtgacatagcagacatataagcagtctgccctgtgtccagactaaactcctgacccataaaatctgggaatacaaatgttgttattttaatacaattgtatggcactgagattggggtggtttgttatgcagcaattataactggaacaagaacacttgaccctgtaagacacttgaaattatatgagttatgacatcagtaaagtatcttttcttatctacactttctatcgtaaccacaatgcatatggataatttgtgaagtgaataaggacatggtgaaggactgattccaagtggctgggagagggaagggtgtgctgcatgaatttcatgttcttagatactagtgagaagaggctgtaacacattaatcactccccttctctcactcatacaatggtagcactagtagcacattatcttttcttgtgaaagtgttgcattaagaaatttcttttggagtagcccccaaactgtaacagaatgtgacgtgataatttcccaccgtcttcaagtactgccaagatgtagaagtctccttattccttgtagacaaatggttgctccttggaggggcctatttgaattttttttgttttgttggtcttttttttttttttttttgagacagggtctcactctgttgcccaggctgtagtgcagtgatgcaaccacagctcactgatgcctcggccttccaggctcagatcctcccacctcagcctcctgggtagctgggaatacaggcatgcaccacaaagtctggctaattttttgtagtttttcatagagatgaggtttccccatgttgcccaggctggtctcgaactcctgggctcaagctgtccacccacttcagcctcccaaagtgagccacctttcatctccccatctcatcttatgactctgtgcttgaactggtgtatttaaagattaaggacctttctgaccaatgtcaaatgaaccatccagatggttctggctctcagaaagatcagaggcagtctgaatagcaagtaaggatcaagtcaaccaccagttcaccaaacaaagccaaaacattggcatcaaggaataagccaatggctgacataagtacctgctgccccagaagttacttgtttcaactatttgagttcagcacatcatcgcaattctaaatacttaagttatcttcagcaagtgaatgcaacttataacttattcttccatccttgggtaggtgggggaaccatttgccattttcagagtaaattcaactgagttagaaggaagcccctataacatcaacagaaagcaaattctatagtcaagtctctcaaccattaaattttaggattatattctggtggtacttcttagaaaaaagaaagaagtaaagtttcacctatgagataaattagaggacaaagtgttacttcctatcttcttgcaatcttggccgggcaccgtggctcacgcctgtaatcccagcactttgggaggccgaggcgggcggatcacgaggtcaggtgatcgacaccatcctggctaacacggtgaaaccccgtttctactaaaaatacaaaaaaattagccgggcgtggtggcgggcgcctgtagtcccagctactccggaggttgaggcaggagaatggcgtgaactcaggaggcggagcttgcagtgagccgagattgcaccactgcactccagcctgggcgacagcgagactccgtctcaaaaataataataataaaatataaaaataaaaaagttgtcttgaccatcttggggtgaaacagctggagattaaaggaagaaatggctgccgagcacagtggctcacgcctgtaatcccagcactttgcgaggccgaggcgacagatcccgaggtcaggagattgagaccatcctggccaacatggtgaaaccccgtctctactaaaaatacaaaaattagctgggcatggtggcgtgtgcctgtaatcctagctactcgggaggctgaggcaggagaatcgcttgaactagggagtcagaggttgccctgagccgagatcgcaccactgcactccagcctggtgacagagcgacactccatcttaaaaaaaaaaaaaaaaagcgggggacgggggcggaggggcgtggggaagaaatggcaaggctctgggaggaataaaaagaaaaaaaaaaaaacaaaacaaaagaaagaaaataaccagaattatatctttgttaaacgaggggccaaaaccagaaagctttgtacaaggttttgtgtcttggcagcaagcattgcccttacaacatagaatgtcattgcaatcatatggtatcagtaaccaatgaattacggccagaacacctaggacctgttcttctagactttagatgtgagttctccttctcacaaatctcaaatgcatgttcattctgaacactggctggttttttgaccctttttgctgacctgaaagggctatgtaggtagagtaagactgaaactattgcctggaacatccctcagagtggccaaaatattacctttatgaccataaagcaattccaattcacattgctttctgtaatagagctttcctttccttccttccttccttccttccttccttccttccttccttcctttctttcttcctttctttctttgttgacagagtctcactctgtcgactaggcttgagtacaatgatgctacctcggctcactgcaacctccgtctcccgggttcaagtgattctcctgcctcagcctccggagtaactgggattacaggtgcatgctaccatgcctggcttgattttggggtttttagtagagacggggtttcaccatgttggcaggctggtctcgaactcctgacctcagatgatccacctgcctcagccacccaaagttctgggattacaggcatgagccaggcataagccagtgcccagcctgtaatagagctttctggactactgagttctacagtattttcctgtatgattattttcaatttctgtctcaagacttgagttaggctctttcaataaggcccaaacacactaccaattaatagcattatgctgcgcttttgatttcaactttggtcccagaacccagaaatgggagcctgtgtctattatctatctcatttttagtggtctttgtggtctgcatggtgaagatgtaaaagctttaactaagatgtaggaatggagaaaagaaaaccaggagaggacttgcttacattctaaaagtgggttgtaggggaagaggaagcaaagctgagacttctgagtaactggacttacgctaagatgcctaactgaggtgggggatgatttagttttggatggttacatggtaaactaaagaaaaaaagtattgaagtaagacaaacatctaaaaactttataatatcttaatttgattttttaaaaattatactttaagttctgggataaatgtgcagaatgtgcaggtctgttacataggtatacatgtgccatggtggtttgctgcatccatcaacccatcatctacattaggtatttctcctaatgctatccctcccctagccccccaacccctgacaggccccagtgtgtgatgttcccctccctgtgtccatgtgttctcattgttaacctcccagttatgagtgagaacatgcagtatttggttttctgttcctgtgttagtttgctgagaatgatggtttccagcttcatccatgtccctgtaaaggacatgaactcatcctttttaatggctgtgtagtattccatggtgtatatgtgccacattttctttatccagtctatcattgatgagcatttgggttggttccaagtctttgctactgtgaatagtgctgcaatgaacaaacatgtgcatgtgtctttatagtaaaatgatttataatcctttggaaatgtaaatccttataatcccagtaatgggattgctgggtcaaatggtatttcttgatctagatccttgaggaatcaccacaccgtgttctacaatggctgaactaatttacagcctcaccaacggtgtaaaagtgttcctatttctctacatcctctccaacatctgttgttttctgactctttaatgatcgccattctaactgacgtgacatggtatctcattgtggttttgattttttaaagaattctacattaaacatcttgatgaattactaaaggaatttctgttggtaagagaaaaagcatgactactttcactgagagtattcagtactgttcaggttttattcccagtgcaatatgacaggaaaaatgaaatatacatattagaatgaaacatcaattacacagccactgatataattttcagaaaatgaaattaaaaattaataaaaacaatgagttaagaggacagataaaagataaaatgaaactcaaaagaattctcatgaatcaaactgaatcaaattgaatttgtacaagcaaaaagtttctattcacattgaaaactctaaaatatcttgatatacacttagaaaaagtgagtattccctatgcggataaatctacagaatgttacttggactacaagagttaattaatggagagacatcatctgactagatgagaatatccagcattatttatatcttgattatctcagcctcctccaaactaaatatgtttaataaaattttaatcaaattattgttttttttttttggaacgtcagtgcttcacttcagatttcttttgaaagaaaaatgtatatgaataccttatattcgataagaatgtgaaaagatttgctctactatgtatcaaaaaatgtaaagctaatcaaaacaaaattaagggaaaagctatattataaatattgattaaaatcattataaaaaccttctgcaatggaatagtaggcaaagcatttcaacagacaagtcacaaaaaaagagagaaaagtaggctcttcaaatgaaaagctgctcaactttcttcccacaacaaagatgtgaaacagataattagggtttgatcattggttcttttgttttgttttgttggtttctcttttacacataagaggtttaacaatttgaacccagtgtctttaagacagaaatgtcacttatgtcagtgttaatgtaattttggaggaacaaacattgggctgtatctataaagtgttcttagtttttttgtttgtttgagatggagtttcactcttgttgtccaggctggagtgcaatggcacgatctcggctcactacaacctccgcctcccgggttcaagcgattctcctgcctcagcctccccagtagctgggattataggcgcacaccctgacgcctggctaatttttgtatttttagtagagacggtttcaccatgttggccaggctggtctcgaactcctgacctcaaggtgatctgcctgcctcagcctcccagagtgctgggattacaggcgtgagccaccgtgcctggccaaaagtgttcttagtttttgacctagcaattccacctgtagaattttttttatataaaatagacatataaaaagataaaagataggctgggcacagtggcttatgcctgtaatcccagcaatttgggaggctgaggtgggcggatcacctgaggtcaggagtttgagaccagcctgaccaacatggagaaaccccatctctactaaaaataccaaattagctggacgtggtggcgcatgcctgcaatcccagctacttgggaggctgaggcaggagaatcgcttgaatccaggaggcggaggttgcggtgagccgagattgtgccattgcactccagcctggacaacaagagcgaaactccacaaaaaaaaaaaaaaaaaaaaaaagatgcttatgatccggcggatcctcctgggttggccaggccggggagagggcgcgggcgccgagtggcgggggcagcgggcgggcgcggcgaccggggccggggcggggatcctggcggcgaccgcggaggcggcagcgccccgggcccgcggccccctcccctccggcgaggggagccgctggatggggccggtcggggggcggccctgcggcgcagagcggcggcgacggcggcggaccccccaggcgggccggggctgagcccggggccggggcgggggctccggggggaccatgcccggaggccggcgggcagcagcatggctcacgggcctggcgcgctgatgctcaagtgcgtggtggtcggcgacggagcggtgggcaagacgtgcccactcatgagctatgccaacgaagccttcccggaggagtacctgcccaccgtcttcgaccactacgtagtcagcgtcaccgtggggggcaagcagtacctcctaggactctatgacacggccggacaggaagactatgactgtctgaggcctttatcttacccagtgaccgacgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaaggatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaaagaataggatcaagatgtataaactgttgtttaattacgtgagaaacatcttcagtggccaaggaaactggccatttctctgagaaagcaaatgaaatgctacagctatacccagaccttttataggtaatgaagcagttcaaaacttgaaagaaaacaaaacctgtcctcagaattctataaagtttattaagaatgttccttaaaggtttaagaagcagtaagcagtatctgaagccacaatctattataaatactttatttcaactagaaggtacaatctctcagaggtttcatagtttaaaaagctacaatcacatcatgttgtaactacataaaaaacagagctgtaaatggaactgcttggctttgaccatacacatttctgcacagcccttacagaatctgcacaaagaaatatctccctttgttccggttaattgttctggtatgtaagttgctttctattccagtatatccagagtggtgaaataacaaggccagccacatagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgcctaaagtgtaataaggtcataactgcatttatcatgaacactaaaaatgtacacattttagttagtgtgtattaaactgtaacaaggcttcgggcaattgtagatttagtttgacgctccccaaagtgcatgagacacatgctaaaattacaaattaaaattttgggtcagactttgccataatgctggactcaatttagctctctgaactagatggtaatttttttttaattcccactttggctgtgtacatcaaatgaaatgagaagtgtgtatgctgaccaaaccacaagaaactttctttaagttgtgttaaagaggaaagacctagaatccaagcatgttacatgaaaattgtaacagagcagctgcttccacctttcagatatggatgttggaaccacagcagaagttatagagcgacaacttacatacacacctagaatgtaagttaaacaaaataccggcttcgggagacccattttctccagccatattacattaggctagaagtaattaatgttgatttatttcatctacaagcagttggtccctaagtgacaggctccgcttcaaaaaaaaaagttggagaaaaattttcatgttcttctgtgaagcttatttggtacactggagccttttctaatctttctctggggggaacaggccgcagaactgtgttagaggtgaaccatcttaattactagttctattacctaattcagcttccttgtttggtctgctgtggatctgccttattgcatatgccatgcatcagataatggtgttagacaaagcttcattgtgaacaacctaatgcattttagagaaacaatctcatctacacattttttttctagcctttcctacatttaaacttgctgttgcctaaatcataattttttaaatgtctttggtgggcttctgttaattcacatgacttgagtttatagctgtgtctactgcacagattgggtaatggaacactaaacttttatacttgaaaatgacaggcttaaatgctcatatcagtcacaaatccaggatgtactgtcttgttgtatgtgagctttgtagagatttttaaaaatataagcatcaccttcacattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgctatttttagataaaattgaaaggaattgtataaatcaattaacatattagctaagttgtccaacacatgttataaatgaattacaacagtaaactattatacatttccaaaaaataaagatatattgcacaatgttcactgctatatagtgtacaatatcaaaaattggaaactaacttgtatgttataatttatgtcagttatgagtggtagaaaaaccattgtagctcttgtcaaaacctgcataggcagtctaaggtaaatataacacttgattttatcagggcccaggttccttctgtcttgtggccactgtatgagccgcaaccccaaggtggaagatggcagtatatgtttatacacagcaatgaggaagggagataggaaagcaaagtgtgtccctttaggaaagatcttggaatctgccatgccatatttctactacatcctgttactaagaacttaggaacatgattgcacctttattggtagtctttattctgggcagccatctgcctagcttaaaatgtggagggtccttaccatagaggaaacagagaatgaattttagcaaacaactagtggtttctgccacatgactaaatgaccaacagggaaacatattacaatacatcatacaattaacctctattcagttgttacagactcaagcaactctacatgaattggcatgtgaacttcttgcaaaacagggtgtttattatacagttttttaaaagtgtgcgaaaagcctgcatatgtccaccgaaagacatgtaaaaatgcttattcctttattatttgtaatatcccaaattttgaaatgccacaaatattcaccagaagtacaatggataagtaaagtgtagcatatttatctagtaaaataccataggttatgggaatgaacaaagtgttgccagatacaataatgtggatgactcctaatgttgcagcaaaagaagacaggcacagaacatataatttacaaccccacttacataaagtttaaaaacaagtaaaattaacctacagtgctagaaagcagaataaagtcaaggaatgctagtgtcaggaaaggagaaagcagcctcctgaggggcttctgaggggctgctaatgttctatttctagaactgggtattggtttttggggcatattcactgtgtaaaaattcagcaagttacatgctgtgatttgtgcaatttgttgtatggatattacacttcagtatgattgcagaagcctagattatctaactgaggtactgacagtaattctcaaaatggaaggtgggctctcatgcctggacagatgtcctcactgcaagctggcatgcagggaccaggtgagtggcttctggtcaccaagggcagctgtgtcacctggacatgagggcagaccccaggtgagagcatcagtaggacaacgctgtcttacttcctgcggttctgtgctggcagccacagaaattgatgcagacgcttccagcttcagtgcttgtgtttcttgctcactagctcagctggtctataataacaaagaaatgaatagtggggtgaagacatattccataggattcagactctacttacaagttctttatttaaaaagtgcactctgggccgggcgcggtggctcacgcctgtaatcccagcactttcggaggctgaggcaggaggatcacgaggtcaggagatcgagaccatcctggctaacacggtgaaaccccgtctctatttaaaatacaaaaaattagccgggcatggtggcacgtgcctgtggtcctagctactcgggaagctgaggaaggaaaatcacttgaacctgggaggtagagtgagccaagacagcgcctctgcactccagcctgggcaacagagtgagtctctgtctcaaaaaaaaagaaaaagaaaaaaatgcactctgtctggtccagaggttcccgtggttcttactcctggatcccatcacccctcctgtctctacacagacccccactccactcccagctggccgcctacccaagcaccactgcccttggcatccttggctaaagtggtgactgcatgggcaggtggagtctgacaagtcacagtgaccaccagcagtgggaggtcacttggcctcacctgtaattcatagccctgaccacaccctctggcatgtgagtttatccacaaggaacaaagctgagatgagacaatttcactacataacttgctcacgcggcatcccgtggtatgctagcattattaacactggaagttcttttgaagattttgaaagtttaattgtcatgagatttttccaaactaagttcatgatatggatttttaaattgtatctaatttaagtgacatttcaattcaaatctaaatctaaaactgatagacctaatgatttcaggtaattaattcttttttgtttttgtttttgttttgttttgttcaagatggactcttgctctgtcacccaggctggagtacagtggcacaatcttggctcactgcaacctctgcctcccaggttcaagtgattctcctgcctcagcctcctaagtagctgggactacagacacccaccaccaagcctggctaatttttgtatttttagtagagacaaggtttcaccatgttggccaggctggtctcaaactcctgacctcaggtgatccacctgccttggcctcccagagtgctgggattacaggggtgagccaccgggctggcctgattagcatcttttaaccgaataaaaacatcctatttaaaagaccaaatatattacttcatttgaaaattaaaatatagggttgggcatggtggctcacgcctgtaatcccagcactatgggaggccgagccaggtggatcacccgaggtcaggagttctcatgagatctggttgtttaaaggtgtgtagcatctccccgctctctctcttcctcctgctctggccatgtaagatgtgcctgcttccccttctgctatgattgttaagtttcctgaggcctccccagaaacagaagccggtacagcctgcagaactgtgagccaattaaacctgttggtttttttttttttttttttaaataaattacccagtctcatgtagttcttttttttttctgtcacccaggctggagtgcagtagcgcaatctcggctcgctgcaacctccatctcccaggttcaagcaattcttctgcttcagcctcccgagtagctgggattacaggcgcccaccaccacgcctggttaatttttgtatttttaatagagacggggtttcaccatgttggccaggctggtgtcaaactcctgacctcaggtgctccacccgcctcggtctcccaaactgctgagattacaggcgtcggccaccgcgcccggcctcaggtagttgtttatagcagtgcgagaatggactaatacacttggctatgaaaatgaaaacaatcacgaaggcagggtccctccccacctctccatatccctgtcttgtctggagctgctttgggtaacgctcagccgggaccagcacattacacaaggcaatgtccacgtgccgggatcagcaaggatgagctttctgtctggggtaagagtaaagactctaacccagcaccacctcgagggcttcaggctcactttctgttgcttgaagtccgcgatgtgctcaggaagtctgcactcctttgaggcctcagcaacagtgtccttgagctgagcttccagctacgaaacgaagacacacttgtcattaacacaaaggaagcacagccttaccagttagatcttccccaaaggacttgtaagagagcaagaccttaaaggacctttgtattttttcaccctttatcaaatcttatcacaaattaaagtttcagaaatacaccgcagggctcagctgaagtggttggttagtaataaaacaagtttaaattcgaatttaagttgatattttgagatgagatttcaagaaagggtactgatttgtgaaaacaagtacttctgatttctgtaaaacactgattcattttttaaatggacaatttcagacacacacacagaagaacaggagagagtaatgaatctcctgtgcctggcacccagctttgacagtgaggagaggactttttttttttttttttttttttttttttttagataagagtcttactctgtcgcccaggctggaatgcagtggtgtgatcttagctcactgcaacatccacctcctgggttcaagcgattcttatgcctcagcctccagtttagctgggattacaggctcacaccacctcgcccggctagtttttgtattttttttagtagagatggggtttcaccgtgttggccaggctaatctcaaactccacctcaggtgatccgcccacctcagcctcaccaagttgctgggattacaggcaagccaccgtagtcggctgacagtgagcagcttgagctgagcttgcttcatctctgcctacgcacaaactgcttgagaacaaatcccaggcaacgtatcactgcatccgatgtggaatggtaatccttagttaggggtttcattaacttgagttgtaactggctgcaactacaaatatatttaggttgcaaaataaactaagaagaaaacaaacagatatcctgtggctaaacagcaaagagccctgaacttgagcatgtactttcagaccttctcatttgtgggattcgttaagtaaattttaatagaatttttttgagacagattctcactctgtcgcccaggctggagtacagtggcacaatctcggctcactgcaacctccacctcccaggctcaagtgatcctcccactaagcctcctgagtacttcatgttagatgtgcatgccaccacacccagctaactttttgtatttttggtagagatggggtttcactatgttgcccagactggtcttgaactcctcagctcaatcgatcagcccacctcagcttcccaaagagctaggattagaggtgtgagccacagcccctggcctttaatcgaattttaaagtaagcattgcttaaaacatgtcactcatcaacagcagaacattcagaatacctagggcagcagttttcaaattgtgggctgagaaccttgggattctgagactttgtcagagaataaataccctctacttactgaaaagggaatttttaaaacctagcaccacaggaatctcttttaataattaattagctatctgtgggaaccaggagttcttcatgtacttcatccagaacagtgtatccaaacagattgagtgcacaaacagacatgagaacccgagcacgttctattaagccagatattaaagaaacattaaaaaatgtaaaaatgcggctgggtgcggtggctcacgcctgtaatcccaggactttgggaggctgaggagggcagatcacctgaggttgggagttcgagaccagcctggccaacatggtgaaaccccatctctactaaaaatacaaaaattagccgagaatggtggtgcatgtctgtaatcccagctactcaagaggctgaggcacgagaatcgcctgaacccgggaggtagaggctgcagtgagcggagattgtgccactgcactccagcctgggtgacagagcaagactccatcttaaaataaaataaaaaaaaatgcaaaaatgccattcttctcactagatttttaaagaaatagttacttttcattacaaactttacgttaacatgtaatgggtttttgttgtattgaaagaattctcagttttaatttctgccgtggtgcatattgagagctgtaatctacctaagtagaagctctttgggatccccagtaatttgcaagagtgtaaaggagtgcttaggccaagacgcttcagaagcactggtctaaagcaagtggcttgaagcgtcctagactacgatttgtctttctactgccattggctctttatggactgcaggtgctcttattcaattaagccgggccatatcacagctcagcataaataccctctacttacttaaaagggaattttaaaaacttaggaataggaacctcttttaatgatttcacaaatagatattgagggatgaacacaaaataaatgcttggcagatcaacttacttgggttcacataaaacttaagatgattttaaagtaatttacataatgcagcccaagttttcaaagatgttttattaaggtcatacaaaagtccagtcaataccatcgctgaaatatctaaatagcttcctcccccccttttttttttttgagacagagttttgctcttgttgcccaggctggagtgcagtggcatgatcttggctcactgcaacctccgcctcccaggttcaagcaattctcctgcttcagcctcccaagtagctaggattacaggcacccaataccatgcctggttaatttttgcatttttaatagagacagggtttcaccatgttggccaggctggtctcaaactcctgacctcaggccatccacccgcctcgacctcccaaagtgctgggattacaggcgtgagccaccgcatctggctaaacagcatcctctttctgagcttcttggatcttcagatctcctgccacatcatgtcagctttctgcatggctacttccatctcctcctccttgtcccacaccttctgcttctgggagtagagctctgccatgagctcattgagctccaagaactcctgcagggccagcttttgctgctgatgggcatctttcagttctttggcttgggatttcaatgtctctgaagcttcaaccaattgctgaaaaaaaaattacagatgttttatgtttgcttaacaaaggtctggaaggctggacatttagtttacactatattaaagagttacaagtgacagccaatgctggttacagattaaagccacagatgggagaaatcccctgcttggaaaaagccctgtgctcacctcaccccagccaaacattcaatgggaagaccacctgggctcaggtgctgagcaacaaccccacaccaagaaagaccctgcaactgcatggagtaacttacagcaggacagctggctctgtaatgccaacctctgcccgaggtcttctacacaattgcaaaggtgaataaagcatttgggcactcaatatagttacttaaacacaagaagaagcagaagcagaaaaaaatacatagacaaagtgctgaagatttaaatcaggccaggcactcatgcctgtcatcccagcactttgggaggctgaggtgggaggatcacttgagcccaggagttcaagaccagcgcctgggcaaaatagtgagacctcatctcttaaaaaaactaaaaaagaaagaaaagaaaattaagaagaaagagatttaaatcaaagactccctgggtggagggccacaagtaggacttaccacaagttcagctgcactgacaacccaaccttaccacttgctgcactgatgaccctgacctccctgcagctgatctggccaacagtctggctgtttagtcactgtcacacttgctggactaagactggaagtgacgagacctggagcaagctggcagggcggctcccacatggggagaaaaggcctccccaggcctctctgggtccagctcagagtcactgtgactgtgtcaagcaatgagacgctgcccagcccacactgcactcccagacaagtcatgcagggggatgatactacagattatcttaagaagcaatttgggcttaaaatctgccccattttagaggacagatcacaaactacaggtccaaggacttcagtgtataaatgaatgtattttagaaaacagagcctatgcagtgagctgagatcgcatgactgcagcctggtgacagagagagactctgtctcaaaaaaaaaaaaaagaaaaaaagaaaagaaaaaagaacctaattgtgttattactatacttaatggcatttgaatataaagttcacatatcttactaaaaaccaaatttataaaggagttatgggggaatcagccacattttaacatatgtcctcttttgcagttccctgtccttactaagatgccccttctaagagcagggggcatggtgtagagagaaggacgaggtcactggtgtcaggcgcagcgtgtcactgcagataacacagtgccctctggacatcgttcctcattcagaatgggcggggctgggggagttgctgcttactccgcggggttgaactggagatggcagatgatgactgtgaagtgggtgcctgctgcaggcagcatgctgaaaggcacccatggcagggagccaagcccagctagctgacatgggctgtgtagcaactgggcacagcaggggccctagaaccaggcttggccctgttgtcctgcgtgcagcagggacagtccatgagcaggagtcccaaggaggtctttaaacatctgtatgaacagaatcttacaaaactctgcaaagcctcttaagcctttctcacccagaaccgaactgcctaccttgtgcatgtcctccttctcctgccacaccatgcggtgctgcttctctggcccccgtagctgctgtgtgaaatcttgttgaggcgccgccttgtcctcaagttgtcactcaagcctgtttgaatatgagcaaaagaggaaataatttgtgttactttctgtgtagcaactatatgtaaatgttgttagctgacttattgaaatgatttaataattcacaggactctttttattgctgtatactaaataaaatacacaaggcagcaatacttaggggccagaaacactgtttactacaagtcaattatggaatcatagcttacagtaaaaatgggcatgtccaaggctcaatttttcttttgtcatttacagtagaataaatagtttgttgctaattttctacactgtctactgggaatatgtgttacttttataatcagaaaaataaatattgcagccatgtagcatataatgatgtttcggtcaacaacagacagcatatatataacagtggtcccataaagttataataccatatttttcccgtagcttttctgtgtttagatacataaatccttgctgtacaggtctgtagccaaggggcaatatgctataccatgtggtctaggtgtgcagtaggctgcaccaccttggttggtctaagaacactctgtgatgttctcacatcaacgaaattacctgatgatgcattgtcgagaacgtatcccagccgctgaaggacgcgtggctggactgaagagcaccgtgtgatgtgggctacagctgagttctgtgcatgatgtggttggagccttgaggaagggggactatggactgaatggtgtccccccccaccaatattagacgctgaagctctaatccccaatgtgactgtagttggggacagggcctataaggagatgatgaaggttaagtgaggtcataagggtgggccctgatccaacaggattcgtgtccttataagagaccagagagcttgggtgctacctccccatgggaggacatggtgagaaggtggctgtgtgcaaaccaggaagagaggcctctggggcttttagcctccagaactgtgagaaaataaaaccctgctgtttaagccactcagtcagtggtattttttagggtgcctggggctaatacagaaggattcaccctcctggggagaaggggccagtggcctcctctgattttcccggctgtctgcagaactccgtccctgcccctcctccttttgccaaagcatcttgctaagggaagacctgattgcattgttcagaggtccccaaaggccacagaaaagtctcaactcctggacctcatgagtcccatcccactgggggagctccctctctcttctctgctctcctctcaggagggaaagttaagggcctgcttggccaccctccagggagatgccatggtgggatgctgcatcctggtgatgagctgggggtaagccagcatgtctcctccagggcttttcccagaactgaatacacactaagatgatctttagggatggaagaatcaaactgggaagaatcacacacctgtagtcccaccctacaaggaaggctgaggctgggggatcacttgagcccaggaatttgagtccagcctggtcaacatagtgagaaccagtgtcaaaaaataaataaataaaaaggaagaatcaggtgactgttccaaactcctccaaaatgggtattgggtcccgactctgctcttcccgggacaggggtgtgccttcccctttcctgttgtccataaacccactccctctcactaaagaaataagaaaaagtgttcacagcactttgagttatgcgaggtgtgcagaatttatcaggcccagagagacaggaatatggacttcagtcacacgccttgtactcatgccctggggtgactgtttaaaggcattttgttcctgactagctcaacccattatcttcctgttcctggaatttgtgataccaaagacaatgtagacaatgtagagacaataaatagctttttttttttttgagacagagtctcgctgtgttgcccaggctggagtgcagtggtgctatctcggctcactgcaagctccacctcccgggttcatgccatcctcctgcctcggcatccagagtagctgggactgcaggcacccgccgccacgcccggctaattttttgtatttttagtagagacggggttttaccgtgttagccaggatggtctcgatctcctgacctcgtgatccgcctgccttggcctccctaagtgctgggattacaggcatgagccaccgcgcccagtcttcttcttcttttttttttttttttttttttgagatggagtttcactctattgcccaggctggagtgcaatggtgtgatcttgactcactgcaaactccgcctcccgggttcaagtgattatcctacctcagcctcccaagtagctgggactataggtgctcaccaccatgcctggctaatttttgtatttttagtagaggaagggtttcatcatgttggccagactggtcttgaactcctgacctcaagtgatcctcccaccttggcctcccaaagtgctgggattacaggtgtgagccaccacgcctgacccaataaatagcttacgttattttcatataaattcctcaggctaggccagccaaggtgggaggatcccttcaggtcaggagttcaagactagcctggacaacacagcaagacttcttctctaatttcaaattcttggtaaacaacttaggaactgcctcttcttttcctttataaaacccacttataactgctgccaatatattaagacaacttgcatctccagggttgcacttctcaaacttggcccaaataaactctatttttttttcaagatggagtttcgctctgtcgcccaggcttgagtgcagtggcgtgatctcagctcactgcaacctctgcctcccaggttcaagggattctcctgcctcagcctcctgagtagctgggattacaggcatgcgccaccgtgccttgctaattttattttatttttttgtattttttgtaaaaacgggcaaggtgggtctcaccacgttgcccaggctggtcttgaactcctgacctgaagcagtcctcctgccatggcctcccaaagcattggaattacaggcatgagctggtgtgcctgacccaacgtctccacttacgttaattttgcctcctttcttccttttttttttttttttttttttttttgaaacggagtatggctctgttgcccaggctggagtgtgcagtggcccaatctcggctcactgcaacaactgcctcccagtttcaagcgattctcctacctcagcctcccgtgtagctgggattacaggtgcctaccaccagccagggtaatttttgtatttttagtagagacgggttttcaccatattggccaggctggtcttgggaactcttgacctcaggtgatccacccgcctcggcctcccaaagtgctgggattgcgggcgttagccatcgcgcccggcccgttttctccttttgggtcacaaaagtgattgaatcctgccacttcccaggtgctgggtgggaacagggaagagggggataattgcggtgctgctgtgacttgggtagatggcggcaaggcctctcagaggtggccttgtttgcaaagatctgaattaggcagggagaggggcaggcctggggcaatcagggaggggcagtggcacactgggagcaaggcaatgttccgcgacccacagaggcagcgcagtagctgttccaaccctggtcagaagacaccccggaaatgcctcagcaaccgcgcagcctttgatgacccccgctgccttcccgccaatcctacatccaatcagagagcgtccccagtacacatgttgagcaatggccaatcagaactgggatccggccctcagcccgcctcccaggaactccgagccaatggcggcctggcaccggcgggccaatcccgtgcggcgcgcacaggcaggaggttgcagttgggcgctcagcagctgtggcagccggttgaggtctggcagtagcgttgggctgaagcagcggagttcgccatggtaaggcccgggtcactcccgccccgcagatgcccaggcagacgaagttggcctcgggtggacagagggacgttgttgcgggcctgggcgctgagaggaggccagagaaggacgcagggtctagtgcgggacaggaggacacgggatcgtttcctggatctttgggtcccagggcagggacggcggcttttgttttagatgaagctgccggcctttagtgaacgggaccattgacggtgtcccgtcccccagagagcaaatagtggcgtcgcctcctgaagacgggagggcgctgctcccgcttcacacgtctttgtgctactcgaaacaactgaggagccccaggagccttcggtgacgggggttggggctgtggacattgatcagatgaggaattaaggctcagacgctgctgcaacattgccttgttcacctaaaggcaaccgttaggccaggcgcggcggctcacgcctggaatcccagcccttggggaggtggaggcgggcggatcacctgatgtctggagttcaagatcagcccgaccaacatggcgaaacccagtctctacaaaaaaatacaaaaattacccgggcatggtgatgcgagtctgtggttccagctactcgggaggctgaggtgggaggatcagccgagcctggaactttgaggctgcagtgagtcgtgatggcgccagtgcactccagcctgggccacagagaccctgcctcaaagacacaaacaaaaaaagcagcccattaacataacagattcccaagtcccaagtctgaatagctgtggtttgtcagttatcctttttttcctttctttttctttcttttttttttttgagacagcactcaacaaatgctgtgttgcccaggctggagcacagttgcaggatcacggctccctgcagccttgaacccctggcttccagcagccctcccacctcagccttccgagtagctggtactacaggtgtgtgccaccacacctggctaatttgtagatttttcatagggacagggactcactatgttacccaggctggtctcaaactggtcccaagtgatcctctcacctcagccttctaaagtgctgggattataggaatgagccaccacacccagcttggcagggtttaaagaaaccaccaaaggacagtgcagtgtcccagcactaatgacgtctgggagccattacaggcttcaaggggtagagagagggagtggttacaagaaattgggagggtagttttatgaagagggcagcctgccaaaagtgtggccttgagagggattcaggtcacccacagcagttgagcaggaaggggccaaggagggagtaccctggcactgctttctccagccccccagtatcccactgctgcctgccattgaccaaaccagcaagaagccagagggcgaggaaggcctctgatgctgttctcaagggtcagccttcgagagcacagagcaggtggtgaatgatggacggggtagaactggggggtagagagaggacacacactgagcacctgggcttggaccatggtgacctgggacctactctgtatttccttacccaacccgactaccttatcctttgatcaggacataatcaaaaactgctacatattcttcagagaattactgtgacgggctataatgtggggttgattattgacattacatggcttccaagttttaaaataacctaagttttgtgtagtggcaaacaggttctagggctacctctagaacttactagctagtatggtttacagcaattagttttcacagcgataaagggatcagtcactaaccctcctaggaaatatcgattgtgaaagcgccagatactgaagcagtatataaatattaaattagaatattttgcatgccatatagtttcaagttgccttgaaatgaatgggttcacttttatgttcctgttcacagcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcggtaggtgcctgggcactggatggcagctttcctgagagggtgggagagcattggtaaagccccgtgtgggctcctttgaatcctcctgctgaaaggatgggatagacaggcatatgcccatggcattgttaggagagaaactgaaaggttcgtgatcaaagtgtctgtgagactcggctcctaatttaggaaaacctgacctacagggaaaagctgctttgccagcagtaagatgggctgtgaagagattccctcgtgcgtgcctcagccctgctcaggtggccctgcctgcagggtgcagtggcattggttccctcccgaatgctgtgcattctcttatgctggtgcactagagtcttgacctgcatcttaggcatagaaggtaagtacagaacagtcatttgcttccttcagattcgcagcctgatgtagtttccaaggagagctacaaagaggcagcacctttcagtggccccccaggagatgacagcatcacctgaaagcctgtgggacccaggtcatccagggtgccctgatgggactgccctgcagaagtcacactgacctggtgactgcccaggttgtaagagtttctaacttacagcctttgatgtagctacacgtaggaaagaattatgtacctgcgtaggagtgccagagcttatttcctttcactgggaactggttgtgctgacatttatacaacaagctgagtttaactttgtagagtcataaattgcatatgcagtttggttatcacacagagacattttctaccagacactgccactgttgacctatgacatgtaggtcatgtactttgaacagcatgtgctctgtagaagtgaacactcctggaatgtgtccatcttggtgagtacaggccttaaaaattcacagcacacactgtctcttttgcagatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggtaagaagagaaggtttcatgtggccattttcttgcatgggaggggtagttcttggaatgtgaaagggaagtcattttatcaacacttagaccagcatcttggccgggcgcggtggctcacacatgtaatcccagcactttgggaggctaaagcgggtggattacctgaggtcaggagtttgagaccagcctggcctacatggtgaaactctatgtctactaaaaatacaaaaattagctgggtgtgggggcacacacctgtactcccagctacttgagaggctgaggcaggagaattgcttgaacccggaaggcggaggttgcaatgagctgagattgcactactgcactctagcctgggaaacagagcaagattccgtctcaaacaaacaagcaaaaacttagaccagcatcttgagtcctactgagtctgcagtggtgatttgtccgtagatctttgcttttctttgcttcaaagtgtactgcatgtttattatggatgatttgaatccatatcaactctttagaggcaaagagaagcggccctggcttgttggaggttggtggtgtggcttccatgggcattggctcacgttgtgtggtttctctcaggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcagctgtctgtggccgagatcaccaatgcctgcttcgagccagccaatcaaatggtcaagtgtgaccctcgccacggcaagtacatggcctgctgcatgttgtacaggggggacgtggtccccaaagacgtcaacgcggccatcgccaccatcaagaccaagcgcaccatccagtttgtggattggtgcccgactggatttaaggtatgactgggtgatgtggaggcctttcagcaagcagcagatgcacaaaataacactggccctgaaggcccacatcctttggggagattatccctgttccatgggctaggcatgtgggcataaattagtgaaccagagttgataattgattcagtgatttctttttttttttttgagacagtcttgctctgtcaaccaggctggagtgcagtggtgcgatctcagctaactgcaacctctgcctcccgggttcaaacaattctctggcctcaccctcccaagtagctgggattacaggtacccgctaccacgcccggctaatttttgtatttttagtagagatggggtttcgccatgttggccaggttggtcttgaactcctgacctcaggtgatctgcctgcctcagcctcccaaagtgctgggattacagtcgtgagccactgcacctagctcagtgatgtcttttgaactctctgtctgagtcatcacactatatatctgtggtgagctttatttatttatttatttattttttgagacagggtcttgctttgtcccccaggctgtagtatagtagtgtgatcttggctcactgcaacctctgcctcccaggctccagcgattctctcacctcagcctcccaagcagctgggaccatagacatgcaacaccatgcccgggtaattttttttttttttttttgagacagagtcttgctctgtcgcccgggttggaatgcagtggcgtgatcttgactcactgcaacctccacctcccgggctcaagcagttctctgcctcagcctcccaagtagctgggattacaggcacctgccaccacgcctggctaatttttgtatttttagtagagatgggattttgccatgttggccaggctggtctcgaactcctggcctcaggtgatccacccgccttagcctcccaagtgctggattacaggcacgagccactgcacccagctaatatttgtatttttagtagagatggggtttcgccatgttggccaggctggtctcaaacccctggcctcacgtgatctgcccacctgtctcccaaagtgctggggtcacaggcttgagccaccacacctggcctgatgttgtcatttatagaacaagtttgctgatccctgctctagttgaccctgtgcactgcggccaggacctcaggtcatgttatgcccgagttctgaaacttggaatgcttcccctttggttaccaccttggaatgtcaccccctacttaggcaggcacatggaccacttcgaccacttcctgctgctgtggtagcagcattcatatgacccttgacccatgatctgctacctttgcatatccacagtggcttgttctgtgggtcagaagtgggtatgatgttccttgtgatagcatggggaagagttgtgtactctgaatctatctgggtggaagaagtttagctacagaatttaattgtaatctacaaagaagacaagcagcatacattttcagagggaagactgtcttcacctgggcacctatcacatgtcacaggtactaggacacagccctttaggtagcttgggatcccaccagggtggctacctccaaggttcctttctctattcctcatctggaactatcaccctgcctggtgcagagaagggcttagtgacgtttgtgaggtgaactgagcattctccgtgtcacctacagggtgtcttctgtttgaggaaaagtagctaccatttctaggtttgatataagcttcatggactgctttctttcccttctctggcaggtgggcattaactaccagccccccacagtggtccccgggggagacctggccaaggtgcagcgggccgtgtgcatgctgagcaacaccacggccattgcggaggcctgggcccgcctggaccataagttcgatctcatgtatgccaagcgggcctttgtgcactggtacgtgggcgaaggcatggaagagggagagttctctgaggcccgcgaggacctggcagctctagagaaggattatgaagaggtgggcgtggattccgtggaagctgaggctgaagaaggcgaagaatactgaggggagggtgtggtgggttctcccctgccacccccgggatggctgcttccaagttgtttgcaattaaaggttctgtataaaaccaagccctctgtgtgtcgtgcagcttagctctgcctacaggagccggtgggaccctagagcctgcatggacagcggtggggtgccagcctgccctgctgctggtgtggggttgggtgcagcaggactgtacataagcagctgccacagaagtaacctgaccaggggaaaatagtgtttcttcaaagccaggtgttcaatgtatagatttcctaaattctaggaaagcagagtcagggttttcaactgaatctgtgatttttcgggcttctttattgatgggtcatgctggctaaaagggagactagaagtgttggaggtctgtggatggggcttgtccatgaagtctctaaagctgtgggtcaaatgtgtaaggtcaggacattttagagggggaaagagtattaaccgagttctgcacagcattcgtgacccacagaaggtcacaacacacccatgctgaccccagtgctccacagtaacctggaaggcagcgttcgccctctgtgcgtacacacagcaaccctgtccctcagcactgtcaactgtcttggtagaaaacctcccatgaggtgggagatcgagaccatcctagctaacatggtgaaaccccgtctctactaaaaatacaacaaaactagccgggtgtggtggtgggcactgtaggcccagctacttgggaggctgaggcaggagaatggcgcgaacccaggaggcggagcttgtagtgagccaagatcgcactactgcactccagcttgggtaacagagcaagactccgtttcagaaaacaaacaaacaaacaaacaaaaaacctcccacatttcactccaagtgaagcttgttgatgtctatttataaaagacctggcaatccagacacctttcctcagaacccaaatcaggttcaggaagttgacccatggtgaagggacctggttagttcactgtggcacaaccaggaccggcacagaaacttcattctaagtgtgccttaatataaaaaaaaaaaaaaaacagtagagagcatctgacctggaccctctgcatctcagaaaggtttattatcaactgaaggaggtaacatgtagcctttgctggggacaaagatgtgacaagtctctgccccatcctaggtgctgccctgcgtagggctcttcccaggcccgccccccttgggcagcctggtagcgctgggctggcgtggcatcctctggctggatccctcgtggttgctgcgttccgccagggccaatactcccccgagggcagcgctgcctttgtctctccctaaggagacacaaagcacaatgattaggaatggacgcgccccataaatgcagcacctgctgtactcgtgctccttgggcaacatttgtgtctacacatttccatcaaagtcgcttcagctagaggccctgcatcagccccaagtcctgagactcagaaccactaaagacaggtcacgccccagaagcccttggcagtgtgcaggggaccctttaggatgtgtcctaggagcgaagccacgcaaggagcacactgccaagggaacattttgaaaggacacatgccacgggcccatttagggaaaggtaggtgtggtggtccacacctagcctggtcagcaaacctagtctgccctgatcgtgccatcagcggcagcagcagcagcagggacgcgctgcctcatcctcaaggtgtgttcacgctggactgcacatctgagctgccccagatggtgacaggcaggaagtactgcagtcaccaagtcctggaattgggtttctgattttgattttggaagctctttcattgtttcctacctacccgagtgttctgcagtggtcaagcctcttgctttcgggtttagctgccagattccatgacagggttcctgccacagtctgaacgcttgagactttccttctgaacaccagaggctctctcggatgaagaccacaggttcagagtttctttgatttgtaatttgcttactttactctttaagatagccaagaaaaatctgcaaccacactcgggccagagctttattttaatgggatgcatttccctgggctcagggtgttgacagcatcggcaagactgagaggaccctccaaggtacaaacgtgcccgggtagcaggcttgcccgtggggtcacagccccccatgcggagtgccttggccagggctctcccctgctctggcctggtggggtctgacccgtgggctctaaacagggcgtgtgtcccctgcctgactcagtgttgggtcccccatttcatccccccagcatttcctttgtcctgactgagggagtgccttgaccactctgacctaatcagctacatgttccccctgcaggctcaaaccctggctggggcttgcatgttcccagacactgatacacgtttaggttgttgcctggaacactgaaagatctgacgtgttgctaagcacgtggaaactggtcccaccccagccaaattccttgcaccctcatagaaactccacaccccaccccctcagtgcggtgtgcctaggcacaacctctttcctggctgtccctcgtgagggcacgctgcagccccctctgtatataagctccctaacaaatgctttggactgaccaccctggcattaagtgtttcttcctttggaatcccaactggctctcatcttggaaaggtttggggcagtcccgtgtgggaactcccctgccatcacttttagggtgactccagacaagggttcagccaacagaacacccagcctcaatcctggtccttccctggcctcttatcaagtgtagtcaaataccctgcaaagggaaactggattcctggagaaaagatgcaaccgggtgtctagggacccattaggtcatttgtttcaccatctgtcaccctgaacaagcagagactcctgtgtctgagatgccgtggacccccgctcttccagaggtacctccagctccctttctatgctaataccacaaaattctccccataccctgcagggataggacggccctccttatgagtttccggggagttcttcctcagagaatgagatctttgctcattcttgcctggtggtggtgagggttacagcggtgtcatgctgggaactctgtcagcttgtcacacttggctgaacaaagatggagtcagggttgccctgagccaaggaggagcgcagtcaggaacacgtggtgggtgatgattggccacctcagcccagcagtgactagtgaaaaaggcacaaagcagacaatagccaccacgcatctcttgtggtacaaactgccataattctagtccccactgactggtcaaggggcaaggattctgtcttccatgagcagacgggacccaccaccctgcagcagctcccacactgggccagcatcctcctctgaggccacagtccctctgcaggccaggccagacagtcagatcttctgtagccgcagcctaatctgggtgcttaggtgcccatgcgctctcagctccccacagcacgcagcatggcaggccgtgcacctaggcctgactcagagtcggcttcccttcagtttgccgccatctgagcttcctctcctcccctcagtagtgacccagtcccttctggaaacaaggatgacagcgaagcagaaaagagcaaataatgctttttttttttttaagagtggtgggggaggggggtttagagactgagtcttgctctgtcacctggtctagagcacagtgatgcaatcacagttcattgctgcccggaacccatggcctcgagggatcttcctgcctcagcctcgatgtagctgggactacaagcatggggccacacctggctaataatgcttatctttaaatctgacagggttgacaaaccctggaaatgtgaaaccaacataaccgtaagccataactgatattaagaaaatcctggaaatcttcaggaattgcgtgctctcggggctagtggggagccctgttcaggcctcctcactttatgaaggatgagaaggcccagaatagaatggcctgcagtgccttgcagtggggaaaccagctttgcttagccctgctccctcgggaggggctactgagtcagacgggctagacagtgggattgaaccaagtgtggctgcaggttggggtgtgagggcagggtgactgatgcccctacacctggtccctggagggccctcctaaacgccaaaaacagtcaatgaccactgaatgttaaaaacagcctggctcagcaggggtcagtggctcgtgcctgtaattccagtgctttgggaggccaaggtgggaggatcctttgaggccaggagctagagaccagctgggacaacatagtgagacctccatctccacaaaaaatttaaaaattagccaggtgtggtagtgtgcacctgtagtcccagctactcaagaggaggtgggaggattgcctgagcccacgaggttgaggctgcagtgagctatgagtgtgccactgcactccagcctgggtgacagagcaagactgtctcaaaaataaataaataaataaaaagtaaaagaaaatgcacaattagctcaaatactttaattaatctaaaatatccaacgtattatttcaatatgtagtcagtacataaattattcataagatgttgcattcacctttgttctttttcttgtttctttgtagaaatgggtggggtcttgctatgttgcccaggctggtctcaaactccgagcttcaagtgatgctcctgcctcagcctccaaaaatgttgggattacaggtgtgaaccaatgcccagcctcattcactttggggttttttgtttatttttgagacagggtctcactctctcacccaggctggagtgcagtggtgcagtcacagctcactgcaacctcaacctcccaggctcaagcaatcctccaacctcagcctcccaagtagttggaactacagatgtgtgccaccatgccctgctaatttttgtatgttttgtagagattgggtctccctgtgttgccctggctagtcctgaactgctgagctcaagagatccagcagcctcggcctcccaaggtgtggtgggttttttgcattcccttttgtaccggtcctttggcatctgctgcgcataccacacgcagtgcaatgaccacgccagccatgtgtggctcgaagttcctgtatcaggcagcacagctcaggtgagactcacggcttccacactccaaacgtcatcttacacgcatgctctggacaacttttaaaacgtatagtttccctaaacttaaatataacgcttgactgaatttatttttccctcaatgactccagactctcaccaagacaagcatcgaccctctgtgcttctggggttttctatttccccttccctgtgggtatgagtgaatctggtggtggttgttcccacaggccgtctgcatggctgggggacaggcatccagaggacccagggtgcctgctgcagctcacagaggcaagctcgagagggcctggcccatagcctggagaactcaacacccgagtcctgtgggaaacctatggcctccatgcccctccccccggattactccgacaacccccctgccatatggggtgacagaatcctccaccccagattctgccattaccagggcagctggagctctgtgtggtcagaagctgtaatatgtgggcctcagagagctctcagcattccatctgtggcctctgcctctcactcagcagcacacgtctgccccattcccctccacctcctcctcaggttccactctatccccatggggcctcggtgccctcatgtcgtggctttctgccacccagcctacaggacctgggctatgcttccaggacacagccctcgagaaacaaatgaccctgaggggcccagcactccaggccactcctgtcctcgggtaaattctcttggagcccccattcgctcacatggcaccccctaatcctcctggcccctctatgcctgcatttccagtgccacaacccccacatacatcttgactgtgcccccccacctgcctcctcctgccctgggcctaccagcacctggacagcgctctgcctctcccatgccctcccactgccccagctcacacgtgtggggctctgctgacccttcctgctccaccctgtgtaacccttgctgctctctgggctctgaagcctcctcccaactccattgctagtggtttttcttttcctttcttttctttttttttttttgagacagggtcttgctctgttgcccaggctggagtccagtcacaagctcttggctcactgcaacatccccctcaggctcaggcaatcctcccacctcagcctcccaagtagctgggaatacagatgggcgccaccaccacgcccacctggctagttttttttttttttgagatggagtctcgctctgtcacccaggctggagtgcagtggcgcaatcttggctcactgtaagctccacctcccaggttcacgccattctcctgcctcagcctcccaagtagctgggactaaaggcacctgccaccatgcctggctaattttttttttgtatttttagtagagatggggtttcaccgtgttagccaggatggtctcgatctcctgagctcgagatccgcccgcctcagcctcccaaagtgctgggattacaggcgtgagccaccgcgccgggccctgcctggctagtttttgtattttttgtagagatggggtcttgctatgttgcccaggctgatcttgaactcctgagctcaaggaatccacctgccttgacttcccgaagtgctgggattacaggtgtgagccagcacactggtctcactggtggttttcctcactgcctctcactggactgagtgtgatcatctcacttccctgccacgccctctgccctgagagctaggcctggcacccagagccctgagtgagtgctaagtgagcagcaacatctcctggagtgacaagaactctgttcccagtttctccctcctgctggacacttgcccctcaattgctcatctcagcctgcagtccatacacccctactccaggcctgtccttcaggccctctccaccctctcttgggcctgagctctgggtggcagtgaggtggccgctgtcaggaggctcatgcaggaggcgcgaccaaagacccctgggctctcacaggcccctgatcacacctggtgacacctggaaagtgtcccaactcaggagtgaggcgggcaagggggctgagtgctggagtgtggccatgggaccagcacatggcatctgtgtggcactgcctggcagactctgggaaggtgggagtctctgtttcagcctccagacttcctgtccaggtaggggacaacttctaagaggccgaggcgtttgtcacgcctggggctgtgctctccagcagagcacactgcacccggctggctgtcttcccctggagaggggctctttacactcaccactagttcgcctctggggtgtggggatgttggtcctgtccccggatgccagcccgactgtggggtctagagactgccacaccatgtctctaataaaccgagtcagaaatagtgccctgtggctaagcggcagggcagcggtggcctgcatgatcctgcccttgcagctcaaagctgcttgggcctcttggggccatgcagtttccatgaaaacaaggaagagcaccaacccccagagataagccaataaacgcaacctgcaaaaggagagaacaggcagcaagagaggcggagggaacccggggggcctggagagagaggtgagtgtgtggcagctgggctgtggagcataaccagagaggccgcaggctgcgggctggaggaaaacgagggccttgcaggggggctactgttcctggcagagagaaaggaggcctctggaggtcagagagagacacaaagagagcagacagagcgagggtcagtgaagaggccagcacgcaggtgcccgggccctcttgggtcagcgggcgtgggtgcccaggccctggcacttcccccatgaaggcagcctgctttccacgccttctcatgatgcctgtgagggtctcctcctgcttccaggcagggagccagctctgggcctccttccattggcctgggaggttgtgctgcatttcagagagagccatcgggagcagaagcaacatgcggagaggatgagcagggacggaggctccaccatgacactctcagtcccagcatctcctcagcccagtcaccacactggagagggaggaggcccttcagaccccgcaggcctctgcaccctgggagttccgcgtctaactctcttcctgcaatcatcagaggcaggaactgggcccaggtggggtaaaggcaggaagacgtctgcctgccctgctccctgggcacttccctggatgctgtataccacaggacagagatcgagactgtcttttgaaaaacatttagagacaggatctcaccctgtcacccagactggtctcaaactcatggcctcaaaggatcctcccgccgtggggtcccaaagattataggcgtgagccacggcgcccagccccaaaccgtcttgattcccgactttgtaggatgaaggcctgagtgaagaggtggggaggagctaagcggaggagccctacccagcctggaccaccctggggcacgcactctgcgtccacctgacctggacgtgcctcctaaggctggcagcgaagcccaggagcagagcccacggatgggccctgcaggtgctgggcctagaccgaccgacagacaggcctggccactcagggccacgccgccgctgtgccgcgcctgccccctccccgcccgccacccccgccactggggcagggacagcgggcccagctctgacctcgggtctcgggcacgctcgacgtgggcagagacacggccgcagggtcctggggctcgctcgctagcctctgcccggcacacatggacttgagcatctggaagacggcgaggggggccacgttcagcttcagcaggtccaccaggatcctggcggggacagacgcggggccggtgagccctctccgcccggcgcggccacctccctgaagaccggacaaggacgggggcgggggcagcgggggctcctcccgaccagcgggccgggcgtacccggagagcagaggtcgggggtgtctggcgagcatgcggcccccacccgccccgctcacttgaacacgtcggggtcgataccgccgcccgccgcctgagccagctcgtacagctccatctcctcggtgctcagcaccttcttgcgccgcagcgccagcttctgccgggccgcctccagccccgggggcgccgccgaccccggcccaggccctacgccctgcgccgccatccgcgaggcccgccgaaaggtgcgccccgccccgccgcgccccctagcggatgcgcccaccgccctctccctgcagcgccagcgtctggcctcccgggctgccctggcgggagcggcgggagcgcggggacggggccgcctcctcggcgtcattggagcccaacagttagtgggcgctcacggtgtgctgagcggcgcgctaggcgtcgggagtggcatggcggactgcaggggccagctgcttggcggtcagggcgtccctgatagacttgcattggtcgtgctcgcttaggtggcagcacccagcccagtgccaggcatacattgggcgctcagtcaatacctgtttcaagaaagcgtgcaattttctggtccgcaccggtgcaccactaggggtcgctcttcggggggggtggggggcactaatcaacaaccctgcttacgcgcacgcgcattccttgctagggagaaagtgcgtgagccctaccttggggcgccagaggccgccacaacgcaggcgcattcagctaaggaccactccctccccccgcactcctgcctcgccatttcccctccctggccggccggccggccttcttcgctttgcgcacgtaccttttgaggtaacggcccaaagaggtagaagcgcttttcccgcccggccgcggggcgtggctctgcgcgcagcttgatgacgacgttttggcgcggtggcggaatggcggcttccacctctgaagcgggcgacgctatgggtcccacaggtgagtggcgcgggacgcgcgcgtgagacggtccgacgccctgggggcttccgcgagcccctgcggaggccatctccgttcctccgcgagccccaggactcgggcggcccggcggctctgcccaggccgggcaggctggggagtggagggccccggctgagtcttcctgccactcctctgggccatgcctttgtgccaccttcccgcgccgctcgtacactctgttctggtccggtaggtgttcgttgaaggttacccgtcgttgaaggaattgagggaaggagagctttgtgttgaaattgagccttgggctcaacaggcggtgtgggaggaagagccgggtgtgggtcccagctcgacccttcccctgtgcgctccacatctccgagccttggtttcggaggctcccgaagcccaattcgcaggagagttggaaacaagtgggcgcgtgctgttaagggaggtcttggcatgacagaatttgcttggaatgattagcgttgcccaagggctgtcgctgtcagaaaaacaaaacaaaacgaaacaaaaaaaacaaacgggtccgaagcagctcctggagaaaataggtgttggagagtcgcgacgaagtggactctaggtgcatggcacgcagagacctgtgacgggggagggtggccatggcagggtcagagaacaggggtgtgggagacacctcttgggagttctcgggtttgaatttcctctcttggaaagttcctagaaattcctctgggcctcattctttcagtcgctgcccatgaaagcttttactgagcagagatgctctccccttcatcatctctagagctccgcacttatccagcagtccacagtttaatgctgctttgatcattttgcagtagtgcagtgttttcttgaccaagtgcattaggactgaggcgtttttctttaacactgcaattgatagctaggttaagaattgaggccgggcgcggtggctcacgcctgtaatcccagcactttgggaggcccaggcgggtggatcacgaggtcacgagttcaagaccagcttggccaagatggtgaaacctcgtctctagtagaaaatacaaaaattagccgggcgtggtagcgggcgcgtgtaatcccagccacttgggaggctgaggcagagaattgcttgcacccgggaggcggaggttgcagtgagctgagatggcgccactgcactccagcctgtgcgacagagcgcagagcgagactccgtctcaaaaaaaaaaaaggaaaagagaaagctggccgggcgcggtggctcacgcctgtaatcccagcactttgggaggctgaggcgggcttatcacgaagtcaggatatctagaccatcctggctaacatgtgaaacccactctactaagtaaatacaaaagacaattagccgggcgtggtggccggcgcctgtagtcccagctactcgggaggctgaggcaggagaatggcgtgaacccaagcggagcttgcagtgagccaagatagcaccactggactccagcctgggcgacagagtgagactccgtctcaaaaaaaaaaaaaaaaaaaattgaaaaaacttgggagatgttcctattgccaagtggcagagaggcagagattcctgtctcctctcactctacaactgcctacatggcctctttacacccagcctctcttcctccacagactgccaggtgccaccccagtgccgttacttgtgcagtgggcagagctgggccaggaaaactgtaactaggccaccagtgggacttggcagacttcctgtctgtgaagtctaggtctgagcattttttatttttgacctgggtgagctgagaggtaggaatctggaaagctgatcttagttttctttcctttttttcttccattttttgagacagagtttccctctgtcaccccggctggagtgcaatggtgtgatctttgctcactgcaacctccacctcctgggctcaagcatttctcatgcctcagcctcccgagtcgctgggactacaggtgcccgccaccacacccagctaatttttgtatttttagtagagatggggttttgccttgttggctacactggtctcgaactcctggcctcaagtgatctgcccaccgtggcctcccaaagtgctgggattacaggtgtgagccatggcgcccggcctttgatcctagttttctgatggcttattcaaaggctcccttggcagagcttgctcttcccctccgttcattgcatagtgcacgggtaatatggaggggatttgcccctgtctcagttttgtgaggcggtctttgtattggaatcttggttctgccacttactagctgggtgggggtaagtgagttatcccatttctgcctctccttcatcatctgtactgacttgcagtcatagtacatctgtacccatcgggttgttgtgaggttggtttttctattcttgtatgacaaacttagcagtttaaaccagcacccatttattatctcatagttatgtgtgcagaagtccaggcaagctcagctgtgcattacaagattaaaaccaaggtgttggcagctttgctcttatctgaaaactccagggaagaagctgcttccaggtttatttaggttgctggcagaatccagttccttggagttgtagaactaaggtctttgtttccttgctggctgtcagctggggactactctgtaacttaaggtcccctaacttaggactctaattggatgtgcaaaatgccatcacagcagtacctagatgagtatttgattgaacaaacaggggtcgggaatctcgggctgctatctttagaattctgcctaccactgaggattaaatgaggagatatatagagagcatttagagtgagtcctggtatataacaaatgctgtacaagcattaccagggattcagtaccacaaacttggctctgaagctggccactatgggctgcaggagaacagtgtttcttttttttttttgagacagagtcttgctcagccttctaggctggagtgtagtggcgtgatctcagctcactgcaaccaccttctcctgggttcaagtgattctcgggtctcagcctcctgagtagctgggattataggcacccaccatcatgtccggctaatttttgtattttggtagagacggggttttaccatgttggccaggctggtcttgaactcctgacctcaggtgatcctcctgcctcagcctcccaaactactgggattacaggcggaagccaccgtgcccagttgagaacagcatttgtataaaagatgggaattgctggccgggcgtggtggctcacgcctgtaatcccacattttgggaggctgaggcggatagatcgcttgagtctgggagttcaagagcagtctgagcaacatgatgaaacccccatctttacaaaaagtacaaaaattagctgggcttgttgatgtttgcctgtagttcccgctagttgggaggctgatgcaggaggatcacttgagctcaggagtttgaggttgcaatgagctatgatcgcaccactgtactgcagcctgagtgagcaagcaagagcctgtctctaatcaataagtaagacatgagaattggcaatataatgtgtgttgcaaattggtaatgtaatgtgtgatattctcctgggcattgtgaaactatgtaatattttgttagggccaggtgcagtggctcacacctgtaaccccaacacttaggaggccaaggcaggaagatcagtggaggccaggatcctgggcatcacagcctgacaaactagcctgggcaacatagcaagaccttgtctctaaaaaaaaaggaaaattagccaggcatagtggcatgtgcctgtactcaggagactgaggtgggaggattgcttgaacccaggagtttgaggttgcagtgagctatgatcgtgctgccgcatgccagcctgggcaacagaacgagaccctgtctctaaagaaaaatataaaaagattctgctgtgttgcagatgttgagattttgtctttgtttttccacagtggtttgctaagaaggccattttcaactctccattggaggctgctatggcgttccctcacctgcagcagcccagctttctactggtaaatatcaactgcttgcatgagtgtcattgtggtcatagttctgtagctgtgggacttgagtgttcttcccattgacttgaagaactctgtagtggttgttttttaggggcatgtgatggaaacaatggcagactccttaacttgactgtgcctcgttattactacaggaccttggggttactcaacctctgggctctgggttttctcatgcaagacaagttcattcaaattctattttctctacttcccaagggtatgaggaggaggagcaagtgagaaggatgtatatcagaatgttcataacttgtaaattcttaaatagatatgaagcattctaataatcagtcataactgtcatcagtgaaaaatggagacactgttgtgcggggggctgctaggttgcactttaagtattaaacatgatgctgagaactgggtgcagtggctcatgcctggagttccagctactgaggagactgaggcaggaggattacttgagcccaagagtttgagaccagcctgggcaacatagtaaagactcaaaaaggaaaaaaaaatgatactgagaagtgagaagttagatatgaggcaagtattggtgatgaaagttcctaattttagttcttaggaggtgtttttgtaaacatttatgtggaaggacattcttcctcagtgcaccccactagagtcaacaggtctggcccatggccagacagctcaggtctccatctctgtctcaatcactgtgaaatccaccctcgtttggaggtagacaaggccttagatatcctttggcaaagctctctaggttgaaattctagctgtttctcctgatcttaatccattcgcacagacgccctttttctccttgtagtcagggtgctttcctcacatcctacgactaggtagatttcattagtccttgtcctgagtcttttctggcctctccattgccttcatgattagtgtctacttggctgaagcggtctgtaatttttgtctgccctgtgttttaagatcattggtttagtaggttcagtgtctattgaataaaggacagctcatttaagagagcttctgccatagccgtgatgttgttgggcgttcttactgatgatcacaacggtgtaatcacggtggtccatcaggctggaaatttccagttgatgcgtacaaactcagtggtactctgtggcttgtgaggggtgcccttacacaatcaagatcctcttctggctctggggctgactctgggatcagcccctacttatggattggtagaagtcaatcctgttctgatcatgtgcagcactctgagggggtactgggaaacaaggctgatagttcctggtccagagagcatagaactacggcctctcctagtagtactctttgggccactgacacacatgaggggctggggaaccaggccagtggttatgggtctgactcataacctattgcttggatttctgtttgactcaagccagagtttgactcaagccagagtatcactaaaagctgcagagtgaatgtcctcgtgactttttcgctttgttctgttttctaggccagcctgaaagctgactctataaataagccctttgcacagcagtgccaagacttgattaaagtaattgaggattttccagcaaaggtatagctctgctaatgtctctctttggagcatgtcttatacattcgttgaagaactttattataattcctaatttccctccccgccccaaccccgagcactgcctggcacagaggcctggccattatcatgaccattatgtttatggacacatttaaacatgtgaacttgtagatcaggggttcttagccacaggtgctctgtccctcaagggacacttggcaatgtcagagacatttttggttgtcacatctggaggtagatggggagtgtgtgctactggcatctaggaagtagaggccagggttgctggaaacattctgcaaagcacaggacagctccctgcaacaaagaagtatctagcccaaaatgtcaatagcaccaaggttcagaaaccctaacgtaaatactaaaaatatgtatttaaatcacacctggaattgtcaagcccaggaagctggcctagacaaggagttaataccaaatggcaataggtcagttaggtttcaggggcttcactctggaaaggatgttgctttcctttctgatagagcatccttcaagtcagaagtttccatctctttttaaagaatctttttttgtggtggctcatgcctgtaatctcaacactttgggaggccgaggtgggaggatcacttaagcccaggagctcaaaaccagtctaggcaacatactgagaacttatctctacaagaaatttaaaaattagctgagtgtagtggtgtgtgcctatagtcccagctactcaggaagctgaggtgggaggattgctcgagcccaggaagtcaaggctgcagtgagccataattgcgccactgcactccagccagggcaacagagtgagaccctgtctcaaaaaatatgtattttgtgtatttttttattttatatattttaattttcttcattgtttatgtttgtttatttttcttaatttagtcttctatcacacacaaaaaatgtattttgattggaggctgacttacttagctggcccaagcctaaagcaacactgcttggtatgccatgtaccccattggaagaacccaaagctgctcttgtcgttggcaccatggcaccagggttcctttgggtgcagggctgatctcgtaggtctcagccagggagtggcctcctcagaaggagctgggcagcaggtggtgcaggactagagccggggcaggaatgggtgctggtcctgcccgcggcctcaccacacattgtttcaggagctgcacaccatcttcccatggctggtagagagcattttcggcagcctagacggtgtcctcgttggctggaacctccgctgcttacaggggcgtgtgaatcctgtggagtacagcatcgtgatggaatttctcgacactgggtaggtaggttggtcaccggagagaggctgggtgattcctcatggtgattccacctttaaaccactctctgaatttcttaagattaagaaacaatcaaagcaagataattcacagttcatttgccctgtttttgtttgtttgttcaatttcatgttcagtggcccaatgatgaagttggtttataagcttcaagctgaagactataagttcgactttcctgtctcctacctgcctgtaagtaaaccacagtggcgagagtggtgctcggggcagtgggccttgcacagccctgtggtgatgggcaatctcctccagtcctctgagggcaaattgaggagcgattcgttccaggggtgtgagaggcaaaggaaatgggtattgcatgactgctacccttgctgtctgcagctttttatgagatggtaggagaagttctaagcaaagactcttgttcaggcactgctcagaggcagggcactgtccccacaggtgggttctgtgtgtgggtctcttccccagcagccttcccaaagtgctgctgtgcatgtggggtactgcgtatcgggcactacgcaccagcacctgcccgcaagcctcactgcctctctctgcagggtcctgtgaaggcgtccatccaggagtgcatcctccctgacagtcctctgtaccacaacaaggtccagttcacccctactgggggccttggtctgaacctggccctgagtatcctttggtggccctgaggtagggaggctgtgggtggcccagcacttgacacttgcggggggtgtggctcatcaaccctgcgtgtttgcccctgacgctgctctcagatccattcgagtattacatattcttctttgccttgagcctcatcactcagaaggtaaggaagggatgccttttgctgggagaggtggggccacggcccagggcttccctgcacttgttggtgcttggtggcctggcagtgtccagagcccacgctaacaactagcttggttttccagccactccctgtgtccctccacgtccgtacttcagactgtgcctatttcatcctggtggacaggtacctgtcatggttcctgcccaccgaaggcagtgtgccctgccactctcctccagcccaggggggaccagcccctcaccgcctcccaggtaaggctgccctttgttaagacctggcccttccataagggagtggcctggtcacttgcatcgcccacggggacaatgttgccaccctttgtccacggttccccaatttttcttatgcctcattccccacccccagctgtcttagcacagactggagggtggggtgtggcgggcaatctgtccttagtgttcagtgtctttggccatcactgaagctatcaggtccctggaggcctccacggcctgcatgggaatgggctgtgttgtgcatggagcagctctccccacaggcagtgtctgaggcagtgagcagggtggaaaggttgtcctatgagcaaaaaaaatggaaatctctatgggcccctggagcaggtcttgaaggggaggccctgggccaaagagcctgttttgccagtccaaacaggctgagcctgatgcgtgcctgcacaggtcgggagtgtgaaccaggggctctcatgcctggctgtcctgggtcctcagtgggcactaacgcagggcctcttggccgacttcccaggagaccctcttgccccagcatcagctgcctgtgcacctctgaccctccttaatctcactggcctattgccttccccaggaagctgcatgcaggccccttcctgcaagtgctggcccaccccagatctgctgtcatgtgtaaggcaggccaggcctttacgtacaattcacgtgtggacagattccccagagggtggaggggagaaagggagaggcagggaggagatgctgcccaggtggcggcagtgatcagtgaccctgaaatgttgctgatcctgtggaggacttggaggtgaggcagattcacaccctcttagatgcagaattcagccgccaagcagttttt

SEQ ID NO: 324 - DNA, 61183 bp, Homo sapiens
gccactctctatttgtcttaatagatttgcctgattttttttaaaatttcaaatcaaggtcactgttgtgaaagggaatttcagagataatacattgttatgaagggccgggtgtggtggcttacacctgcaatcccaacactttgggaggctgaggtgggtggatcatgaggtcaggagtttgagaccagcctgaccaacataatgaaaccccgtctctactaaaaatacaaaatttagctgggtgtggttgtgcacacctataatcccagctactcgggaggctgaggcaggagaagcgcttgaaccccagaggtggaggttgcagtgagccgggatcatgccacagcacttcagcctgggcgacaaagccagactgtgtctcaaaaataaataaataaataaataaataaataaataaataaataagttcctctgagttatttaccatctttctgttgaaatctttactgaaattataaatctcagctttcagaagaagatgtggtaattaaatcgtatgactgttaaaacatacggagctcagctgtgtggacgcagagtaactctgcgtggggtgtgaggtagggtgtgtgtttagaactctgcaagttgaagatttcagagacaagggcagctgcagaagtcctgagttttacactaggacaaaagagaatagatttttctcttatggtggaaagaacatttaaccccgcaatatgtatttagatgatgtcatactttcttcttgaaatatacaaaccctttgatgaatttctttcatctttaaactctttcataatgaatctcttaaataataaatctttctaatacatttttcagtctttgtattcatacaccaatgtaaattctttttttttttttttttttttttgagacagagtctcgccctgtcacccaggctggagtgcagtggcacgatcttggctcactgcaagctccgcctccccggttcaagcgattctcctgcctcagcttcctgagtagctgggactacaggtgcccaccaccatacctggataatttttagtagagtcgggatttcaccatgttggccaggatcgtctccatcttctgacctcgtgatccacagaccttggcctcccaaagtgctgggattataggcttgagccaccacacccgaccgtaaattcttaaaaagacagcatatttattaagttcatgtgttattgctattggaaacaaagacacagtagataaggagtattgcatgagcactggatctgagttgaaaactatggaagacactaacagaactatcttcaagtccgttaaagggaattatttgcagccaggcatttttttccctgaagtaatatctatgacttcttagtagatgttctgaagtggcaaggtaggaacttcagttattgtaggtgaaaacctcaagctatggctgggcatggtggcacatgcctgtagcctgtactcaggaggctgaggcgggaggatctcttgagttgaggagtttgacgctatagtgcactatgatcactcctgtgaatggctgtggcactccagcccgggcaacatagtgagaccccatctctaaaaaaaattgaaaattaaaaaaactttcagatatgcttagaagcagatttttcaaatcccatggggaagggctttaagaagagtatgatcagtaaccagcgaaacaatgattaaagcattgtctttagaagatgatgaactaaaggaatctaaatcttattgcctgaaactctttgcagtcaggcagcttaattgggtgtctttgagaaaattattgtctcatttatcatatttgtgcaatgaaaataatacctacattgtacgcttgtggaatttaaataacaaaatattttatgtatctacatatctcctggatatagtacaagtttaaaacattgtagtttatcatcagtttcctgagagatggcaccaatggcaaaacggtcaccaaagctattcctttagaattagaggacagtccccacttcatggacaacatgtgagtctaagcacccatagcgtccatcagcctgtcctctctccttttttaaagagcaaaacaggaattctgttgtgattgaaggactttctgtctgtccctggaatcctagatgctttgagataactgcatagaagttgcagacttttttcaaacactgatggaatgaaatactgtcattgcctctcttttttcatagctagcatagaagactgatctttttgggggggattgggtgggtggcaacctcatccaaggaggggctacataagtcgtagaagaccttgccaatccaggtaggttgtaactttaggctctgtatggctggtcagggagtcagtctctggcttgactctgaccttccaggagcctggcagttgaagaggatctcagggtgatcagatagagaactgcagaaggtgagagtcaagttagcctcttccagacttattacagtcccctaaagcattaatgacctttttgcctaaagccgatacatggacatttttagttcattgaccttcaaataattgcagctgtttggaaagctattggtcatagaaactggtagtacttccaaacttttcagtgatgtttatcatttttttttttttgagatggggttttgcttttgttgcccaggctggagtgcaatggcgcgatcttggctcaccacaacctctgcctcctgggttcaagcaattctcctgcctcagcctctggagtagctgggattacaggcatgtgccaccacgcccggctaatattgtatttttagtagagacggggtttctccatgttggtcagattggtcttgaactcccaacatcaggtgatccctcctgccttggcctcccaaagtgctgggattacaggcgtgagccaccgcacctggctgatgtttatcatcttaatagcatctgtcctttaaccctgcacacacactccaaaaaagttaactaaaagagacaatgattaattttatattctgatgttttcttatgaacacatttgtggccactttagtgtccagcaaagcatttctttggcgagtgatttaaggaggggtggaaagtggaatggaagaagtctctggaaagtctttaacactgagacgtattttctccctgtttgactccaaggaatttccactcatggaatctggcctattagaaagaactttttccttttgtacttgattcaacttaataaattatgttaaccagctatggtgaatgatgagcattcctcaaaccacagaacaataggcttcatcgttgaagctctaaaagagcagggatctatctgttccaattctcttctgctgggcaccatcttctagctctgctgcagtctctcattcataattcttcccctagaccaagttcttcttttttactgacctctaggacacctggcatgcattcctcttctgactgcctttgttggcctgaatgctgaaataacatcactgaactaacatctcctaaagaagacatttgtcatcagaggcaaatcctcagtgaggattaacctgtctttaaaagatcatgagtaaccggcatatgagatggcatgagactaagaagtgttcctttgaggcagacccgcaatggtctgtgtgcttgcctctccggtcatatcaccaattatcaaatcttggtgcaccatcgcatcccatttgtcacacatctgatttttcttaaataattatactgttcctttgtgaggattaacccgtctttaaaagatcatgcgtaaatcagcacaatctgaaagattcagagcttttttacctttctctctgctaggcacaatgattaccatctccagccttattcttcacagccactcaatcgtggtccttgcagttttgcttcactccacatacaccatttcatttcccttcccacagtcacttcctagaacagatacagagggaggccctgctttgcatgctaatgagggaccacagaaatgactgcaaacagaaaatggaacgcgatctcgtgcatcaaaggggaatgttctgactgttctgtgacttttaaaaatatgttgtcaaaacattaaaaactattgtaggttataaatgcacaggaacattttcaaaaatactaaaactaatatttagtatagtgtaatttaaaacatcagaaacacgaatcaatattttatttctttgtaaaaatcttaatggagtatagtttgaatgaagctggccctcctcttcttgtagtacttacagtgcagagtgagctataccttgacaaactgtcattctcctaagtttgaatcagcttccaactatttattgtttgtgctttcaatgtcatgaaatacctctgataattcctttaatgtgagttttgtttgttttgttttgttttgttttgccatgtcactttcttgggacatctttatcctaaaatgaatgaacacatctattttcatttatgttgttaagtctgccttccctaagttcctctggaatgcctcaaacagtggcaaattacctccaatagctatttcttccataactccatttacactcaatttgaatttcactttcagagtatattagtcagcgttctccagaaaacagtatatgcacacacagaggcataaatatttatttcatcttatatatatgaagatttttaagatatataaagatttatataggtatacatgaagatttattttattatggaaattggcttacacaattagagaggctgagaagttccaccatctgcattctggagaaccaagaaaaccagtggaataattcagtccaaagtccaagtccaaggctggagaaccacagtgccagtgtccaagttctggagaagatggatgtcccagctcaaacagggggagtacatttgcccttcctccaccttcttgttctatcagatgatgcccacattggtgagggtgatctgatctttactcagtctactcatttacatggtaatgtcttctgcaaacaccctcacagacacaccagaactaatgttttaccagctgtctggacatcccttagcttagccaagttaatgcataaaattaactagcattcagagttctctatttttgtttatttgctgtgcttttatctttctgacacttcactgttggccagttttctcttttgattagccatttttgaaaatgttatgcaggcttatcactggaagaaaaggaaaaaacacagcttcatggtttgctgccagtgtgtgaattgaataaaagatgtggggccgggcgcggtggctcacacctgtaatgccagcactttgggaggctgatgtgggtggatcacgatgtcaagagatcaagaccatcctggccaacatggtgaaactctgtctctactaaaaatacaaaaattagctgggcatggtggcacctgcctgcggtcccagctacttgggaggctgaggcaggagaatcacttgaacccaggaggcagaggttgcagtgagccgagattgtgccactgcactccagcctggtgacagagcgagacacaagactccgtgtcaaaaaaaaaaaaaaaaagatgtgtggtgaccaatcaccaatagatattgaaagaagtgacatgattggtcactgatcataatgcgcctctggtatacatgcagcaatttatgggttgaaggtctagcagtgaagtttctcctttatgcaattattcacagttaatagaccatagcaactgataccagaactgtgttgttgggggactggtgtcattggactaaactgtggtaactgaaatctgcgtaatattggagctgtgctaagcaaggatggactggttattactaggacaactttctggcttctctttttatttttagtgcatctaattcatctgacatttaatcgatccagattttcttccaggatgactaataccttagtcatctaaccactcaaggacctcacaatatcttacatgtagttttcacctaaactagggtataacaattataaccatcttcctggtcatcctcagcatgtatactgcagttatatcctaagatttcatctctattaagctccagggagtaataggtgttctttagccctctgcaggattagagaattgaggctgctttgttactgttgttgttcacaataaacttccataggaagtgagttacaagactctagacctttgttaatcctgaactttctgggcatcttgtctgagtgatatatcttcagtaaagtgtatcctaagagctgtcctttctgtttccttggccttcttcacaagcctgctctccaaatacccccactctgggagactgactagctcccaagttggaacacagagttctcaagcttgttgctttgtaggtgacaccaacagaggaacttctgcctgatgttctatctgctaactcccaaattagagtctggaaagagtaatcttgccttgcttatttagtcaaggatacctctcttcttagtactgctatagagggatgtaaatgcctcttcttcacagttgacttcggtagctgggaaatacgacaatatctctaaatttttatttgtatgtaacacaaaactcccgcaaaagaataagagataaacaggcagaggctgttctgcctttttattctgagcccccaaagaaaaacctgtagtgtcatgctgggcagaattttgtaactattttgaccaatagagtataatggaagtaatgccatggtgccctccaagctagatggtaagaacaccttgcacttctgccttgcctacttaggacatttgttcttagaacccatctgctgtacatgctgtgaggaggacagaataacccgtgtgcagaggctgtgcagaggcactttggccagtagtccatctgaggtcccagccaataatcagcatcaactaccaggtatgtgaatgaagatacacacaggtgattcctgttcccagctgctgtcacacctaaactttgagtcttccaagcaaatgccccagatgtgacatagcagacatataagcagtctgccctgtgtccagactaaactcctgacccataaaatctgggaatacaaatgttgttattttaatacaattgtatggcactgagattggggtggtttgttatgcagcaattataactggaacaagaacacttgaccctgtaagacacttgaaattatatgagttatgacatcagtaaagtatcttttcttatctacactttctatcgtaaccacaatgcatatggataatttgtgaagtgaataaggacatggtgaaggactgattccaagtggctgggagagggaagggtgtgctgcatgaatttcatgttcttagatactagtgagaagaggctgtaacacattaatcactccccttctctcactcatacaatggtagcactagtagcacattatcttttcttgtgaaagtgttgcattaagaaatttcttttggagtagcccccaaactgtaacagaatgtgacgtgataatttcccaccgtcttcaagtactgccaagatgtagaagtctccttattccttgtagacaaatggttgctccttggaggggcctatttgaattttttttgttttgttggtcttttttttttttttttttgagacagggtctcactctgttgcccaggctgtagtgcagtgatgcaaccacagctcactgatgcctcggccttccaggctcagatcctcccacctcagcctcctgggtagctgggaatacaggcatgcaccacaaagtctggctaattttttgtagtttttcatagagatgaggtttccccatgttgcccaggctggtctcgaactcctgggctcaagctgtccacccacttcagcctcccaaagtgagccacctttcatctccccatctcatcttatgactctgtgcttgaactggtgtatttaaagattaaggacctttctgaccaatgtcaaatgaaccatccagatggttctggctctcagaaagatcagaggcagtctgaatagcaagtaaggatcaagtcaaccaccagttcaccaaacaaagccaaaacattggcatcaaggaataagccaatggctgacataagtacctgctgccccagaagttacttgtttcaactatttgagttcagcacatcatcgcaattctaaatacttaagttatcttcagcaagtgaatgcaacttataacttattcttccatccttgggtaggtgggggaaccatttgccattttcagagtaaattcaactgagttagaaggaagcccctataacatcaacagaaagcaaattctatagtcaagtctctcaaccattaaattttaggattatattctggtggtacttcttagaaaaaagaaagaagtaaagtttcacctatgagataaattagaggacaaagtgttacttcctatcttcttgcaatcttggccgggcaccgtggctcacgcctgtaatcccagcactttgggaggccgaggcgggcggatcacgaggtcaggtgatcgacaccatcctggctaacacggtgaaaccccgtttctactaaaaatacaaaaaaattagccgggcgtggtggcgggcgcctgtagtcccagctactccggaggttgaggcaggagaatggcgtgaactcaggaggcggagcttgcagtgagccgagattgcaccactgcactccagcctgggcgacagcgagactccgtctcaaaaataataataataaaatataaaaataaaaaagttgtcttgaccatcttggggtgaaacagctggagattaaaggaagaaatggctgccgagcacagtggctcacgcctgtaatcccagcactttgcgaggccgaggcgacagatcccgaggtcaggagattgagaccatcctggccaacatggtgaaaccccgtctctactaaaaatacaaaaattagctgggcatggtggcgtgtgcctgtaatcctagctactcgggaggctgaggcaggagaatcgcttgaactagggagtcagaggttgccctgagccgagatcgcaccactgcactccagcctggtgacagagcgacactccatcttaaaaaaaaaaaaaaaaagcgggggacgggggcggaggggcgtggggaagaaatggcaaggctctgggaggaataaaaagaaaaaaaaaaaaacaaaacaaaagaaagaaaataaccagaattatatctttgttaaacgaggggccaaaaccagaaagctttgtacaaggttttgtgtcttggcagcaagcattgcccttacaacatagaatgtcattgcaatcatatggtatcagtaaccaatgaattacggccagaacacctaggacctgttcttctagactttagatgtgagttctccttctcacaaatctcaaatgcatgttcattctgaacactggctggttttttgaccctttttgctgacctgaaagggctatgtaggtagagtaagactgaaactattgcctggaacatccctcagagtggccaaaatattacctttatgaccataaagcaattccaattcacattgctttctgtaatagagctttcctttccttccttccttccttccttccttccttccttccttccttcctttctttcttcctttctttctttgttgacagagtctcactctgtcgactaggcttgagtacaatgatgctacctcggctcactgcaacctccgtctcccgggttcaagtgattctcctgcctcagcctccggagtaactgggattacaggtgcatgctaccatgcctggcttgattttggggtttttagtagagacggggtttcaccatgttggcaggctggtctcgaactcctgacctcagatgatccacctgcctcagccacccaaagttctgggattacaggcatgagccaggcataagccagtgcccagcctgtaatagagctttctggactactgagttctacagtattttcctgtatgattattttcaatttctgtctcaagacttgagttaggctctttcaataaggcccaaacacactaccaattaatagcattatgctgcgcttttgatttcaactttggtcccagaacccagaaatgggagcctgtgtctattatctatctcatttttagtggtctttgtggtctgcatggtgaagatgtaaaagctttaactaagatgtaggaatggagaaaagaaaaccaggagaggacttgcttacattctaaaagtgggttgtaggggaagaggaagcaaagctgagacttctgagtaactggacttacgctaagatgcctaactgaggtgggggatgatttagttttggatggttacatggtaaactaaagaaaaaaagtattgaagtaagacaaacatctaaaaactttataatatcttaatttgattttttaaaaattatactttaagttctgggataaatgtgcagaatgtgcaggtctgttacataggtatacatgtgccatggtggtttgctgcatccatcaacccatcatctacattaggtatttctcctaatgctatccctcccctagccccccaacccctgacaggccccagtgtgtgatgttcccctccctgtgtccatgtgttctcattgttaacctcccagttatgagtgagaacatgcagtatttggttttctgttcctgtgttagtttgctgagaatgatggtttccagcttcatccatgtccctgtaaaggacatgaactcatcctttttaatggctgtgtagtattccatggtgtatatgtgccacattttctttatccagtctatcattgatgagcatttgggttggttccaagtctttgctactgtgaatagtgctgcaatgaacaaacatgtgcatgtgtctttatagtaaaatgatttataatcctttggaaatgtaaatccttataatcccagtaatgggattgctgggtcaaatggtatttcttgatctagatccttgaggaatcaccacaccgtgttctacaatggctgaactaatttacagcctcaccaacggtgtaaaagtgttcctatttctctacatcctctccaacatctgttgttttctgactctttaatgatcgccattctaactgacgtgacatggtatctcattgtggttttgattttttaaagaattctacattaaacatcttgatgaattactaaaggaatttctgttggtaagagaaaaagcatgactactttcactgagagtattcagtactgttcaggttttattcccagtgcaatatgacaggaaaaatgaaatatacatattagaatgaaacatcaattacacagccactgatataattttcagaaaatgaaattaaaaattaataaaaacaatgagttaagaggacagataaaagataaaatgaaactcaaaagaattctcatgaatcaaactgaatcaaattgaatttgtacaagcaaaaagtttctattcacattgaaaactctaaaatatcttgatatacacttagaaaaagtgagtattccctatgcggataaatctacagaatgttacttggactacaagagttaattaatggagagacatcatctgactagatgagaatatccagcattatttatatcttgattatctcagcctcctccaaactaaatatgtttaataaaattttaatcaaattattgttttttttttttggaacgtcagtgcttcacttcagatttcttttgaaagaaaaatgtatatgaataccttatattcgataagaatgtgaaaagatttgctctactatgtatcaaaaaatgtaaagctaatcaaaacaaaattaagggaaaagctatattataaatattgattaaaatcattataaaaaccttctgcaatggaatagtaggcaaagcatttcaacagacaagtcacaaaaaaagagagaaaagtaggctcttcaaatgaaaagctgctcaactttcttcccacaacaaagatgtgaaacagataattagggtttgatcattggttcttttgttttgttttgttggtttctcttttacacataagaggtttaacaatttgaacccagtgtctttaagacagaaatgtcacttatgtcagtgttaatgtaattttggaggaacaaacattgggctgtatctataaagtgttcttagtttttttgtttgtttgagatggagtttcactcttgttgtccaggctggagtgcaatggcacgatctcggctcactacaacctccgcctcccgggttcaagcgattctcctgcctcagcctccccagtagctgggattataggcgcacaccctgacgcctggctaatttttgtatttttagtagagacggtttcaccatgttggccaggctggtctcgaactcctgacctcaaggtgatctgcctgcctcagcctcccagagtgctgggattacaggcgtgagccaccgtgcctggccaaaagtgttcttagtttttgacctagcaattccacctgtagaattttttttatataaaatagacatataaaaagataaaagataggctgggcacagtggcttatgcctgtaatcccagcaatttgggaggctgaggtgggcggatcacctgaggtcaggagtttgagaccagcctgaccaacatggagaaaccccatctctactaaaaataccaaattagctggacgtggtggcgcatgcctgcaatcccagctacttgggaggctgaggcaggagaatcgcttgaatccaggaggcggaggttgcggtgagccgagattgtgccattgcactccagcctggacaacaagagcgaaactccacaaaaaaaaaaaaaaaaaaaaaaagatgcttatgatccggcggatcctcctgggttggccaggccggggagagggcgcgggcgccgagtggcgggggcagcgggcgggcgcggcgaccggggccggggcggggatcctggcggcgaccgcggaggcggcagcgccccgggcccgcggccccctcccctccggcgaggggagccgctggatggggccggtcggggggcggccctgcggcgcagagcggcggcgacggcggcggaccccccaggcgggccggggctgagcccggggccggggcgggggctccggggggaccatgcccggaggccggcgggcagcagcatggctcacgggcctggcgcgctgatgctcaagtgcgtggtggtcggcgacggagcggtgggcaagacgtgcccactcatgagctatgccaacgaagccttcccggaggagtacctgcccaccgtcttcgaccactacgtagtcagcgtcaccgtggggggcaagcagtacctcctaggactctatgacacggccggacaggaagactatgactgtctgaggcctttatcttacccagtgaccgacgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaaggatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaaagaataggatcaagatgtataaactgttgtttaattacgtgagaaacatcttcagtggccaaggaaactggccatttctctgagaaagcaaatgaaatgctacagctatacccagaccttttataggtaatgaagcagttcaaaacttgaaagaaaacaaaacctgtcctcagaattctataaagtttattaagaatgttccttaaaggtttaagaagcagtaagcagtatctgaagccacaatctattataaatactttatttcaactagaaggtacaatctctcagaggtttcatagtttaaaaagctacaatcacatcatgttgtaactacataaaaaacagagctgtaaatggaactgcttggctttgaccatacacatttctgcacagcccttacagaatctgcacaaagaaatatctccctttgttccggttaattgttctggtatgtaagttgctttctattccagtatatccagagtggtgaaataacaaggccagccacatagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgcctaaagtgtaataaggtcataactgcatttatcatgaacactaaaaatgtacacattttagttagtgtgtattaaactgtaacaaggcttcgggcaattgtagatttagtttgacgctccccaaagtgcatgagacacatgctaaaattacaaattaaaattttgggtcagactttgccataatgctggactcaatttagctctctgaactagatggtaatttttttttaattcccactttggctgtgtacatcaaatgaaatgagaagtgtgtatgctgaccaaaccacaagaaactttctttaagttgtgttaaagaggaaagacctagaatccaagcatgttacatgaaaattgtaacagagcagctgcttccacctttcagatatggatgttggaaccacagcagaagttatagagcgacaacttacatacacacctagaatgtaagttaaacaaaataccggcttcgggagacccattttctccagccatattacattaggctagaagtaattaatgttgatttatttcatctacaagcagttggtccctaagtgacaggctccgcttcaaaaaaaaaagttggagaaaaattttcatgttcttctgtgaagcttatttggtacactggagccttttctaatctttctctggggggaacaggccgcagaactgtgttagaggtgaaccatcttaattactagttctattacctaattcagcttccttgtttggtctgctgtggatctgccttattgcatatgccatgcatcagataatggtgttagacaaagcttcattgtgaacaacctaatgcattttagagaaacaatctcatctacacattttttttctagcctttcctacatttaaacttgctgttgcctaaatcataattttttaaatgtctttggtgggcttctgttaattcacatgacttgagtttatagctgtgtctactgcacagattgggtaatggaacactaaacttttatacttgaaaatgacaggcttaaatgctcatatcagtcacaaatccaggatgtactgtcttgttgtatgtgagctttgtagagatttttaaaaatataagcatcaccttcacattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgctatttttagataaaattgaaaggaattgtataaatcaattaacatattagctaagttgtccaacacatgttataaatgaattacaacagtaaactattatacatttccaaaaaataaagatatattgcacaatgttcactgctatatagtgtacaatatcaaaaattggaaactaacttgtatgttataatttatgtcagttatgagtggtagaaaaaccattgtagctcttgtcaaaacctgcataggcagtctaaggtaaatataacacttgattttatcagggcccaggttccttctgtcttgtggccactgtatgagccgcaaccccaaggtggaagatggcagtatatgtttatacacagcaatgaggaagggagataggaaagcaaagtgtgtccctttaggaaagatcttggaatctgccatgccatatttctactacatcctgttactaagaacttaggaacatgattgcacctttattggtagtctttattctgggcagccatctgcctagcttaaaatgtggagggtccttaccatagaggaaacagagaatgaattttagcaaacaactagtggtttctgccacatgactaaatgaccaacagggaaacatattacaatacatcatacaattaacctctattcagttgttacagactcaagcaactctacatgaattggcatgtgaacttcttgcaaaacagggtgtttattatacagttttttaaaagtgtgcgaaaagcctgcatatgtccaccgaaagacatgtaaaaatgcttattcctttattatttgtaatatcccaaattttgaaatgccacaaatattcaccagaagtacaatggataagtaaagtgtagcatatttatctagtaaaataccataggttatgggaatgaacaaagtgttgccagatacaataatgtggatgactcctaatgttgcagcaaaagaagacaggcacagaacatataatttacaaccccacttacataaagtttaaaaacaagtaaaattaacctacagtgctagaaagcagaataaagtcaaggaatgctagtgtcaggaaaggagaaagcagcctcctgaggggcttctgaggggctgctaatgttctatttctagaactgggtattggtttttggggcatattcactgtgtaaaaattcagcaagttacatgctgtgatttgtgcaatttgttgtatggatattacacttcagtatgattgcagaagcctagattatctaactgaggtactgacagtaattctcaaaatggaaggtgggctctcatgcctggacagatgtcctcactgcaagctggcatgcagggaccaggtgagtggcttctggtcaccaagggcagctgtgtcacctggacatgagggcagaccccaggtgagagcatcagtaggacaacgctgtcttacttcctgcggttctgtgctggcagccacagaaattgatgcagacgcttccagcttcagtgcttgtgtttcttgctcactagctcagctggtctataataacaaagaaatgaatagtggggtgaagacatattccataggattcagactctacttacaagttctttatttaaaaagtgcactctgggccgggcgcggtggctcacgcctgtaatcccagcactttcggaggctgaggcaggaggatcacgaggtcaggagatcgagaccatcctggctaacacggtgaaaccccgtctctatttaaaatacaaaaaattagccgggcatggtggcacgtgcctgtggtcctagctactcgggaagctgaggaaggaaaatcacttgaacctgggaggtagagtgagccaagacagcgcctctgcactccagcctgggcaacagagtgagtctctgtctcaaaaaaaaagaaaaagaaaaaaatgcactctgtctggtccagaggttcccgtggttcttactcctggatcccatcacccctcctgtctctacacagacccccactccactcccagctggccgcctacccaagcaccactgcccttggcatccttggctaaagtggtgactgcatgggcaggtggagtctgacaagtcacagtgaccaccagcagtgggaggtcacttggcctcacctgtaattcatagccctgaccacaccctctggcatgtgagtttatccacaaggaacaaagctgagatgagacaatttcactacataacttgctcacgcggcatcccgtggtatgctagcattattaacactggaagttcttttgaagattttgaaagtttaattgtcatgagatttttccaaactaagttcatgatatggatttttaaattgtatctaatttaagtgacatttcaattcaaatctaaatctaaaactgatagacctaatgatttcaggtaattaattcttttttgtttttgtttttgttttgttttgttcaagatggactcttgctctgtcacccaggctggagtacagtggcacaatcttggctcactgcaacctctgcctcccaggttcaagtgattctcctgcctcagcctcctaagtagctgggactacagacacccaccaccaagcctggctaatttttgtatttttagtagagacaaggtttcaccatgttggccaggctggtctcaaactcctgacctcaggtgatccacctgccttggcctcccagagtgctgggattacaggggtgagccaccgggctggcctgattagcatcttttaaccgaataaaaacatcctatttaaaagaccaaatatattacttcatttgaaaattaaaatatagggttgggcatggtggctcacgcctgtaatcccagcactatgggaggccgagccaggtggatcacccgaggtcaggagttctcatgagatctggttgtttaaaggtgtgtagcatctccccgctctctctcttcctcctgctctggccatgtaagatgtgcctgcttccccttctgctatgattgttaagtttcctgaggcctccccagaaacagaagccggtacagcctgcagaactgtgagccaattaaacctgttggtttttttttttttttttttaaataaattacccagtctcatgtagttcttttttttttctgtcacccaggctggagtgcagtagcgcaatctcggctcgctgcaacctccatctcccaggttcaagcaattcttctgcttcagcctcccgagtagctgggattacaggcgcccaccaccacgcctggttaatttttgtatttttaatagagacggggtttcaccatgttggccaggctggtgtcaaactcctgacctcaggtgctccacccgcctcggtctcccaaactgctgagattacaggcgtcggccaccgcgcccggcctcaggtagttgtttatagcagtgcgagaatggactaatacacttggctatgaaaatgaaaacaatcacgaaggcagggtccctccccacctctccatatccctgtcttgtctggagctgctttgggtaacgctcagccgggaccagcacattacacaaggcaatgtccacgtgccgggatcagcaaggatgagctttctgtctggggtaagagtaaagactctaacccagcaccacctcgagggcttcaggctcactttctgttgcttgaagtccgcgatgtgctcaggaagtctgcactcctttgaggcctcagcaacagtgtccttgagctgagcttccagctacgaaacgaagacacacttgtcattaacacaaaggaagcacagccttaccagttagatcttccccaaaggacttgtaagagagcaagaccttaaaggacctttgtattttttcaccctttatcaaatcttatcacaaattaaagtttcagaaatacaccgcagggctcagctgaagtggttggttagtaataaaacaagtttaaattcgaatttaagttgatattttgagatgagatttcaagaaagggtactgatttgtgaaaacaagtacttctgatttctgtaaaacactgattcattttttaaatggacaatttcagacacacacacagaagaacaggagagagtaatgaatctcctgtgcctggcacccagctttgacagtgaggagaggactttttttttttttttttttttttttttttttagataagagtcttactctgtcgcccaggctggaatgcagtggtgtgatcttagctcactgcaacatccacctcctgggttcaagcgattcttatgcctcagcctccagtttagctgggattacaggctcacaccacctcgcccggctagtttttgtattttttttagtagagatggggtttcaccgtgttggccaggctaatctcaaactccacctcaggtgatccgcccacctcagcctcaccaagttgctgggattacaggcaagccaccgtagtcggctgacagtgagcagcttgagctgagcttgcttcatctctgcctacgcacaaactgcttgagaacaaatcccaggcaacgtatcactgcatccgatgtggaatggtaatccttagttaggggtttcattaacttgagttgtaactggctgcaactacaaatatatttaggttgcaaaataaactaagaagaaaacaaacagatatcctgtggctaaacagcaaagagccctgaacttgagcatgtactttcagaccttctcatttgtgggattcgttaagtaaattttaatagaatttttttgagacagattctcactctgtcgcccaggctggagtacagtggcacaatctcggctcactgcaacctccacctcccaggctcaagtgatcctcccactaagcctcctgagtacttcatgttagatgtgcatgccaccacacccagctaactttttgtatttttggtagagatggggtttcactatgttgcccagactggtcttgaactcctcagctcaatcgatcagcccacctcagcttcccaaagagctaggattagaggtgtgagccacagcccctggcctttaatcgaattttaaagtaagcattgcttaaaacatgtcactcatcaacagcagaacattcagaatacctagggcagcagttttcaaattgtgggctgagaaccttgggattctgagactttgtcagagaataaataccctctacttactgaaaagggaatttttaaaacctagcaccacaggaatctcttttaataattaattagctatctgtgggaaccaggagttcttcatgtacttcatccagaacagtgtatccaaacagattgagtgcacaaacagacatgagaacccgagcacgttctattaagccagatattaaagaaacattaaaaaatgtaaaaatgcggctgggtgcggtggctcacgcctgtaatcccaggactttgggaggctgaggagggcagatcacctgaggttgggagttcgagaccagcctggccaacatggtgaaaccccatctctactaaaaatacaaaaattagccgagaatggtggtgcatgtctgtaatcccagctactcaagaggctgaggcacgagaatcgcctgaacccgggaggtagaggctgcagtgagcggagattgtgccactgcactccagcctgggtgacagagcaagactccatcttaaaataaaataaaaaaaaatgcaaaaatgccattcttctcactagatttttaaagaaatagttacttttcattacaaactttacgttaacatgtaatgggtttttgttgtattgaaagaattctcagttttaatttctgccgtggtgcatattgagagctgtaatctacctaagtagaagctctttgggatccccagtaatttgcaagagtgtaaaggagtgcttaggccaagacgcttcagaagcactggtctaaagcaagtggcttgaagcgtcctagactacgatttgtctttctactgccattggctctttatggactgcaggtgctcttattcaattaagccgggccatatcacagctcagcataaataccctctacttacttaaaagggaattttaaaaacttaggaataggaacctcttttaatgatttcacaaatagatattgagggatgaacacaaaataaatgcttggcagatcaacttacttgggttcacataaaacttaagatgattttaaagtaatttacataatgcagcccaagttttcaaagatgttttattaaggtcatacaaaagtccagtcaataccatcgctgaaatatctaaatagcttcctcccccccttttttttttttgagacagagttttgctcttgttgcccaggctggagtgcagtggcatgatcttggctcactgcaacctccgcctcccaggttcaagcaattctcctgcttcagcctcccaagtagctaggattacaggcacccaataccatgcctggttaatttttgcatttttaatagagacagggtttcaccatgttggccaggctggtctcaaactcctgacctcaggccatccacccgcctcgacctcccaaagtgctgggattacaggcgtgagccaccgcatctggctaaacagcatcctctttctgagcttcttggatcttcagatctcctgccacatcatgtcagctttctgcatggctacttccatctcctcctccttgtcccacaccttctgcttctgggagtagagctctgccatgagctcattgagctccaagaactcctgcagggccagcttttgctgctgatgggcatctttcagttctttggcttgggatttcaatgtctctgaagcttcaaccaattgctgaaaaaaaaattacagatgttttatgtttgcttaacaaaggtctggaaggctggacatttagtttacactatattaaagagttacaagtgacagccaatgctggttacagattaaagccacagatgggagaaatcccctgcttggaaaaagccctgtgctcacctcaccccagccaaacattcaatgggaagaccacctgggctcaggtgctgagcaacaaccccacaccaagaaagaccctgcaactgcatggagtaacttacagcaggacagctggctctgtaatgccaacctctgcccgaggtcttctacacaattgcaaaggtgaataaagcatttgggcactcaatatagttacttaaacacaagaagaagcagaagcagaaaaaaatacatagacaaagtgctgaagatttaaatcaggccaggcactcatgcctgtcatcccagcactttgggaggctgaggtgggaggatcacttgagcccaggagttcaagaccagcgcctgggcaaaatagtgagacctcatctcttaaaaaaactaaaaaagaaagaaaagaaaattaagaagaaagagatttaaatcaaagactccctgggtggagggccacaagtaggacttaccacaagttcagctgcactgacaacccaaccttaccacttgctgcactgatgaccctgacctccctgcagctgatctggccaacagtctggctgtttagtcactgtcacacttgctggactaagactggaagtgacgagacctggagcaagctggcagggcggctcccacatggggagaaaaggcctccccaggcctctctgggtccagctcagagtcactgtgactgtgtcaagcaatgagacgctgcccagcccacactgcactcccagacaagtcatgcagggggatgatactacagattatcttaagaagcaatttgggcttaaaatctgccccattttagaggacagatcacaaactacaggtccaaggacttcagtgtataaatgaatgtattttagaaaacagagcctatgcagtgagctgagatcgcatgactgcagcctggtgacagagagagactctgtctcaaaaaaaaaaaaaagaaaaaaagaaaagaaaaaagaacctaattgtgttattactatacttaatggcatttgaatataaagttcacatatcttactaaaaaccaaatttataaaggagttatgggggaatcagccacattttaacatatgtcctcttttgcagttccctgtccttactaagatgccccttctaagagcagggggcatggtgtagagagaaggacgaggtcactggtgtcaggcgcagcgtgtcactgcagataacacagtgccctctggacatcgttcctcattcagaatgggcggggctgggggagttgctgcttactccgcggggttgaactggagatggcagatgatgactgtgaagtgggtgcctgctgcaggcagcatgctgaaaggcacccatggcagggagccaagcccagctagctgacatgggctgtgtagcaactgggcacagcaggggccctagaaccaggcttggccctgttgtcctgcgtgcagcagggacagtccatgagcaggagtcccaaggaggtctttaaacatctgtatgaacagaatcttacaaaactctgcaaagcctcttaagcctttctcacccagaaccgaactgcctaccttgtgcatgtcctccttctcctgccacaccatgcggtgctgcttctctggcccccgtagctgctgtgtgaaatcttgttgaggcgccgccttgtcctcaagttgtcactcaagcctgtttgaatatgagcaaaagaggaaataatttgtgttactttctgtgtagcaactatatgtaaatgttgttagctgacttattgaaatgatttaataattcacaggactctttttattgctgtatactaaataaaatacacaaggcagcaatacttaggggccagaaacactgtttactacaagtcaattatggaatcatagcttacagtaaaaatgggcatgtccaaggctcaatttttcttttgtcatttacagtagaataaatagtttgttgctaattttctacactgtctactgggaatatgtgttacttttataatcagaaaaataaatattgcagccatgtagcatataatgatgtttcggtcaacaacagacagcatatatataacagtggtcccataaagttataataccatatttttcccgtagcttttctgtgtttagatacataaatccttgctgtacaggtctgtagccaaggggcaatatgctataccatgtggtctaggtgtgcagtaggctgcaccaccttggttggtctaagaacactctgtgatgttctcacatcaacgaaattacctgatgatgcattgtcgagaacgtatcccagccgctgaaggacgcgtggctggactgaagagcaccgtgtgatgtgggctacagctgagttctgtgcatgatgtggttggagccttgaggaagggggactatggactgaatggtgtccccccccaccaatattagacgctgaagctctaatccccaatgtgactgtagttggggacagggcctataaggagatgatgaaggttaagtgaggtcataagggtgggccctgatccaacaggattcgtgtccttataagagaccagagagcttgggtgctacctccccatgggaggacatggtgagaaggtggctgtgtgcaaaccaggaagagaggcctctggggcttttagcctccagaactgtgagaaaataaaaccctgctgtttaagccactcagtcagtggtattttttagggtgcctggggctaatacagaaggattcaccctcctggggagaaggggccagtggcctcctctgattttcccggctgtctgcagaactccgtccctgcccctcctccttttgccaaagcatcttgctaagggaagacctgattgcattgttcagaggtccccaaaggccacagaaaagtctcaactcctggacctcatgagtcccatcccactgggggagctccctctctcttctctgctctcctctcaggagggaaagttaagggcctgcttggccaccctccagggagatgccatggtgggatgctgcatcctggtgatgagctgggggtaagccagcatgtctcctccagggcttttcccagaactgaatacacactaagatgatctttagggatggaagaatcaaactgggaagaatcacacacctgtagtcccaccctacaaggaaggctgaggctgggggatcacttgagcccaggaatttgagtccagcctggtcaacatagtgagaaccagtgtcaaaaaataaataaataaaaaggaagaatcaggtgactgttccaaactcctccaaaatgggtattgggtcccgactctgctcttcccgggacaggggtgtgccttcccctttcctgttgtccataaacccactccctctcactaaagaaataagaaaaagtgttcacagcactttgagttatgcgaggtgtgcagaatttatcaggcccagagagacaggaatatggacttcagtcacacgccttgtactcatgccctggggtgactgtttaaaggcattttgttcctgactagctcaacccattatcttcctgttcctggaatttgtgataccaaagacaatgtagacaatgtagagacaataaatagctttttttttttttgagacagagtctcgctgtgttgcccaggctggagtgcagtggtgctatctcggctcactgcaagctccacctcccgggttcatgccatcctcctgcctcggcatccagagtagctgggactgcaggcacccgccgccacgcccggctaattttttgtatttttagtagagacggggttttaccgtgttagccaggatggtctcgatctcctgacctcgtgatccgcctgccttggcctccctaagtgctgggattacaggcatgagccaccgcgcccagtcttcttcttcttttttttttttttttttttttgagatggagtttcactctattgcccaggctggagtgcaatggtgtgatcttgactcactgcaaactccgcctcccgggttcaagtgattatcctacctcagcctcccaagtagctgggactataggtgctcaccaccatgcctggctaatttttgtatttttagtagaggaagggtttcatcatgttggccagactggtcttgaactcctgacctcaagtgatcctcccaccttggcctcccaaagtgctgggattacaggtgtgagccaccacgcctgacccaataaatagcttacgttattttcatataaattcctcaggctaggccagccaaggtgggaggatcccttcaggtcaggagttcaagactagcctggacaacacagcaagacttcttctctaatttcaaattcttggtaaacaacttaggaactgcctcttcttttcctttataaaacccacttataactgctgccaatatattaagacaacttgcatctccagggttgcacttctcaaacttggcccaaataaactctatttttttttcaagatggagtttcgctctgtcgcccaggcttgagtgcagtggcgtgatctcagctcactgcaacctctgcctcccaggttcaagggattctcctgcctcagcctcctgagtagctgggattacaggcatgcgccaccgtgccttgctaattttattttatttttttgtattttttgtaaaaacgggcaaggtgggtctcaccacgttgcccaggctggtcttgaactcctgacctgaagcagtcctcctgccatggcctcccaaagcattggaattacaggcatgagctggtgtgcctgacccaacgtctccacttacgttaattttgcctcctttcttccttttttttttttttttttttttttttgaaacggagtatggctctgttgcccaggctggagtgtgcagtggcccaatctcggctcactgcaacaactgcctcccagtttcaagcgattctcctacctcagcctcccgtgtagctgggattacaggtgcctaccaccagccagggtaatttttgtatttttagtagagacgggttttcaccatattggccaggctggtcttgggaactcttgacctcaggtgatccacccgcctcggcctcccaaagtgctgggattgcgggcgttagccatcgcgcccggcccgttttctccttttgggtcacaaaagtgattgaatcctgccacttcccaggtgctgggtgggaacagggaagagggggataattgcggtgctgctgtgacttgggtagatggcggcaaggcctctcagaggtggccttgtttgcaaagatctgaattaggcagggagaggggcaggcctggggcaatcagggaggggcagtggcacactgggagcaaggcaatgttccgcgacccacagaggcagcgcagtagctgttccaaccctggtcagaagacaccccggaaatgcctcagcaaccgcgcagcctttgatgacccccgctgccttcccgccaatcctacatccaatcagagagcgtccccagtacacatgttgagcaatggccaatcagaactgggatccggccctcagcccgcctcccaggaactccgagccaatggcggcctggcaccggcgggccaatcccgtgcggcgcgcacaggcaggaggttgcagttgggcgctcagcagctgtggcagccggttgaggtctggcagtagcgttgggctgaagcagcggagttcgccatggtaaggcccgggtcactcccgccccgcagatgcccaggcagacgaagttggcctcgggtggacagagggacgttgttgcgggcctgggcgctgagaggaggccagagaaggacgcagggtctagtgcgggacaggaggacacgggatcgtttcctggatctttgggtcccagggcagggacggcggcttttgttttagatgaagctgccggcctttagtgaacgggaccattgacggtgtcccgtcccccagagagcaaatagtggcgtcgcctcctgaagacgggagggcgctgctcccgcttcacacgtctttgtgctactcgaaacaactgaggagccccaggagccttcggtgacgggggttggggctgtggacattgatcagatgaggaattaaggctcagacgctgctgcaacattgccttgttcacctaaaggcaaccgttaggccaggcgcggcggctcacgcctggaatcccagcccttggggaggtggaggcgggcggatcacctgatgtctggagttcaagatcagcccgaccaacatggcgaaacccagtctctacaaaaaaatacaaaaattacccgggcatggtgatgcgagtctgtggttccagctactcgggaggctgaggtgggaggatcagccgagcctggaactttgaggctgcagtgagtcgtgatggcgccagtgcactccagcctgggccacagagaccctgcctcaaagacacaaacaaaaaaagcagcccattaacataacagattcccaagtcccaagtctgaatagctgtggtttgtcagttatcctttttttcctttctttttctttcttttttttttttgagacagcactcaacaaatgctgtgttgcccaggctggagcacagttgcaggatcacggctccctgcagccttgaacccctggcttccagcagccctcccacctcagccttccgagtagctggtactacaggtgtgtgccaccacacctggctaatttgtagatttttcatagggacagggactcactatgttacccaggctggtctcaaactggtcccaagtgatcctctcacctcagccttctaaagtgctgggattataggaatgagccaccacacccagcttggcagggtttaaagaaaccaccaaaggacagtgcagtgtcccagcactaatgacgtctgggagccattacaggcttcaaggggtagagagagggagtggttacaagaaattgggagggtagttttatgaagagggcagcctgccaaaagtgtggccttgagagggattcaggtcacccacagcagttgagcaggaaggggccaaggagggagtaccctggcactgctttctccagccccccagtatcccactgctgcctgccattgaccaaaccagcaagaagccagagggcgaggaaggcctctgatgctgttctcaagggtcagccttcgagagcacagagcaggtggtgaatgatggacggggtagaactggggggtagagagaggacacacactgagcacctgggcttggaccatggtgacctgggacctactctgtatttccttacccaacccgactaccttatcctttgatcaggacataatcaaaaactgctacatattcttcagagaattactgtgacgggctataatgtggggttgattattgacattacatggcttccaagttttaaaataacctaagttttgtgtagtggcaaacaggttctagggctacctctagaacttactagctagtatggtttacagcaattagttttcacagcgataaagggatcagtcactaaccctcctaggaaatatcgattgtgaaagcgccagatactgaagcagtatataaatattaaattagaatattttgcatgccatatagtttcaagttgccttgaaatgaatgggttcacttttatgttcctgttcacagcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcggtaggtgcctgggcactggatggcagctttcctgagagggtgggagagcattggtaaagccccgtgtgggctcctttgaatcctcctgctgaaaggatgggatagacaggcatatgcccatggcattgttaggagagaaactgaaaggttcgtgatcaaagtgtctgtgagactcggctcctaatttaggaaaacctgacctacagggaaaagctgctttgccagcagtaagatgggctgtgaagagattccctcgtgcgtgcctcagccctgctcaggtggccctgcctgcagggtgcagtggcattggttccctcccgaatgctgtgcattctcttatgctggtgcactagagtcttgacctgcatcttaggcatagaaggtaagtacagaacagtcatttgcttccttcagattcgcagcctgatgtagtttccaaggagagctacaaagaggcagcacctttcagtggccccccaggagatgacagcatcacctgaaagcctgtgggacccaggtcatccagggtgccctgatgggactgccctgcagaagtcacactgacctggtgactgcccaggttgtaagagtttctaacttacagcctttgatgtagctacacgtaggaaagaattatgtacctgcgtaggagtgccagagcttatttcctttcactgggaactggttgtgctgacatttatacaacaagctgagtttaactttgtagagtcataaattgcatatgcagtttggttatcacacagagacattttctaccagacactgccactgttgacctatgacatgtaggtcatgtactttgaacagcatgtgctctgtagaagtgaacactcctggaatgtgtccatcttggtgagtacaggccttaaaaattcacagcacacactgtctcttttgcagatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggtaagaagagaaggtttcatgtggccattttcttgcatgggaggggtagttcttggaatgtgaaagggaagtcattttatcaacacttagaccagcatcttggccgggcgcggtggctcacacatgtaatcccagcactttgggaggctaaagcgggtggattacctgaggtcaggagtttgagaccagcctggcctacatggtgaaactctatgtctactaaaaatacaaaaattagctgggtgtgggggcacacacctgtactcccagctacttgagaggctgaggcaggagaattgcttgaacccggaaggcggaggttgcaatgagctgagattgcactactgcactctagcctgggaaacagagcaagattccgtctcaaacaaacaagcaaaaacttagaccagcatcttgagtcctactgagtctgcagtggtgatttgtccgtagatctttgcttttctttgcttcaaagtgtactgcatgtttattatggatgatttgaatccatatcaactctttagaggcaaagagaagcggccctggcttgttggaggttggtggtgtggcttccatgggcattggctcacgttgtgtggtttctctcaggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcagctgtctgtggccgagatcaccaatgcctgcttcgagccagccaatcaaatggtcaagtgtgaccctcgccacggcaagtacatggcctgctgcatgttgtacaggggggacgtggtccccaaagacgtcaacgcggccatcgccaccatcaagaccaagcgcaccatccagtttgtggattggtgcccgactggatttaaggtatgactgggtgatgtggaggcctttcagcaagcagcagatgcacaaaataacactggccctgaaggcccacatcctttggggagattatccctgttccatgggctaggcatgtgggcataaattagtgaaccagagttgataattgattcagtgatttctttttttttttttgagacagtcttgctctgtcaaccaggctggagtgcagtggtgcgatctcagctaactgcaacctctgcctcccgggttcaaacaattctctggcctcaccctcccaagtagctgggattacaggtacccgctaccacgcccggctaatttttgtatttttagtagagatggggtttcgccatgttggccaggttggtcttgaactcctgacctcaggtgatctgcctgcctcagcctcccaaagtgctgggattacagtcgtgagccactgcacctagctcagtgatgtcttttgaactctctgtctgagtcatcacactatatatctgtggtgagctttatttatttatttatttattttttgagacagggtcttgctttgtcccccaggctgtagtatagtagtgtgatcttggctcactgcaacctctgcctcccaggctccagcgattctctcacctcagcctcccaagcagctgggaccatagacatgcaacaccatgcccgggtaattttttttttttttttttgagacagagtcttgctctgtcgcccgggttggaatgcagtggcgtgatcttgactcactgcaacctccacctcccgggctcaagcagttctctgcctcagcctcccaagtagctgggattacaggcacctgccaccacgcctggctaatttttgtatttttagtagagatgggattttgccatgttggccaggctggtctcgaactcctggcctcaggtgatccacccgccttagcctcccaagtgctggattacaggcacgagccactgcacccagctaatatttgtatttttagtagagatggggtttcgccatgttggccaggctggtctcaaacccctggcctcacgtgatctgcccacctgtctcccaaagtgctggggtcacaggcttgagccaccacacctggcctgatgttgtcatttatagaacaagtttgctgatccctgctctagttgaccctgtgcactgcggccaggacctcaggtcatgttatgcccgagttctgaaacttggaatgcttcccctttggttaccaccttggaatgtcaccccctacttaggcaggcacatggaccacttcgaccacttcctgctgctgtggtagcagcattcatatgacccttgacccatgatctgctacctttgcatatccacagtggcttgttctgtgggtcagaagtgggtatgatgttccttgtgatagcatggggaagagttgtgtactctgaatctatctgggtggaagaagtttagctacagaatttaattgtaatctacaaagaagacaagcagcatacattttcagagggaagactgtcttcacctgggcacctatcacatgtcacaggtactaggacacagccctttaggtagcttgggatcccaccagggtggctacctccaaggttcctttctctattcctcatctggaactatcaccctgcctggtgcagagaagggcttagtgacgtttgtgaggtgaactgagcattctccgtgtcacctacagggtgtcttctgtttgaggaaaagtagctaccatttctaggtttgatataagcttcatggactgctttctttcccttctctggcaggtgggcattaactaccagccccccacagtggtccccgggggagacctggccaaggtgcagcgggccgtgtgcatgctgagcaacaccacggccattgcggaggcctgggcccgcctggaccataagttcgatctcatgtatgccaagcgggcctttgtgcactggtacgtgggcgaaggcatggaagagggagagttctctgaggcccgcgaggacctggcagctctagagaaggattatgaagaggtgggcgtggattccgtggaagctgaggctgaagaaggcgaagaatactgaggggagggtgtggtgggttctcccctgccacccccgggatggctgcttccaagttgtttgcaattaaaggttctgtataaaaccaagccctctgtgtgtcgtgcagcttagctctgcctacaggagccggtgggaccctagagcctgcatggacagcggtggggtgccagcctgccctgctgctggtgtggggttgggtgcagcaggactgtacataagcagctgccacagaagtaacctgaccaggggaaaatagtgtttcttcaaagccaggtgttcaatgtatagatttcctaaattctaggaaagcagagtcagggttttcaactgaatctgtgatttttcgggcttctttattgatgggtcatgctggctaaaagggagactagaagtgttggaggtctgtggatggggcttgtccatgaagtctctaaagctgtgggtcaaatgtgtaaggtcaggacattttagagggggaaagagtattaaccgagttctgcacagcattcgtgacccacagaaggtcacaacacacccatgctgaccccagtgctccacagtaacctggaaggcagcgttcgccctctgtgcgtacacacagcaaccctgtccctcagcactgtcaactgtcttggtagaaaacctcccatgaggtgggagatcgagaccatcctagctaacatggtgaaaccccgtctctactaaaaatacaacaaaactagccgggtgtggtggtgggcactgtaggcccagctacttgggaggctgaggcaggagaatggcgcgaacccaggaggcggagcttgtagtgagccaagatcgcactactgcactccagcttgggtaacagagcaagactccgtttcagaaaacaaacaaacaaacaaacaaaaaacctcccacatttcactccaagtgaagcttgttgatgtctatttataaaagacctggcaatccagacacctttcctcagaacccaaatcaggttcaggaagttgacccatggtgaagggacctggttagttcactgtggcacaaccaggaccggcacagaaacttcattctaagtgtgccttaatataaaaaaaaaaaaaaaacagtagagagcatctgacctggaccctctgcatctcagaaaggtttattatcaactgaaggaggtaacatgtagcctttgctggggacaaagatgtgacaagtctctgccccatcctaggtgctgccctgcgtagggctcttcccaggcccgccccccttgggcagcctggtagcgctgggctggcgtggcatcctctggctggatccctcgtggttgctgcgttccgccagggccaatactcccccgagggcagcgctgcctttgtctctccctaaggagacacaaagcacaatgattaggaatggacgcgccccataaatgcagcacctgctgtactcgtgctccttgggcaacatttgtgtctacacatttccatcaaagtcgcttcagctagaggccctgcatcagccccaagtcctgagactcagaaccactaaagacaggtcacgccccagaagcccttggcagtgtgcaggggaccctttaggatgtgtcctaggagcgaagccacgcaaggagcacactgccaagggaacattttgaaaggacacatgccacgggcccatttagggaaaggtaggtgtggtggtccacacctagcctggtcagcaaacctagtctgccctgatcgtgccatcagcggcagcagcagcagcagggacgcgctgcctcatcctcaaggtgtgttcacgctggactgcacatctgagctgccccagatggtgacaggcaggaagtactgcagtcaccaagtcctggaattgggtttctgattttgattttggaagctctttcattgtttcctacctacccgagtgttctgcagtggtcaagcctcttgctttcgggtttagctgccagattccatgacagggttcctgccacagtctgaacgcttgagactttccttctgaacaccagaggctctctcggatgaagaccacaggttcagagtttctttgatttgtaatttgcttactttactctttaagatagccaagaaaaatctgcaaccacactcgggccagagctttattttaatgggatgcatttccctgggctcagggtgttgacagcatcggcaagactgagaggaccctccaaggtacaaacgtgcccgggtagcaggcttgcccgtggggtcacagccccccatgcggagtgccttggccagggctctcccctgctctggcctggtggggtctgacccgtgggctctaaacagggcgtgtgtcccctgcctgactcagtgttgggtcccccatttcatccccccagcatttcctttgtcctgactgagggagtgccttgaccactctgacctaatcagctacatgttccccctgcaggctcaaaccctggctggggcttgcatgttcccagacactgatacacgtttaggttgttgcctggaacactgaaagatctgacgtgttgctaagcacgtggaaactggtcccaccccagccaaattccttgcaccctcatagaaactccacaccccaccccctcagtgcggtgtgcctaggcacaacctctttcctggctgtccctcgtgagggcacgctgcagccccctctgtatataagctccctaacaaatgctttggactgaccaccctggcattaagtgtttcttcctttggaatcccaactggctctcatcttggaaaggtttggggcagtcccgtgtgggaactcccctgccatcacttttagggtgactccagacaagggttcagccaacagaacacccagcctcaatcctggtccttccctggcctcttatcaagtgtagtcaaataccctgcaaagggaaactggattcctggagaaaagatgcaaccgggtgtctagggacccattaggtcatttgtttcaccatctgtcaccctgaacaagcagagactcctgtgtctgagatgccgtggacccccgctcttccagaggtacctccagctccctttctatgctaataccacaaaattctccccataccctgcagggataggacggccctccttatgagtttccggggagttcttcctcagagaatgagatctttgctcattcttgcctggtggtggtgagggttacagcggtgtcatgctgggaactctgtcagcttgtcacacttggctgaacaaagatggagtcagggttgccctgagccaaggaggagcgcagtcaggaacacgtggtgggtgatgattggccacctcagcccagcagtgactagtgaaaaaggcacaaagcagacaatagccaccacgcatctcttgtggtacaaactgccataattctagtccccactgactggtcaaggggcaaggattctgtcttccatgagcagacgggacccaccaccctgcagcagctcccacactgggccagcatcctcctctgaggccacagtccctctgcaggccaggccagacagtcagatcttctgtagccgcagcctaatctgggtgcttaggtgcccatgcgctctcagctccccacagcacgcagcatggcaggccgtgcacctaggcctgactcagagtcggcttcccttcagtttgccgccatctgagcttcctctcctcccctcagtagtgacccagtcccttctggaaacaaggatgacagcgaagcagaaaagagcaaataatgctttttttttttttaagagtggtgggggaggggggtttagagactgagtcttgctctgtcacctggtctagagcacagtgatgcaatcacagttcattgctgcccggaacccatggcctcgagggatcttcctgcctcagcctcgatgtagctgggactacaagcatggggccacacctggctaataatgcttatctttaaatctgacagggttgacaaaccctggaaatgtgaaaccaacataaccgtaagccataactgatattaagaaaatcctggaaatcttcaggaattgcgtgctctcggggctagtggggagccctgttcaggcctcctcactttatgaaggatgagaaggcccagaatagaatggcctgcagtgccttgcagtggggaaaccagctttgcttagccctgctccctcgggaggggctactgagtcagacgggctagacagtgggattgaaccaagtgtggctgcaggttggggtgtgagggcagggtgactgatgcccctacacctggtccctggagggccctcctaaacgccaaaaacagtcaatgaccactgaatgttaaaaacagcctggctcagcaggggtcagtggctcgtgcctgtaattccagtgctttgggaggccaaggtgggaggatcctttgaggccaggagctagagaccagctgggacaacatagtgagacctccatctccacaaaaaatttaaaaattagccaggtgtggtagtgtgcacctgtagtcccagctactcaagaggaggtgggaggattgcctgagcccacgaggttgaggctgcagtgagctatgagtgtgccactgcactccagcctgggtgacagagcaagactgtctcaaaaataaataaataaataaaaagtaaaagaaaatgcacaattagctcaaatactttaattaatctaaaatatccaacgtattatttcaatatgtagtcagtacataaattattcataagatgttgcattcacctttgttctttttcttgtttctttgtagaaatgggtggggtcttgctatgttgcccaggctggtctcaaactccgagcttcaagtgatgctcctgcctcagcctccaaaaatgttgggattacaggtgtgaaccaatgcccagcctcattcactttggggttttttgtttatttttgagacagggtctcactctctcacccaggctggagtgcagtggtgcagtcacagctcactgcaacctcaacctcccaggctcaagcaatcctccaacctcagcctcccaagtagttggaactacagatgtgtgccaccatgccctgctaatttttgtatgttttgtagagattgggtctccctgtgttgccctggctagtcctgaactgctgagctcaagagatccagcagcctcggcctcccaaggtgtggtgggttttttgcattcccttttgtaccggtcctttggcatctgctgcgcataccacacgcagtgcaatgaccacgccagccatgtgtggctcgaagttcctgtatcaggcagcacagctcaggtgagactcacggcttccacactccaaacgtcatcttacacgcatgctctggacaacttttaaaacgtatagtttccctaaacttaaatataacgcttgactgaatttatttttccctcaatgactccagactctcaccaagacaagcatcgaccctctgtgcttctggggttttctatttccccttccctgtgggtatgagtgaatctggtggtggttgttcccacaggccgtctgcatggctgggggacaggcatccagaggacccagggtgcctgctgcagctcacagaggcaagctcgagagggcctggcccatagcctggagaactcaacacccgagtcctgtgggaaacctatggcctccatgcccctccccccggattactccgacaacccccctgccatatggggtgacagaatcctccaccccagattctgccattaccagggcagctggagctctgtgtggtcagaagctgtaatatgtgggcctcagagagctctcagcattccatctgtggcctctgcctctcactcagcagcacacgtctgccccattcccctccacctcctcctcaggttccactctatccccatggggcctcggtgccctcatgtcgtggctttctgccacccagcctacaggacctgggctatgcttccaggacacagccctcgagaaacaaatgaccctgaggggcccagcactccaggccactcctgtcctcgggtaaattctcttggagcccccattcgctcacatggcaccccctaatcctcctggcccctctatgcctgcatttccagtgccacaacccccacatacatcttgactgtgcccccccacctgcctcctcctgccctgggcctaccagcacctggacagcgctctgcctctcccatgccctcccactgccccagctcacacgtgtggggctctgctgacccttcctgctccaccctgtgtaacccttgctgctctctgggctctgaagcctcctcccaactccattgctagtggtttttcttttcctttcttttctttttttttttttgagacagggtcttgctctgttgcccaggctggagtccagtcacaagctcttggctcactgcaacatccccctcaggctcaggcaatcctcccacctcagcctcccaagtagctgggaatacagatgggcgccaccaccacgcccacctggctagttttttttttttttgagatggagtctcgctctgtcacccaggctggagtgcagtggcgcaatcttggctcactgtaagctccacctcccaggttcacgccattctcctgcctcagcctcccaagtagctgggactaaaggcacctgccaccatgcctggctaattttttttttgtatttttagtagagatggggtttcaccgtgttagccaggatggtctcgatctcctgagctcgagatccgcccgcctcagcctcccaaagtgctgggattacaggcgtgagccaccgcgccgggccctgcctggctagtttttgtattttttgtagagatggggtcttgctatgttgcccaggctgatcttgaactcctgagctcaaggaatccacctgccttgacttcccgaagtgctgggattacaggtgtgagccagcacactggtctcactggtggttttcctcactgcctctcactggactgagtgtgatcatctcacttccctgccacgccctctgccctgagagctaggcctggcacccagagccctgagtgagtgctaagtgagcagcaacatctcctggagtgacaagaactctgttcccagtttctccctcctgctggacacttgcccctcaattgctcatctcagcctgcagtccatacacccctactccaggcctgtccttcaggccctctccaccctctcttgggcctgagctctgggtggcagtgaggtggccgctgtcaggaggctcatgcaggaggcgcgaccaaagacccctgggctctcacaggcccctgatcacacctggtgacacctggaaagtgtcccaactcaggagtgaggcgggcaagggggctgagtgctggagtgtggccatgggaccagcacatggcatctgtgtggcactgcctggcagactctgggaaggtgggagtctctgtttcagcctccagacttcctgtccaggtaggggacaacttctaagaggccgaggcgtttgtcacgcctggggctgtgctctccagcagagcacactgcacccggctggctgtcttcccctggagaggggctctttacactcaccactagttcgcctctggggtgtggggatgttggtcctgtccccggatgccagcccgactgtggggtctagagactgccacaccatgtctctaataaaccgagtcagaaatagtgccctgtggctaagcggcagggcagcggtggcctgcatgatcctgcccttgcagctcaaagctgcttgggcctcttggggccatgcagtttccatgaaaacaaggaagagcaccaacccccagagataagccaataaacgcaacctgcaaaaggagagaacaggcagcaagagaggcggagggaacccggggggcctggagagagaggtgagtgtgtggcagctgggctgtggagcataaccagagaggccgcaggctgcgggctggaggaaaacgagggccttgcaggggggctactgttcctggcagagagaaaggaggcctctggaggtcagagagagacacaaagagagcagacagagcgagggtcagtgaagaggccagcacgcaggtgcccgggccctcttgggtcagcgggcgtgggtgcccaggccctggcacttcccccatgaaggcagcctgctttccacgccttctcatgatgcctgtgagggtctcctcctgcttccaggcagggagccagctctgggcctccttccattggcctgggaggttgtgctgcatttcagagagagccatcgggagcagaagcaacatgcggagaggatgagcagggacggaggctccaccatgacactctcagtcccagcatctcctcagcccagtcaccacactggagagggaggaggcccttcagaccccgcaggcctctgcaccctgggagttccgcgtctaactctcttcctgcaatcatcagaggcaggaactgggcccaggtggggtaaaggcaggaagacgtctgcctgccctgctccctgggcacttccctggatgctgtataccacaggacagagatcgagactgtcttttgaaaaacatttagagacaggatctcaccctgtcacccagactggtctcaaactcatggcctcaaaggatcctcccgccgtggggtcccaaagattataggcgtgagccacggcgcccagccccaaaccgtcttgattcccgactttgtaggatgaaggcctgagtgaagaggtggggaggagctaagcggaggagccctacccagcctggaccaccctggggcacgcactctgcgtccacctgacctggacgtgcctcctaaggctggcagcgaagcccaggagcagagcccacggatgggccctgcaggtgctgggcctagaccgaccgacagacaggcctggccactcagggccacgccgccgctgtgccgcgcctgccccctccccgcccgccacccccgccactggggcagggacagcgggcccagctctgacctcgggtctcgggcacgctcgacgtgggcagagacacggccgcagggtcctggggctcgctcgctagcctctgcccggcacacatggacttgagcatctggaagacggcgaggggggccacgttcagcttcagcaggtccaccaggatcctggcggggacagacgcggggccggtgagccctctccgcccggcgcggccacctccctgaagaccggacaaggacgggggcgggggcagcgggggctcctcccgaccagcgggccgggcgtacccggagagcagaggtcgggggtgtctggcgagcatgcggcccccacccgccccgctcacttgaacacgtcggggtcgataccgccgcccgccgcctgagccagctcgtacagctccatctcctcggtgctcagcaccttcttgcgccgcagcgccagcttctgccgggccgcctccagccccgggggcgccgccgaccccggcccaggccctacgccctgcgccgccatccgcgaggcccgccgaaaggtgcgccccgccccgccgcgccccctagcggatgcgcccaccgccctctccctgcagcgccagcgtctggcctcccgggctgccctggcgggagcggcgggagcgcggggacggggccgcctcctcggcgtcattggagcccaacagttagtgggcgctcacggtgtgctgagcggcgcgctaggcgtcgggagtggcatggcggactgcaggggccagctgcttggcggtcagggcgtccctgatagacttgcattggtcgtgctcgcttaggtggcagcacccagcccagtgccaggcatacattgggcgctcagtcaatacctgtttcaagaaagcgtgcaattttctggtccgcaccggtgcaccactaggggtcgctcttcggggggggtggggggcactaatcaacaaccctgcttacgcgcacgcgcattccttgctagggagaaagtgcgtgagccctaccttggggcgccagaggccgccacaacgcaggcgcattcagctaaggaccactccctccccccgcactcctgcctcgccatttcccctccctggccggccggccggccttcttcgctttgcgcacgtaccttttgaggtaacggcccaaagaggtagaagcgcttttcccgcccggccgcggggcgtggctctgcgcgcagcttgatgacgacgttttggcgcggtggcggaatggcggcttccacctctgaagcgggcgacgctatgggtcccacaggtgagtggcgcgggacgcgcgcgtgagacggtccgacgccctgggggcttccgcgagcccctgcggaggccatctccgttcctccgcgagccccaggactcgggcggcccggcggctctgcccaggccgggcaggctggggagtggagggccccggctgagtcttcctgccactcctctgggccatgcctttgtgccaccttcccgcgccgctcgtacactctgttctggtccggtaggtgttcgttgaaggttacccgtcgttgaaggaattgagggaaggagagctttgtgttgaaattgagccttgggctcaacaggcggtgtgggaggaagagccgggtgtgggtcccagctcgacccttcccctgtgcgctccacatctccgagccttggtttcggaggctcccgaagcccaattcgcaggagagttggaaacaagtgggcgcgtgctgttaagggaggtcttggcatgacagaatttgcttggaatgattagcgttgcccaagggctgtcgctgtcagaaaaacaaaacaaaacgaaacaaaaaaaacaaacgggtccgaagcagctcctggagaaaataggtgttggagagtcgcgacgaagtggactctaggtgcatggcacgcagagacctgtgacgggggagggtggccatggcagggtcagagaacaggggtgtgggagacacctcttgggagttctcgggtttgaatttcctctcttggaaagttcctagaaattcctctgggcctcattctttcagtcgctgcccatgaaagcttttactgagcagagatgctctccccttcatcatctctagagctccgcacttatccagcagtccacagtttaatgctgctttgatcattttgcagtagtgcagtgttttcttgaccaagtgcattaggactgaggcgtttttctttaacactgcaattgatagctaggttaagaattgaggccgggcgcggtggctcacgcctgtaatcccagcactttgggaggcccaggcgggtggatcacgaggtcacgagttcaagaccagcttggccaagatggtgaaacctcgtctctagtagaaaatacaaaaattagccgggcgtggtagcgggcgcgtgtaatcccagccacttgggaggctgaggcagagaattgcttgcacccgggaggcggaggttgcagtgagctgagatggcgccactgcactccagcctgtgcgacagagcgcagagcgagactccgtctcaaaaaaaaaaaaggaaaagagaaagctggccgggcgcggtggctcacgcctgtaatcccagcactttgggaggctgaggcgggcttatcacgaagtcaggatatctagaccatcctggctaacatgtgaaacccactctactaagtaaatacaaaagacaattagccgggcgtggtggccggcgcctgtagtcccagctactcgggaggctgaggcaggagaatggcgtgaacccaagcggagcttgcagtgagccaagatagcaccactggactccagcctgggcgacagagtgagactccgtctcaaaaaaaaaaaaaaaaaaaattgaaaaaacttgggagatgttcctattgccaagtggcagagaggcagagattcctgtctcctctcactctacaactgcctacatggcctctttacacccagcctctcttcctccacagactgccaggtgccaccccagtgccgttacttgtgcagtgggcagagctgggccaggaaaactgtaactaggccaccagtgggacttggcagacttcctgtctgtgaagtctaggtctgagcattttttatttttgacctgggtgagctgagaggtaggaatctggaaagctgatcttagttttctttcctttttttcttccattttttgagacagagtttccctctgtcaccccggctggagtgcaatggtgtgatctttgctcactgcaacctccacctcctgggctcaagcatttctcatgcctcagcctcccgagtcgctgggactacaggtgcccgccaccacacccagctaatttttgtatttttagtagagatggggttttgccttgttggctacactggtctcgaactcctggcctcaagtgatctgcccaccgtggcctcccaaagtgctgggattacaggtgtgagccatggcgcccggcctttgatcctagttttctgatggcttattcaaaggctcccttggcagagcttgctcttcccctccgttcattgcatagtgcacgggtaatatggaggggatttgcccctgtctcagttttgtgaggcggtctttgtattggaatcttggttctgccacttactagctgggtgggggtaagtgagttatcccatttctgcctctccttcatcatctgtactgacttgcagtcatagtacatctgtacccatcgggttgttgtgaggttggtttttctattcttgtatgacaaacttagcagtttaaaccagcacccatttattatctcatagttatgtgtgcagaagtccaggcaagctcagctgtgcattacaagattaaaaccaaggtgttggcagctttgctcttatctgaaaactccagggaagaagctgcttccaggtttatttaggttgctggcagaatccagttccttggagttgtagaactaaggtctttgtttccttgctggctgtcagctggggactactctgtaacttaaggtcccctaacttaggactctaattggatgtgcaaaatgccatcacagcagtacctagatgagtatttgattgaacaaacaggggtcgggaatctcgggctgctatctttagaattctgcctaccactgaggattaaatgaggagatatatagagagcatttagagtgagtcctggtatataacaaatgctgtacaagcattaccagggattcagtaccacaaacttggctctgaagctggccactatgggctgcaggagaacagtgtttcttttttttttttgagacagagtcttgctcagccttctaggctggagtgtagtggcgtgatctcagctcactgcaaccaccttctcctgggttcaagtgattctcgggtctcagcctcctgagtagctgggattataggcacccaccatcatgtccggctaatttttgtattttggtagagacggggttttaccatgttggccaggctggtcttgaactcctgacctcaggtgatcctcctgcctcagcctcccaaactactgggattacaggcggaagccaccgtgcccagttgagaacagcatttgtataaaagatgggaattgctggccgggcgtggtggctcacgcctgtaatcccacattttgggaggctgaggcggatagatcgcttgagtctgggagttcaagagcagtctgagcaacatgatgaaacccccatctttacaaaaagtacaaaaattagctgggcttgttgatgtttgcctgtagttcccgctagttgggaggctgatgcaggaggatcacttgagctcaggagtttgaggttgcaatgagctatgatcgcaccactgtactgcagcctgagtgagcaagcaagagcctgtctctaatcaataagtaagacatgagaattggcaatataatgtgtgttgcaaattggtaatgtaatgtgtgatattctcctgggcattgtgaaactatgtaatattttgttagggccaggtgcagtggctcacacctgtaaccccaacacttaggaggccaaggcaggaagatcagtggaggccaggatcctgggcatcacagcctgacaaactagcctgggcaacatagcaagaccttgtctctaaaaaaaaaggaaaattagccaggcatagtggcatgtgcctgtactcaggagactgaggtgggaggattgcttgaacccaggagtttgaggttgcagtgagctatgatcgtgctgccgcatgccagcctgggcaacagaacgagaccctgtctctaaagaaaaatataaaaagattctgctgtgttgcagatgttgagattttgtctttgtttttccacagtggtttgctaagaaggccattttcaactctccattggaggctgctatggcgttccctcacctgcagcagcccagctttctactggtaaatatcaactgcttgcatgagtgtcattgtggtcatagttctgtagctgtgggacttgagtgttcttcccattgacttgaagaactctgtagtggttgttttttaggggcatgtgatggaaacaatggcagactccttaacttgactgtgcctcgttattactacaggaccttggggttactcaacctctgggctctgggttttctcatgcaagacaagttcattcaaattctattttctctacttcccaagggtatgaggaggaggagcaagtgagaaggatgtatatcagaatgttcataacttgtaaattcttaaatagatatgaagcattctaataatcagtcataactgtcatcagtgaaaaatggagacactgttgtgcggggggctgctaggttgcactttaagtattaaacatgatgctgagaactgggtgcagtggctcatgcctggagttccagctactgaggagactgaggcaggaggattacttgagcccaagagtttgagaccagcctgggcaacatagtaaagactcaaaaaggaaaaaaaaatgatactgagaagtgagaagttagatatgaggcaagtattggtgatgaaagttcctaattttagttcttaggaggtgtttttgtaaacatttatgtggaaggacattcttcctcagtgcaccccactagagtcaacaggtctggcccatggccagacagctcaggtctccatctctgtctcaatcactgtgaaatccaccctcgtttggaggtagacaaggccttagatatcctttggcaaagctctctaggttgaaattctagctgtttctcctgatcttaatccattcgcacagacgccctttttctccttgtagtcagggtgctttcctcacatcctacgactaggtagatttcattagtccttgtcctgagtcttttctggcctctccattgccttcatgattagtgtctacttggctgaagcggtctgtaatttttgtctgccctgtgttttaagatcattggtttagtaggttcagtgtctattgaataaaggacagctcatttaagagagcttctgccatagccgtgatgttgttgggcgttcttactgatgatcacaacggtgtaatcacggtggtccatcaggctggaaatttccagttgatgcgtacaaactcagtggtactctgtggcttgtgaggggtgcccttacacaatcaagatcctcttctggctctggggctgactctgggatcagcccctacttatggattggtagaagtcaatcctgttctgatcatgtgcagcactctgagggggtactgggaaacaaggctgatagttcctggtccagagagcatagaactacggcctctcctagtagtactctttgggccactgacacacatgaggggctggggaaccaggccagtggttatgggtctgactcataacctattgcttggatttctgtttgactcaagccagagtttgactcaagccagagtatcactaaaagctgcagagtgaatgtcctcgtgactttttcgctttgttctgttttctaggccagcctgaaagctgactctataaataagccctttgcacagcagtgccaagacttgattaaagtaattgaggattttccagcaaaggtatagctctgctaatgtctctctttggagcatgtcttatacattcgttgaagaactttattataattcctaatttccctccccgccccaaccccgagcactgcctggcacagaggcctggccattatcatgaccattatgtttatggacacatttaaacatgtgaacttgtagatcaggggttcttagccacaggtgctctgtccctcaagggacacttggcaatgtcagagacatttttggttgtcacatctggaggtagatggggagtgtgtgctactggcatctaggaagtagaggccagggttgctggaaacattctgcaaagcacaggacagctccctgcaacaaagaagtatctagcccaaaatgtcaatagcaccaaggttcagaaaccctaacgtaaatactaaaaatatgtatttaaatcacacctggaattgtcaagcccaggaagctggcctagacaaggagttaataccaaatggcaataggtcagttaggtttcaggggcttcactctggaaaggatgttgctttcctttctgatagagcatccttcaagtcagaagtttccatctctttttaaagaatctttttttgtggtggctcatgcctgtaatctcaacactttgggaggccgaggtgggaggatcacttaagcccaggagctcaaaaccagtctaggcaacatactgagaacttatctctacaagaaatttaaaaattagctgagtgtagtggtgtgtgcctatagtcccagctactcaggaagctgaggtgggaggattgctcgagcccaggaagtcaaggctgcagtgagccataattgcgccactgcactccagccagggcaacagagtgagaccctgtctcaaaaaatatgtattttgtgtatttttttattttatatattttaattttcttcattgtttatgtttgtttatttttcttaatttagtcttctatcacacacaaaaaatgtattttgattggaggctgacttacttagctggcccaagcctaaagcaacactgcttggtatgccatgtaccccattggaagaacccaaagctgctcttgtcgttggcaccatggcaccagggttcctttgggtgcagggctgatctcgtaggtctcagccagggagtggcctcctcagaaggagctgggcagcaggtggtgcaggactagagccggggcaggaatgggtgctggtcctgcccgcggcctcaccacacattgtttcaggagctgcacaccatcttcccatggctggtagagagcattttcggcagcctagacggtgtcctcgttggctggaacctccgctgcttacaggggcgtgtgaatcctgtggagtacagcatcgtgatggaatttctcgacactgggtaggtaggttggtcaccggagagaggctgggtgattcctcatggtgattccacctttaaaccactctctgaatttcttaagattaagaaacaatcaaagcaagataattcacagttcatttgccctgtttttgtttgtttgttcaatttcatgttcagtggcccaatgatgaagttggtttataagcttcaagctgaagactataagttcgactttcctgtctcctacctgcctgtaagtaaaccacagtggcgagagtggtgctcggggcagtgggccttgcacagccctgtggtgatgggcaatctcctccagtcctctgagggcaaattgaggagcgattcgttccaggggtgtgagaggcaaaggaaatgggtattgcatgactgctacccttgctgtctgcagctttttatgagatggtaggagaagttctaagcaaagactcttgttcaggcactgctcagaggcagggcactgtccccacaggtgggttctgtgtgtgggtctcttccccagcagccttcccaaagtgctgctgtgcatgtggggtactgcgtatcgggcactacgcaccagcacctgcccgcaagcctcactgcctctctctgcagggtcctgtgaaggcgtccatccaggagtgcatcctccctgacagtcctctgtaccacaacaaggtccagttcacccctactgggggccttggtctgaacctggccctgagtatcctttggtggccctgaggtagggaggctgtgggtggcccagcacttgacacttgcggggggtgtggctcatcaaccctgcgtgtttgcccctgacgctgctctcagatccattcgagtattacatattcttctttgccttgagcctcatcactcagaaggtaaggaagggatgccttttgctgggagaggtggggccacggcccagggcttccctgcacttgttggtgcttggtggcctggcagtgtccagagcccacgctaacaactagcttggttttccagccactccctgtgtccctccacgtccgtacttcagactgtgcctatttcatcctggtggacaggtacctgtcatggttcctgcccaccgaaggcagtgtgccctgccactctcctccagcccaggggggaccagcccctcaccgcctcccaggtaaggctgccctttgttaagacctggcccttccataagggagtggcctggtcacttgcatcgcccacggggacaatgttgccaccctttgtccacggttccccaatttttcttatgcctcattccccacccccagctgtcttagcacagactggagggtggggtgtggcgggcaatctgtccttagtgttcagtgtctttggccatcactgaagctatcaggtccctggaggcctccacggcctgcatgggaatgggctgtgttgtgcatggagcagctctccccacaggcagtgtctgaggcagtgagcagggtggaaaggttgtcctatgagcaaaaaaaatggaaatctctatgggcccctggagcaggtcttgaaggggaggccctgggccaaagagcctgttttgccagtccaaacaggctgagcctgatgcgtgcctgcacaggtcgggagtgtgaaccaggggctctcatgcctggctgtcctgggtcctcagtgggcactaacgcagggcctcttggccgacttcccaggagaccctcttgccccagcatcagctgcctgtgcacctctgaccctccttaatctcactggcctattgccttccccaggaagctgcatgcaggccccttcctgcaagtgctggcccaccccagatctgctgtcatgtgtaaggcaggccaggcctttacgtacaattcacgtgtggacagattccccagagggtggaggggagaaagggagaggcagggaggagatgctgcccaggtggcggcagtgatcagtgaccctgaaatgttgctgatcctgtggaggacttggaggtgaggcagattcacaccctcttagatgcagaattcagccgccaagcagtttttgatgcctggttttttttgtttgttttaactttttgcgttttttattttaattttttcttttagaaatcgtatatgtgggctgggagtggtggctgacgcctgtaattccagcactttgggaggccgaggtggagggatcgcctgaggtcaggaattcgagaccagcctggccaacatggtgaaacctcatctctactaaaaatacaaaagttagctgggcatggtggtgcacacctgtaatcccagctactcgggaggctgaggcgggagaatcgcttgaacccaggaggcagaggtcatggtgagctgagatcacaccattgcacgcgcacgcgcacacacacacacacaacacacacgcacacagaagagatcacatacgtatggtttgggtttatttatttattttattttattttatttatttattttttggagatggagtctcgctctttcgcccatgctggagtggtgcagtggcacgatcttggctcaccacaacctccgcctcctgggttcaagcgattctcccacctcagcctcgcaagtagctgggattagaggcacaggtcagtgtgcccggctaatttttgtatttttagtagaaacggggtttcaccatgttggccaggctggcctcaaactcctgacctcaggcaatccatccacctcggcctcagcgaaagtgttgggattacaggtgtgagctactgcgcccagcattttttttttttttttttttttttttgagacagggcctggctgggttgctcagcctggagtgcagtgttgtgatcacaactcacagcaacgttaacctcctgagctcaagtgatcctcccacttcaacctgccaagtagctagtactataagcatgcacccctacacctagcttttattttatttttttgtaagatgggtcttgctgtgttgcccaggctgctctggaactcctgggctccagcaatcctcctgccttagcctcccaaagttcagagattacaggcatgaaccaccgtactggtccattgtgggcttttgtttttttttttgacagggtcttactctgttgcccaggctggagtgcagtggcgctgtctctgcttcaagtgattctcctggctcagcctcccaagtagctgggactacaggtgcctgtcaccacacccagctaatttttgtatctttaatagagacagggtttcaccatgttgggcaggctggtcttgaactcctgaccacaagtgatctgcccgcctcgaccccctaaagtgctgggattacaggtgtgagccaccgctcctggcctagccattatgtatttttaaagacagtcttactctgtcacacaggctggagtgcagtgtcataatcatcacttggtggcacaatcatcactcaagccagcctgtcacctcagtgcatcaccacagccagctaatttaacttttttttttttttttttttttgcagagatatggggatgcctcgctgtgttgcccaggctggtcttgaactcctggcctcagcaatcttcctgcctcagcttcccaagtagctggaattacaggtgcaagccaccacacctaactttttattttgaaataacttcagacttacagataagtttccacacataataaaaataacttgtaggccgaacacggtggctcacgcctgtaatcccagcactttgggaggccaaggcgggaggattgcttggggccaggaattcgagaccagcgtgggcaacgttgggagacctcatttctacaaaaaaaaaaaaaaaaaaaaaaaaagccaggtgtgatgatgtgcaactatggtcccagctactcaggagactgaggtgggaggatcacttgtgcccaggagcaatgagctgtgagctgtgagtgtgccactgcactctagcctggggtaacagaacaagatcctgtctcagggaaaaaaaaaaaaaagaaactttcatagacccttcacccagatttccaaattgttaacactttgctgcatctgttgttttccacctctattgtatgtgttttttttctctaagccaataggagtaagctacaggatatgacaccccttgacctcttaatatttcagtgtatttcctagaagcgaatgcattatcctatatagtcacagtgcctgtaaccacaccaggaagttagtattgccaccaggcctcacactgtgtgcagtgatgtttcacaggctcacccactgtatatagtgatatttctagtccccttcagtcaggaacggtcccttgcctttctgtctttcctgaccttgacccctccagagcatgtggccgccccttaggctgtctggtatttgctggtgactaggcccagcatgggctttgttgggaggagcaccgtagtgggacacctggtccttgccaggtgcccttttatcaccgggttaaaaaggtgccggtcaggtttttccattgtaaaataattactttgtgcccagattaaatagtaatgaggctgggcgtggtggttcatgcctgtaatcccaggactttgagaggctgaggtgggcggatcactggagctcaggagtgtgagaccagctcaggcaacatagcaaaatcccatctctaccaaaaatttaaaaataaccaggtgtggtggtgtgtgcctgtaatcccagctacttgagaggctgaggtgggaggattgcttgcacccaggaggcggaggtggcagtgagccgagatcatgcccctgtactccagcctaggctacagagagagaccgtatctcaaccaaaaaaaaaaaaaaaaattaatagtgagtgcctgggcaacatagcatgaccttgtttctactaaaaagaaaaacatcagccaggcatggtggtgttggtcccagctacttgggaggcctaagtctaggaggttgaggttgcagtgagctgtgattgcatcattgcactccagcctaggcaacaggatacgatcctgtctcaaaaaaaaaaaattgataatgagaatttaccaggaagatgtatggagaccatgtaattatcagtagtattaacatccacttttgattctcccctttattcaaattaattttatttgcagacagggtcttgttctcttaccccagactggagtgcagtggtacgatctctgctcacagcaacctcaacctcctgggcccaagagatcttcccgtctcaaccccccaagtatctgggactacaggcaggcatcaccacacctggctaatttttatattttttttttgtggagacagggttttgccctattgcccaggctggaaatttcttaattatttagaaacagggtcttgctctgtcaccccaggatggagtgaagttggtacgatcatttgtcactatagcctcaactcgtgggcccaggccattctccctcctcagccttctaagtagctagtactacaggcacatgccaccaggcccagctgttttatgtttcaatgtttttgtggagatgggttctcactttgttgcccaggctgatctcaaatgcctggcctcaagtaatcctcctgccttggtctcccaaggtgctgggattacaggtgtgagcccccatgcccaacctcactattgattcttgaccaaatcagctattaatagggcggttaccaagtggtggttctctaacttatccctccttcattgattagtgggtcagtggtcactctgcggtaaggaagacttctctctttgctatttatttattcaggtatatcagtgtggatcagggggctgggggggaggtatgcattgtgctattgaacaagttgtaatctctccctgctctcgttgattttgatatccagattgcccctggctaggccagcgggagcctgtaaactcgggcctgtttctgtgtctccctcaggacaccaaccatgccctttgcttcctatggcctccaccacactagcctcctgaagcgacacatctctcatcagacgtctgtgaatgcagaccccgcctcccacgagatctggaggtcagacactgctccaggtgagagttgagctggtcaaaagaaactgttcagccagctgggcatggtggctcatgcctataatccccagcactttgtgaggccgaggtgggcagatcatctgaggtcaggagtttgggaccaacctggccaacatggtgaaaccatgtgtctactaaaaatacaaaaatgagccgggcacggtggcaggcgcctgtaatttcagctactcaggaggctgaggcaggagaatcacttgaacacaggaggtggagacagcagtaagctgagatagtgccattgcactccagcgtgggtgacagaactggactccatctcaaaaaagaaaagaaaagaaaaaagaaactgtttagccaccttccactatgtggggcagagtcccagaggcggcccctcagcccggggctgattctaaattgttggtattttcctgctgtgacatttagaaaacatgaaagtaaatctgcccacccttctaacttgtatgtcattgatggcgtttttcatcccaggatcccctgtccatggaagttgtttcgttttgcctgtggtgaggcaaaattgttgcagaggcttttggtttccatgacactgaatggtgaggggtctgtgcagcctccacaggccttccattgattcaggggatccaagtagtaggtgacagatttccttgtctgcccagaggggctccagcctgtcaggatggtatgggctggctcacttcctgagtgctggtcagctcccaggtcctggctgtgtcttctaggcacacatcagagagattcagcaggtgccgcttctgacgctggatcctggggctgacttggtagccacagccttgcttttgacagcctgacatgtagataagataggattctatctcccatcttgtatataactcctagtatttggggtgctacactttttgaagcctccataccgtttcacagcatcctcgcagggtggaatggtaagaaccgttgcccctgttcacagaggggaccatgatgcccagatggctcttggctgtgtagaccgtgggctgtgctggccatgaagagggcagaagatcgtgacacagggcttatagggcagaactggaaggttctgctgttccctggaccaaagcatttttttttttttttgagatggagtctccctctgttgtccaggctggagtgcagtggcttaatcttggctccgtgcaaccttcacctctcaggttcaagtgattctcccgcctcagcctcccaagtagctaggattacaggtgcccactgccatgctcagctaatttttgcatttttagtagagatggggtttcaccatgtctccaactcctgacctcaggtgatccacctgccttggcctcccaaagtgttgggattacaggcgtgagccactgtgcccagccctttttttttttttttttttaaatcagagtctaactttgttgccaggctagagtgcagtggtacagtcttggctcactgcagcctcaaactcctgggcacaagcaatccttccacctcagactcccaagtagctgggattataggtgtgatgcctcaccacacccagctaatttttgtattttttgtagagacagattttcactatgttggccaggctggtcttgaactcccagcctcaggtaatccacccaccttggcctcccaaagtgctgggatgacagggttgagccaccatgcctgttggttgcctttttactctatcaatagtattttttcatgctcaagagtgttgattttaatgaagtctagttgtctattttttttcctttttgttgcctgtgctttgggcgtcatatctaattaatcattgtcaaatctagtgttatgaagttttctcccatgttttcttctgagagtgtatggttttagtgcttatcctcaggttgcttacccattttgagttattttttggcgatggtgtgaaggaagggcccagcttcgctgttctgcacatggaatgagttcccagctctgcttgttggagacactgtcctttccccactggatggtctggcaccattgtcaagaatggtttgactagctaatgcttttttgcaggtttttgttgaaatgtggcttcatcactattcgttggagatgtatcaaaaaatgcagtcccctcatgccaaggtatgtttccacagtttttcttcccacctcctgcttctgaccctgctcagcctgctgcttcttatcctgcctcggagtgagttttcacaggctggatggtgggaagcagaaacccaccacccacctgtcactcagaagccgagtaagaagtgggcatcattctctagtttccggtggcgggcagggggcattgcacactgacgtgtagacacttgaggcctggaagtctggcctttccggggccctccctgtgcagcttcctgagccccctccctggcagcgggaacagatgaggttgtggtgctcttgctctgggggtggggggagctgcaatgcctctgggagcc

SEQ ID NO: 325 - DNA, 4469 bp, Homo sapiens
gaaggggatgaaaccagggaagggcataaccagaactttaaagatataggtaaggttctatttttcttaatctaggtgctcctcattacttatgcaaatttctgcagccagcttgaatttctcgtcagaaaatgggtttttcttttctatcgcattgtcaggctgcaaattttccaaactttcatggtctgtttcccttttaaaaccaagtgcctttaacagcacccaagtcacctcttgaatgctttgctgcttagaaatttcttccactagctaccttaaatcatctttctcaagttcaaagttccacaaatctctagggcaggggctaaatgctgccaatttctttgctaaaacataacaagagtcaccattgcaccagttcccaagaagttccttatctccatttgagaccacctcaggctggatttcattgtccatattattatcaacattttggtcaaagccatttgacaagtctctagagagttccaaacttccctacattttcctttctttttctgagccctccaaactgttccaacctctgcctgttacccagttccaaagtcgcttccacatttccatttatcttttcagcagcaccccactcctggtatttactgtattagtccattttcatactgctgataaagacatgcttgagactgggaaatttacaaaagaaagaggtttaatggatttatattttgacgtggctggggaggcctcacaatcatggtggaaggcaaggaggagcaagtcacattttatgtggatggcagcaggcaaagagagagcctgtgtagggaaactcccatttttaaaaccattagatctcatgagactcactcactatcacgagaacagcatgggaaaggcctacccccatcattcaaccatctcccactggattcctcccacaacatgtgggaattatgggagctacaagatgagatttgggtggagacacagagccaaaccacatcacctccctttttcccaagcagaggagtccctccctgtgaccaccaccatcctaggcccacagtgagtactgcctggctaccattgatgttcactcaaggcccatgggctcttcagtcaacttgtggtgaatgctgccaggcctgagactctcccttcagggaatctggcccccttccagcccaaagcaggtccagaaataccatccaagagccatgtcctggaataaggaaccccaagagcctgcttggtgctctactgcactgtggcctagctggtgtctaagctgcaagacaaagtccctcttccttctccttttctcaagcagaaggattccctccctatagccaccacagctgggaatgtggctgagttacacctgaagtgagctcgcctgtgagtcacaaccaaggtccacggcaattactatctgggtattgctgctgattattgagggtccaagtgctctttagtcagaaagtgataaatcctgctaggactgggtcctttccttcaaagcagcaggttctcttctggctcagggtgtgtctagacatgtcatccagaaggtaggacctggaatggggacctcggaactctacctgatattctatcctactgtgattgagctgatacccaagttgcaagacaaagttctctttactcttccctcttctctcctcaacagagggaaggagtctctcccagagctgtgagctgcactgcctggggtttggggagggatggtgcaagaactcctttggccaccccagctgatgtttcactaggtctcttgtcttccaagttcagtgggtctgagcttagcacagcaccaggacttgccagggaattgcagtccttgtggcctagactgcctttccagtttatttaggacctcagagtgccttggtctgcaatggcaaggcttgttggaactcaggttctgaccactgggatgggcaattcccctctggctaggactgacctaaatgctccctccagcagcactggctggggtctacccagtcttgctttctgcagtgaaaagcagcactgagttccaatgcaaagacctacaatcactgagctcaccttcccctaagcacacagattctctgacccacacaaccactgtcaggggttgtgtcgcaagtcaagaatgcctttcctacccgcttcagtgcctctttcagtgatatgaggataaaaccaggtactgtgattgctcatctgattgttggttcttataaaggtgctttcatgtgtggatagttgttaaatatgacatttctgcggagaggacgattggtgaaggcttctgtttggccatttttcaccacttcccctcacatgtatgtttaagtattcttttgaatgtacgaataattttacaataatagttggaaaaagagtaggcagggcagagtagcatttagagtttggtatgtgtgtgtgaagtgaatctgtctctaggaacatgaagagatttaagcctgatcataaccttcatattgaagtacaattgatacagcagagcacttcttcctctgcttttaaatacatgatgtttgtcacagacttgcaatccaaatggatgaaggtgacccacccttctggcgaaaaaattctttgaaagctcatgtctataatcaccacaattacagctgcttccaccactgctactaccttcaccaccatcttggtatcattcgtttgttttaaatgctctcatgtttctgacattttactcagtgttttattaatattattatctttattaatcctcaacaactagtgagctagatattattaatcataagatcttctggggtaaggctcagcaaagtgaaagaactaggcttatcactgctagtaaatggcagttcttgggttcaaatgcacaccagttggggtccaaaatgttactttttaacgtcacatcatactgcctaatttcaaatgcatatattatactgtcaccccttcagtgacaataatgtgtaccatgaattctccaaagtaatattcataaggatgttttaaaggagtagcagcaaaagaacagactgaatatataactgattaatgacaatacttctgagaggttggaagatgagacatagagaaaagatgcagaacattctgaaaaattgagggcgaaaggacagaaacagagtaagacaaattaaaaccagggaaataggcaggaaggggagaaaaagaatcgggagaatgaacagaaaataataagaccatcctaaagaatttattttttcttttccccagaagcctctttcctcaccttggaataggtgtttcatcttttgaaatgagttggataaataagaagaaaaggttgaaaagtaatttcaagtccacagagcgaaccctaggatagattgcttttcccttgcaagcctttcatccagaaaactttaaggtcttatggttttggcaataattataacagtaatcataatactgcctagctggtgttttccccttggcagtatgtctgtaccaatcagtttggcaggataatatcttcaagttcacacactaatttgcatgaatctgtttgttagtctacaaaagtgagggctctttcatgcccttggaccttagtgtacttggggctgtctatcttggacatttgtgctaatgaggtacttttaggtcagaacgaagaagttcttgcttagacttattatgtacatttgaatattttagctatgcatttgaatgtatatatcacagatatatgtacaaatatctgtggggtgtgaaaattcagattgttagggtggaaatgtgacacttcgtacttgcaaaaaatctttaaaaataggatatttacctacttattaaaacagtaattttggtaatgctggttagcaggtggagcgcacgagagaacttttcttccactgaattctgtgacatatatgttgtcatgagacctattattgatatgtgttaggggttttttatagtaatcactggacattacaattcatttaaccctcttaatgacttgttatgggagctgaggatgggagagaggaaggtgacagacagagtaatgggaacaattcattcagcttctccaaggcatgccagggcgagaaagttcaagtgctgattcagattattcagaggtataaggattaatcctagcatggataggcagcgcatatagggctggaggagaagctatggaactgtgatcctggagtgatgaaagggctataaaacaggtttcttacacttccttttgaaagttcaaaaattgtgcctgtacaattaatgaggaatacaatatgactagatatgcctgtacatgttgttgtttgttccattaaaagtttcataataaaacagagatccaaaacaagattatgtatttatgactatactggcaagtaaaacttttgttagaacttcatgataaagcttttaaaagggctttatcttatctttaa

SEQ ID NO: 326 - DNA, 5995 bp, Homo sapiens
gaaggggatgaaaccagggaagggcataaccagaactttaaagatataggtaaggttctatttttcttaatctaggtgctcctcattacttatgcaaatttctgcagccagcttgaatttctcgtcagaaaatgggtttttcttttctatcgcattgtcaggctgcaaattttccaaactttcatggtctgtttcccttttaaaaccaagtgcctttaacagcacccaagtcacctcttgaatgctttgctgcttagaaatttcttccactagctaccttaaatcatctttctcaagttcaaagttccacaaatctctagggcaggggctaaatgctgccaatttctttgctaaaacataacaagagtcaccattgcaccagttcccaagaagttccttatctccatttgagaccacctcaggctggatttcattgtccatattattatcaacattttggtcaaagccatttgacaagtctctagagagttccaaacttccctacattttcctttctttttctgagccctccaaactgttccaacctctgcctgttacccagttccaaagtcgcttccacatttccatttatcttttcagcagcaccccactcctggtatttactgtattagtccattttcatactgctgataaagacatgcttgagactgggaaatttacaaaagaaagaggtttaatggatttatattttgacgtggctggggaggcctcacaatcatggtggaaggcaaggaggagcaagtcacattttatgtggatggcagcaggcaaagagagagcctgtgtagggaaactcccatttttaaaaccattagatctcatgagactcactcactatcacgagaacagcatgggaaaggcctacccccatcattcaaccatctcccactggattcctcccacaacatgtgggaattatgggagctacaagatgagatttgggtggagacacagagccaaaccacatcacctccctttttcccaagcagaggagtccctccctgtgaccaccaccatcctaggcccacagtgagtactgcctggctaccattgatgttcactcaaggcccatgggctcttcagtcaacttgtggtgaatgctgccaggcctgagactctcccttcagggaatctggcccccttccagcccaaagcaggtccagaaataccatccaagagccatgtcctggaataaggaaccccaagagcctgcttggtgctctactgcactgtggcctagctggtgtctaagctgcaagacaaagtccctcttccttctccttttctcaagcagaaggattccctccctatagccaccacagctgggaatgtggctgagttacacctgaagtgagctcgcctgtgagtcacaaccaaggtccacggcaattactatctgggtattgctgctgattattgagggtccaagtgctctttagtcagaaagtgataaatcctgctaggactgggtcctttccttcaaagcagcaggttctcttctggctcagggtgtgtctagacatgtcatccagaaggtaggacctggaatggggacctcggaactctacctgatattctatcctactgtgattgagctgatacccaagttgcaagacaaagttctctttactcttccctcttctctcctcaacagagggaaggagtctctcccagagctgtgagctgcactgcctggggtttggggagggatggtgcaagaactcctttggccaccccagctgatgtttcactaggtctcttgtcttccaagttcagtgggtctgagcttagcacagcaccaggacttgccagggaattgcagtccttgtggcctagactgcctttccagtttatttaggacctcagagtgccttggtctgcaatggcaaggcttgttggaactcaggttctgaccactgggatgggcaattcccctctggctaggactgacctaaatgctccctccagcagcactggctggggtctacccagtcttgctttctgcagtgaaaagcagcactgagttccaatgcaaagacctacaatcactgagctcaccttcccctaagcacacagattctctgacccacacaaccactgtcaggggttgtgtcgcaagtcaagaatgcctttcctacccgcttcagtgcctctttcagtgatatgaggataaaaccaggtactgtgattgctcatctgattgttggttcttataaaggtgctttcatgtgtggatagttgttaaatatgacatttctgcggagaggacgattggtgaaggcttctgtttggccatttttcaccacttcccctcacatgtatgtttaagtattcttttgaatgtacgaataattttacaataatagttggaaaaagagtaggcagggcagagtagcatttagagtttggtatgtgtgtgtgaagtgaatctgtctctaggaacatgaagagatttaagcctgatcataaccttcatattgaagtacaattgatacagcagagcacttcttcctctgcttttaaatacatgatgtttgtcacagacttgcaatccaaatggatgaaggtgacccacccttctggcgaaaaaattctttgaaagctcatgtctataatcaccacaattacagctgcttccaccactgctactaccttcaccaccatcttggtatcattcgtttgttttaaatgctctcatgtttctgacattttactcagtgttttattaatattattatctttattaatcctcaacaactagtgagctagatattattaatcataagatcttctggggtaaggctcagcaaagtgaaagaactaggcttatcactgctagtaaatggcagttcttgggttcaaatgcacaccagttggggtccaaaatgttactttttaacgtcacatcatactgcctaatttcaaatgcatatattatactgtcaccccttcagtgacaataatgtgtaccatgaattctccaaagtaatattcataaggatgttttaaaggagtagcagcaaaagaacagactgaatatataactgattaatgacaatacttctgagaggttggaagatgagacatagagaaaagatgcagaacattctgaaaaattgagggcgaaaggacagaaacagagtaagacaaattaaaaccagggaaataggcaggaaggggagaaaaagaatcgggagaatgaacagaaaataataagaccatcctaaagaatttattttttcttttccccagaagcctctttcctcaccttggaataggtgtttcatcttttgaaatgagttggataaataagaagaaaaggttgaaaagtaatttcaagtccacagagcgaaccctaggatagattgcttttcccttgcaagcctttcatccagaaaactttaaggtcttatggttttggcaataattataacagtaatcataatactgcctagctggtgttttccccttggcagtatgtctgtaccaatcagtttggcaggataatatcttcaagttcacacactaatttgcatgaatctgtttgttagtctacaaaagtgagggctctttcatgcccttggaccttagtgtacttggggctgtctatcttggacatttgtgctaatgaggtacttttaggtcagaacgaagaagttcttgcttagacttattatgtacatttgaatattttagctatgcatttgaatgtatatatcacagatatatgtacaaatatctgtggggtgtgaaaattcagattgttagggtggaaatgtgacacttcgtacttgcaaaaaatctttaaaaataggatatttacctacttattaaaacagtaattttggtaatgctggttagcaggtggagcgcacgagagaacttttcttccactgaattctgtgacatatatgttgtcatgagacctattattgatatgtgttaggggttttttatagtaatcactggacattacaattcatttaaccctcttaatgacttgttatgggagctgaggatgggagagaggaaggtgacagacagagtaatgggaacaattcattcagcttctccaaggcatgccagggcgagaaagttcaagtgctgattcagattattcagaggtataaggattaatcctagcatggataggcagcgcatatagggctggaggagaagctatggaactgtgatcctggagtgatgaaagggctataaaacaggtttcttacacttccttttgaaagttcaaaaattgtgcctgtacaattaatgaggaatacaatatgactagatatgcctgtacatgttgttgtttgttccattaaaagtttcataataaaacagagatccaaaacaagattatgtatttatgactatactggcaagtaaaacttttgttagaacttcatgataaagcttttaaaagggctttatcttatctttaaaagcccacaaggaaaatactttttcttttgcttcacaatactgaaggactcttgattttatataaaaagagtcctcttatttctagtgcactgactgacctaatattatgaagctttgaaatcattcttggcttgaaacctaattattatttcattgctgctgaacattagtaacatgccagatattattgtgttaactcttcctaaaagttagtaaaaatcataaagactcctctatcatttggtgactccatacttaaataacttagccattaactattgataaggtgattatcaccatggaaatttccttttcctactgtatacaacattaattgattatacctattagatggtaagctgcttaagggaatgtttcacatcagtagaggctcaataaatgaagcttattcaatgaaggaatgaacaaatcaattaattttataggcttagcagaaatatagcttctgataaagtagattccattcttatattattttcttttattgcattcaattatcacttgagaaggcacattttccacattttttggctactaatcctataaatcctatacatctattaaataaagatgtagaaaataattttcaagaatatacatttcattaggtttagcacactaatagaaaagctctaatggaagaaaatctataaattctggctataattatagacatctccttccatgaacaaactctaaactccttattctatgaacaagcttgagttcataaagaagagtcagagaattactaaaaacaatattgatagcatgctgcatttccaaagaaatggtagcataaaaggaaagccaaaatttatagcaactaaatcatatgaaaaggaactgcaaaagtaaattatctgcttctaaaaagagagcatagaaataagttagaaagaccaaattaatagaactgtacactaaaaagcatggattttaccatatgtaagttatgtcaataaactacgactaagaaaaaagacatttttattagtgtctaatgtcattattaaaatttttgtattttaatacgtttaaaatatttaaaatttttaatatatttaaaatattccccacaaagtatttccattttgtcaggggaataaactctcctttatttgaattcaaataaaattcaaattactgaagccctgttactatggcttcagaaaagccaagaaactcattgttcttcattaaggggtaaagataaaattaaaaatatttgaattaaggttaagaacactgactttgagattagattactgtggaaagctacaagttatgatactgttggctgaataaacaaacccatgtaaacagtagcttattcattgttaaaatatagaaaataatagatatgtgatgcagttattgtgaggatttagcatgacaatgcatgtaacacatttaatgtattagcccattatatattatttttatatattatatattatgtattattttgaattatatattattaatattttctgctgggaca

SEQ ID NO: 327 - DNA, 2430 bp, Homo sapiens
gaaggggatgaaaccagggaagggcataaccagaactttaaagatataggtaaggttctatttttcttaatctaggtgctcctcattacttatgcaaatttctgcagccagcttgaatttctcgtcagaaaatgggtttttcttttctatcgcattgtcaggctgcaaattttccaaactttcatggtctgtttcccttttaaaaccaagtgcctttaacagcacccaagtcacctcttgaatgctttgctgcttagaaatttcttccactagctaccttaaatcatctttctcaagttcaaagttccacaaatctctagggcaggggctaaatgctgccaatttctttgctaaaacataacaagagtcaccattgcaccagttcccaagaagttccttatctccatttgagaccacctcaggctggatttcattgtccatattattatcaacattttggtcaaagccatttgacaagtctctagagagttccaaacttccctacattttcctttctttttctgagccctccaaactgttccaacctctgcctgttacccagttccaaagtcgcttccacatttccatttatcttttcagcagcaccccactcctggtatttactgtattagtccattttcatactgctgataaagacatgcttgagactgggaaatttacaaaagaaagaggtttaatggatttatattttgacgtggctggggaggcctcacaatcatggtggaaggcaaggaggagcaagtcacattttatgtggatggcagcaggcaaagagagagcctgtgtagggaaactcccatttttaaaaccattagatctcatgagactcactcactatcacgagaacagcatgggaaaggcctacccccatcattcaaccatctcccactggattcctcccacaacatgtgggaattatgggagctacaagatgagatttgggtggagacacagagccaaaccacatcacctccctttttcccaagcagaggagtccctccctgtgaccaccaccatcctaggcccacagtgagtactgcctggctaccattgatgttcactcaaggcccatgggctcttcagtcaacttgtggtgaatgctgccaggcctgagactctcccttcagggaatctggcccccttccagcccaaagcaggtccagaaataccatccaagagccatgtcctggaataaggaaccccaagagcctgcttggtgctctactgcactgtggcctagctggtgtctaagctgcaagacaaagtccctcttccttctccttttctcaagcagaaggattccctccctatagccaccacagctgggaatgtggctgagttacacctgaagtgagctcgcctgtgagtcacaaccaaggtccacggcaattactatctgggtattgctgctgattattgagggtccaagtgctctttagtcagaaagtgataaatcctgctaggactgggtcctttccttcaaagcagcaggttctcttctggctcagggtgtgtctagacatgtcatccagaaggtaggacctggaatggggacctcggaactctacctgatattctatcctactgtgattgagctgatacccaagttgcaagacaaagttctctttactcttccctcttctctcctcaacagagggaaggagtctctcccagagctgtgagctgcactgcctggggtttggggagggatggtgcaagaactcctttggccaccccagctgatgtttcactaggtctcttgtcttccaagttcagtgggtctgagcttagcacagcaccaggacttgccagggaattgcagtccttgtggcctagactgcctttccagtttatttaggacctcagagtgccttggtctgcaatggcaaggcttgttggaactcaggttctgaccactgggatgggcaattcccctctggctaggactgacctaaatgctccctccagcagcactggctggggtctacccagtcttgctttctgcagtgaaaagcagcactgagttccaatgcaaagacctacaatcactgagctcaccttcccctaagcacacagattctctgacccacacaaccactgtcaggggttgtgtcgcaagtcaagaatgcctttcctacccgcttcagtgcctctttcagtgatatgaggataaaaccaggtactgtgattgctcatctgattgttggttcttataaaggtgctttcatgtgtggatagttgttaaatatgacatttctgcggagaggacgattggtgaaggcttctgtttggccatttttcaccacttcccctcacatgtatgtttaagtattcttttgaatgtacgaataattttacaataatagttggaaaaagagtaggcagggcagagtagcatttagagtttgg

SEQ ID NO: 328 - DNA, 3162 bp, Homo sapiens
tgtgttgggaaaatttgtgatactattggtgagttagaaaaaaaaaatcaccattcctagaaatatttttattttttgagacagagtcttgctctgttgcccaggctggggtgcagtgccgtgatcatagctcactgcaaccttgaagtcctgggctcaagtggtcctttcacctcagcctcctgaatagctaggactgcaggcatgcatcatcacacctggataattttttaattttttgtagatacatggtctcactatgtttcccagactagtctcaaactcctggcctcaagtgagcctcatgcttctttagaaaatattttaaattctattgatggtatatttgaatcatattcatatataaaggacatactatagtgaaccctcacatttaatgagttacacattataattacaatttctaatcaacagttctttagcaggcctggtgactggaagtggtatgaatctcccttactcacgcccagtgctaacacttgggcaaggttttgctttttgcaaatctgcatgtagattttcctgatagcagaactcagagaaatcaacaaattgccaggaactggggactataagtgggctatgttgtgaagaaacaggctacttggaacttctgagagctcagaaatttgatttggcattcttcaaatgccttagaaacttcaaatcctctggattgagagtggaacatttgtcatacaaacaatgaagaatccactggtgaggatctatgaacttggctgccctagaggtaaaagtataaaggaagcagtggagccattgccttcatgattcacagctcctgggctttgatctcagtatggtatcaaaacactcctaaagtccacctcactcatttattaatgtaaatgcttgaatcacactctgtgtaccttttcaaaaaatagattattttctctaaatttttattgacaaactattatttattatttccattttcctgttttctagtttggctggcttccctcttgatcctcactacatataattcacactgtttttgtttacttattaggttttgttttcctcttgatcctttttacagatattccatggttttccaatgctatgttcctaattcacagatttgtggtcttctatgtttaaagaatttatggaatcctagagttgagatgacttttgctgtcatctaatgccgctcacttatcttataaaatagaaaactgagcctctgaaaatgagcggatttatataacttatatagtttctcagtgaaagactgaagggtatgttttctgaattcctccttttatgcaggtagcagccaatgcactgcataatttaagggattgttgagattgaacaccagggtcctgtttggggatatgctaccaaagttttgaaaaagcattatctggaaaggccatttgatttaggggaattgaagggatatgagggttgaaggaacagattattttgagaattaattaaggatgaaagaggctgggcacggtggcacaggcatgtaatcccattttttgggggtgctgaggtggttggatcacttgagatcaagtgttcgagaccaacctgggcaacatggcaaaaccccatctctatcaaaaatacaaaaattagccagatgtagtggtgtatgtctgtagtcccagctacttgggaagctgaggtgggaggatcgcttgagcctggaggtggaggttgcagtgagctgaggtcacaccactgcactccagcgcgggcaacagagtcagaccctatatacaaaaaatggtgacagctctgagtagtaaagaatagcagcaaatggcaggatcacagaaataaaatgctttaaattacaggtgatctagggtgttctaaaaagtctactgattctcacacaaagaagatggctactatctgaatcacacatcctaacaagtgttggcaagggtgtaaagaaattggaactctagtgtactgctggtggagtataagatggtgcagctgctataaaaaatatggctgctttttaaataattaaaaatgaatgaccatattatctagcaattttacctctggatatatgtccaaaagaattcaaagcagggtctcaaaaaggtatttgacattcgtgttcatagcagcattactcactatagccaaaatatgaaagtaacccatttccatcaatggatgaatggagaaataaaatattatatacatacaatggaacattattcaaacttaaaaaggaagaaaatcctgacatatactataacatagataaactttgagaactttgttaagtgaaataagccagtcacacaaagacaaatactgtatgaatctacttatatatgaatttagagtagctaaactcatataagcaaaatgtggaatggtggttctcagtggcaagaggaagggggaaatggagagttgtttaatgaatgtagagttcagttttgcaagatgaaatagtttgggagattgcttgtacaacattgtgaagataccaaatactactgaaccgaatgcttgaaaatggttaagatggtacattttgtttgtatattgttatactttgaatgtttgtcccttcataactcatgtttaaattcggttgcaattgtagcagagttaagaggcgagacctttaacaggagattgggtcatgaggtctctaccctcataggtggaattactgccattataaaagggtggtttcagcccctttttgtgccgggcccttctgtcttctgtggggtgatgcaatgaaaacgccctagcagatgctggcagcttcattttggattttccagcctccagaactgtgagccaatacatttctatccattaaaaatgacctaatctgtggtattgtgtcatagcagcacaatacagactaagacatggattttaccacaattaaaaaataaaagaagaaaagactgatgaatttctgggggaggaaataaaagagggatgcacagtgtgcagaagaccttgtggtatcatgacatgagttgaaagtagaacctgggtaaatacaatgaattagcctccaatagtcttttcagttatgtaagagaagaggggagtcattccggacaaccaacttgatgttttctttaatggatctttgggtgaaatatg

SEQ ID NO: 329 - DNA, 159700 bp, Homo sapiens
cagatatatatttggggtgcaatgtatttgaaaattgtttttttgaaatatgctaattcagtaagctattcttttttataatacattttatttgagattgctacagatttctggacacacacacacgcacacatgcacacacatgaataagcaaaaaataatagattgaccctgaaaaaagcataattttcaaaaaattataagggctactctcataatatacaattaatgtgtcagagttttattcaactcattaatgagggaactagaaagaataataggcttgttcaagagtaagtaacaaaactagataaataggatttggaaacaaaagaatgttagcataatattactatgttcaaaactggttaatatccacaggaaaaaaacaataacttatttggttatcttttctaaatgacaggaattatttcctattctatcagacaaaaacctaaaagttaatatgtaacttcacaaagtctatgacaattaatcaatatttcttagtttcattacttttttctagcctctatttcatttatttctgttcctatctttatttccttttttctactaactttggattttgctttttctagtcccttgaggtgtaattacattaggttgattatttgatatctttcttcttttttgatgtagatatttattgctataaacttccccactggaatgatttttgctgcatctgataagttttagtatattgtgtgactattattgtttgtatcaagatatttcacaatatttttaaattttcattttaagtgcctctttgatccattgattgttcagcagtatgttgcttaattttcatatacttgtaaaatttccaaattccaagtcctgttattgacttcttgttatatcaatgtggtgagaaagatacttgatactattttaattattttaaattttctaagacttactttgctgcctgacatatgatctatcctggagcatatttcatgtgttcttgagaaaaatatatattctgttgctgtttgatagaatgttttttatgtgtatagtaggtccatttggtctaaagtgtagtttgagtctgatgttttcttattaattttctgtctggattatctgtctgttgttgaaagtggaatattgaagtccattatgattattgtattacagtatatctcttctttaaaatctattaatattgatatatatcatactttatatattatatatattatacacacacaattactactagacctcagaaatgaagttgatggcaacacaatgatagtgggggtcttcaatgctccactgagagcactagaaaggtccaagacagaaagtcaacaaagaaacaatggacttaaagtataccctagaacaaatggacttaacacatatttatagaacattctacccaacgactgcagaatgtacattctgttcatcagcacacggaacatactccaagatagaccatatgatagaccacaaaacaagtctcaataaagataagaaaatcgaaatcattatcaagtgctctctcagaccacagtgcaatacaattggaaatcaacttcaaaaggaaccctcaaaaccatgcaaatatatcaagttgaataacctgctcctgaatgatcattgggtcaccaatgaaatcaagatggaaatttaaaaattctttgaactgaatggtaatagtacacaacctatcaaaacctctgggatacagcaaaagcagtgctgagaggaaagttcacagcattaaatggctacatcaaaaagtctgaaagagtacaaataggcaatctaaggtcacacctcaaaaaactcagaaaacaagaataaaccaaatccaaccccagcagaaaaagagaaataacaaagatcagagcagaactaaatgaaattgaaataaaaaaatacaaaaaataaatgaaacaaaaagttggttctttgaaaagataaacaaatatgatagaccgttagtgagattaaccaagaagagaagagagaggatccaaataacctcaattagaaacaaaataggagacattacaactgatgttacagacatacaaaagataattcaaggctactataaacacctttatgtgcacaaactagaaaacctagaggagacagataaattcctggaaatatacaatcctcctagattaaaccagaaagaaatagaagctctgaacagatcgataatgggtagcaagattgaaacagtaataaaaaaaatgccaacaaaaaaaaagttcaggaccacatggattcacaactgaattctttcagacattgaaagaattggtgccaatcctactgaaactattccaaaagataaagagggaatcttccctaaatcattctattaagccagtattaccctaataccaaaaccaggaaaggacataacataaaaagaaaactacagaccaatatcactgatgaacatagaagcaaaaatcctcaactcaatactagataaatgaattcaacagcatattaaaaagataatctaccatgatcaagtgagttttaaacaagggatgcagggatggtttaacatacagaagtcaacaaatgtgatacactacataaacagaagtgaaaacaaaaatcatatgatcctcaatagatgcataaaagcatttgacaaaatccagcattcttttatgattaagaccttcagcaaaattggcatagaagggacatacctaaatgggaaaaagttgaaagcgttcccccctgagaactggaacaagataaggatgctcactttcaccacttctattaaacatagtactgaaagtcctagccagagcaatcagacgagaaaaaaataaaggggatccaaattgataatgaggaagtcaaaccgtggctgttcaccgatgatatgatcatatacctagaaaaccctagagacttattaaaaaagctcccggatctgatgaatgaattcaataagtttctggatacaaaatcagtgtgcacaaaccagtagcactgctatccaccaacagcgaccaagctgagaatcaaattgagaactcaacccccttcacaacagctgcaaaaagaaacccttaagaatatacctaaccaaagaggtgaaagatctctacaaggaaaactacaaaacactggtgaaagaaatcatagatgacacaaacaaatggaaacatcccatgctcatggatgggtagaatcaataatatgaaaatgaccaatggcaaaaaacaatctgtaatttcaatgcaattttcatcaaaataccatcatcgttcttcacagaactagaaaaacaatcctaaaatgtatagggaacacaaaaagagcccacatagccaaagcaagactaagcaaaaagaacaaatctgcaagtaccacattaccagacttcacactataccacaaagctatagttaccagaacagcatgatactgatataaaaacaggcaagtagaccaatagaacagaatagaggatgcagaaataaggccaaatacttacagccaactgaacttcaacaaagcaaacaaaaacataaagtgtggaaaggacaccctattcaacaaatggtgctgggataattggcaagccacatgtggaagaatgaaactggatcctcatcactcaccttgtacaaaaatcaatcaagatgaattaaagacttaaatttaacatcatctgaacgataaaattctaggagataacatggtaaaaactcttctagacattggcctaggcaaagacttcatgactgaggaccgaaaatcaaatgcaactaaaacaaagataaatagatgggacttaattaaaaagcttctgcacagcaaaagaaatgatcagcagagtaaacaggcaacacacagggtagaagaaaatcttcacaaactgtgcatcagacaaaggaccaatatccagaatctacaaggaatgcaaacaaatcagcaagaaaaacaacagcaacaaataatcctatcaaaaagtgggctaagggcatgaatagacaattctcaaaagaagatatacaaatgaccaacaaacatatgaaaaaatgctcaacatcactaattatcagggaattgagaatcaaagccacaatgtgataccaccttactcctgcaagaatggccataattaaaacttttttaaaaaaaatatgttggtgtggatgtggtgaaaagggaaaacttttacactgctggtgggaatgtgaactagtacaaccactgtggaaaggactatggacattccttaaataaccaaaagtagatccgccatttgatccagcaatcccactgggggcatctacccagaggaaaataaatcattatatgaaaaagacgcttgcttatgcatgtttatagcagcagaattcacaattgcaaaaatatggaaccagtctaaatgactatcaaccaacaagtggacaaagaaccaacaagtggataaagaatttgtggtatatatgtatgtgtatatatatttgtgtgtatatatgtatatatatgtgtatatatatgtatgtgtatatatgtgtatacatgtatgtgtatatatgtatgtatatatgtatatatgtatgtatatatatgcatatatatgtgtatatgtgtatatatagtgtatatatgtgtatatatacacacatatacatatatagtgtatatatgtgtaaatatatacacatatatacatatacacatatacacatatatacatatactcatatatatacactatatatacacatatatacacacacatatatacacgtatatatacacatatatatatacacatacatatatacacatacacatatacaatggaatactactctgccataaaaaggaatgaaataatggcatttgcagtaacctggatggaattggagactgttattctaagtgaagtaactcaagaatggaaaaccaaacatcgtatgttctcacttataagtgggagctaagctataaggatacaaaggcataagagtaatataatggactctggagatgcgtgggaaggtatgggagtggggtgagggataaaagactacacactgggtgcagtgtacactgcttgggtcatgggtgcaacaaaatttcagaaatcacacctaacgaacttatccatgtagccaaaccccacctgttctcccaaacgattgaaataattaataataataaaggtgagatccagaacaaaaaaagatgagcccatgaggtgcacttcttgagcaacacaattcaatttatttaattttacctcaatgattgtgaaaatatagtttttcaatattctaaagtcacgactctcatatacctacaaagtaaaaatatttttaaaagaattttctctgcctctcaatgaaggagccagtaggatgataaagcttgattcaaagagtacttgaggaagtgagtgttcacaggtatttttaaaaatgttagagtaggctgggggcagtggctcatgcctgtaatcccagtactttgggaggccgaggcgcgcggatcatgaggtcaggagatcgagaccatcctggctaacacggtgaaaccctgtctctactaaaaaatacaacaaaaattagccaggcgtggtggtgtgcgcctgtagtcccagctactcgggaggctgaggcaggagaatggcatgaacccgggaggcggagcttgcagtgagccgagatctcgccactgcactccagcctgggtgacagagcaagactccgtctcaaaaaaaaaaaaaaaaaaaagttagaatcaaagtacgattgccttttataccagttcgtaaaaggaaacaaattctgaagaaacaagtgttgatactttctcattatacatatgcaaattttcctctataaatactttgaacaattagttttgaattaaatgttgactctgtaagcttgagtgacagtagatattgtatttgtcttctcatgcatcacctggaaaatttgtgtgagactttttacagatagcaaatacttgaaaacttaagaaaaagttggcgaaaaacaattttgagaagataaatgttatataagctgggccttcaggacctttgaaagctaggaaaatttttatttactttgcataggataatgacaatagccataagagactggggcatgtgttgaagaaagaagagttttcagagatgatgattagatgcttcttagcaaaagtaaatttgtagaaagggaagcccagaagcagatcagaaatatgtaattatggaagttatttttaagttttttgcaacatgaaatttgaaataaatatgaaataaactttctcctgcgtgttcttagaatatcttcatcatttgtgtgattaaatttcttgtgcataaaaaaatgggtaatgcttataagagaagctagaaactcaaagataagcagacatccataaaggaaagaaaggcaaagtggagctagggatataaaaattacttgtaatccattttggctctgctcagttgggcagtttctggtttctccatattaatcttaaagaagaaatcagcagccatttataaaatgataaatcctcatcataaacattttaaaaatgttgcaggctttaaaaggagatattttaagaatcctgtgtgatgcttaaatagttaacaagaagatttaattttctaattgctattagaaacttagggaaaaaaatggaccagcatatagagcctacacagaaataaaacttaaatagcattgatatttaaagttttatgtttctctttcctcctagttcaaaccggctaatatgatttgtaggaaatcagttggtaaagaatgcgatttcactgaatattgcaatggggaccttccatactgtttgcctgacacttatgtacgtgatggagaatattgtgattcaggtggagccttctgttttcaaggaaagtgtcggacttttgacaaacaatgtgatgatttaattggaagaggtaataatcataattttcttcttagtccctaaattctgattattccaaactctgttattgaattttatggaacaaaaatgtaaatgtatgtgttaatgactgaattcttgcataatgtatattagtgttaaagaaaaaacaaaattatcttttctttttcttttttgagacggagtttctctctgtcgcccaggctggagtgcagtggcctgatctcagctcactgtaacctccgcctctttggtccaagcgatcctcctgggttcaagcgatcctcctgccgcagcctacggagtagctgggataacaggagcacactgtcatgggtggttaagtttgtgtttttagtagagacagtgtttcaccatgttggccaggcttgtctcaaactcctagcttcaagtgatctgcccacatcgtgctcccaaagtgctgggattacaggcacgagccactgcgcctggcgcaaaaacaaaattttcatgattgtgaaatacaacaacaaaaaacctctctgaatttatatggaatttctgtaggaacagaaaataaacctcaagtgaaaatgcagtttttcaaaatattatatagaatttgtggtgggggtttagtttaaaggaaacaaggtttcttaatcagaggaaagcagggctaatcactgattagttgggtttctaagcgcttgctgaaaagtgagggcttcagttcattagcaatctagtccattttgataatttcctataaatgtcatttgcttgattggaagatacaaattcctgaacgtatgcagtgcatgttctccgagagagtgaaatttttcattcttagccctcccttgaggtcttctctaaccaggtcatagatctctaaatattgtctacagcaatgtgactgccaggaatttaaggagaaggtgagatgggggttttgatgattttcataattttgtcctgcttttctaacagaatcattatttgtaccatatggcaagacaatagctatagactttaaaacattgttaacatacaaacaaagagctggggccagtagctcatgcctgtaatcccagcactttgggaggccaaggcgggcggatcacaaggtcaggagttcaagaccagcctggccaacatggtgaagccctgtctctactaaaaatacaaaaattagccgggtgtgcttgggatgaggcgggataatcgcttgaatccaggaggccgaggttgcagtgagctgagatcacgccactgcactccagcctgggcgacagagcaagacaccgtcttggaaaacaaaaacaataacaaaatcattcaaacgaatgaccagtaaaattaggaggaatgggacagtacttcagatctatgatctaatgtttctttaagtaaagccaggactcaatgctaggcagataaaattagagccacatagtggattgccaatcaggtgtcttccgggttatgccattcactgtgtatttagtattatcagtgattttaagagattttaaagtcctttgtgagaactgtgggagtacacgggtatttgccccaaagagtacagttttttttttttggaaggcaagcatgacttctaaagcaccttgatttcaaaataatgtatgtccacttctagtgaccatgtgttcatgcatctaggacgtgataattctggacttgactaccagtttttgtacttatttttgaaaaacaatctcactttgctagccccctgagggcaatagaagcctgatgaaaatttaccctcaatggtagctgtatttcaacgcatattaaatccagttctttgtacaataacatgctatacgggtttgcagcctaggagcaataggctacaccatatagcctaggtgtgtagcaggctataccatctaggtttgtttaactacactgtatgatgttcacacaacaatggatacattgctcagaacatatcctcatcattaagcaactgatgactgtactcagtaaatataaggtattattattattattagattatgatgtgtgttccctacaaatatccaattatttgagtaggtcatctatgacctgtcatggttggctcaaatgatccttgagcagggtttgatataattctgaagtaggcattagttttgcttggtaaaacctatatgctatttgtaggaaacagacaataagaattcttataccacaggcctaatacaaatcatcatgcccccccaaattgttgatttctggacaaaatatactaatgaagttgtcacattgaaagacatagcttatttatcaagcaatggcatttaaaatagggaaatctgtagatctatggtaaaagaacgaggttaagtattaagctttttttttttcaaaaaaatcaaaccagtgaaggaaaaacacctcaaatggttaccacctttttctaagctctttactaaattttgtttttggaaatgtctggcccctacagcatgctcctcttcagtgttatctctgcaaatgcagaaacttcctattgtaggtataatataaaatgatgttattacctttggtgttatttggtttgtggttatgtttgccctaataaggctgaaagtctcatgagttgtaaagttccatatattattagagggctttatgaccaagttgagttgtatatcatctagacaaatgttaagtgctaatccaaccgttatacaagggtttctcaacctcagcactagtgataatgtaggccagctcatactttattgtgagaagtgggggcagggaatgcttctcctgtgcattgtaggatatttggcagcgtccttggcctctgcccactagacaggatgcctggagagacttttggttgtcccagcttggatggggtgaatcttggcttctagtgagtacaggtcaggggtgctgctaaatgctttgtaatacacaggatagcctctacaacaaagaattatatctgctgtgctgtgttgagacctccttctctagagagggccagaagtttgactacttaagctgattaagactctgaaaaaggattatattccacactaaagtatgaacagtctttgcaaaactaacctggtaatgtttctttttcaatttttaagatatgatttatcaaaaaccatattggatcaatattcttatgaaagtggcacaaaggttggctctgggcgtagatattttccaaaccatagaagcatacttaccagggacgtgtaaaagatttgctggattattgaatagttgtgtgagaaggagaaataaacaatatttcatgattatttaatcaactaataaaatatgttcagggttttcagcatctatattcaggcttatttagtatatagcactataaaatttaaatgtaatccttatacaaggtctgaggatgcttcaactaatttatctaaagctacaattgctctggatttaagaaacagactacaaacaggtgatggagctttgatgagcactgggcagttaggtaaatattcctataatgtgacttgacctttaatgaacacatagacactaacatttatgataatctggaaaacacagtaaagatgtgaaggctgctttggggtcctgaaggcatcttttacctctcagttcactgaaagatattctgaaatgtttgaaaaagtaaaatcatgtatggaacttagtattccataaaattaggaaccaattgtatatttagccatttaatcctggacatccttaaatttataaatgtctttcagaagtttcttttggataattatgaatagtcaacaatcttttgactatttcagacaaagttcttcctttggctgacaaattatggctaggtgataaaataggatagggaagcttttccttaaaaattttatacttccttttagccaatggaatagataaatatatagagatagcttgaaaactccaaataagtacagataggagatcgcctactttgggcaaaggtagatctggaaggaaactttatattttgagatgctgatttaaaccatgagaaaagtaaggtggatactcagaaaagccttaatgtattattgtcgaagtattattgttctgtagcaccttgtacatgtatggattgtgctccttaactgagtgaaatttacagatcatgttctccaagtatgaaagtctgtgaaattattgaagatagctctcttgtcaattaatagtggtaacaacaaatgatctctattttgattacatatgactaacatgatcaacgtaaactacgtctaaactactaagtcaaagtaataggacagttattatagatgtttgaatttttcagaattttaaaattagacataactaaatatataaaggactgaagtagatgaacattgatattctaattttaaaattcaacaatttttatttagtgattattaggatctaataattattaagatctaataatctaataatagattatgactctagtgtggagcaaggagagttaaatgaagtgttctttgtgtttgtcatcattattgcactaaagatactatttttctactgtttcatttagaataagagtaaacagcattttcacaacgggtagggaagtaaggcaggaagtaaataatttataggaaatagagagggcgacagttgcttatttgtctaacaatacagaagcattctaataatgttgttgtttgttttctgtttctgcagaagaaagtcttctaggcttataaaaaggagtttgttttttaatcctagctctgcccccagaaactttttagtcctgggtaattataaactttcttatggatcacattgtaatttccagattgagtctttcatttctttaatataacttaaattctgtattgtaatttacttaagtttttgttgttgttcataggttcaagaggtgctccggttttctgttatgatgaaattaataccagaggagacaattttggaaactgtggcactgcacactgtctttttcagtatgtatttagaaaattataaaactgtttggaatgtaggttagagattgttaaaatcctaggaaatatattatatgcagtaaaatcgaatgttgggggtcaggttttctttattacatcatctgagctggacaatattatccactgcctacaagaacatttgttcagcgcctataatgttaaaacaacaatgaccataaaaatgtcctctgtttattgttgtgatgagctagacattgttatgcagcttatatatattatatatttataatataggttatattattcaatttatgtacatcaaatgtgtataagaattacttatcccatttactattgaaaaaactgaagaccagagatcattttctcaaatttcagcagctattgtggaacagatcacagctgtcatagtgtaaaaaccattagtttttcacttgccagattgcctcatgaaacaaaaaagaatcataacataagtcattgtgcaaaaaaatatgtactgagagaaaatagttgaaatttggatttaaattagtaaatcactttttaaaaatttcactgtatcagcaacctatgttatctcaataaacaataaggtaatttttttcttccttgtgcttctagacatattctatgtggaaaattagtctgtacatgggaacacagagacttaatatcacgtccaaatttatctgtgatttatgcacatgtacgagaccaaacatgtgtgtctacatacctacccaggaggacgccacctccagtaaattcacctatttcaatcacatcatattattcagctgaagacagagatgaaacatttgtacaagatggttccatgtgtggtcctgatatggtaattagaactacacaaattaaagtgttttaaaatgatttttctggttatactcattttgacaatgtactaaccaatgcattttcttccattttttcttgtggtaaaatgcacgtaatataaaaattgccattttaacctttttaagtgtacaattcagtggtattatatacattcataatgctgtaaaaccatcaccaccctctatcttcataaatcttttcattttgtaaaactgaaactcatttcattaaacaataactccccattcctacctcctctgatcccctgaaaaaccaccattctactttctgactctataaatttgactattataggtatctcacataagaggaataatatagtatttttctttctgactggcttatttcacttagcataaggccctcaagtttcagctatactgtagtatgtcagaatttccttcatttttaaagctgactactattctgttgtatgtacgttctgcattttgtttatctattcatctgttgatgaacatttggaatcattccatgttttagctattataaacaatgccactataatcatggcagtataaatatgtcttcaaaactgtgctttcaatttctgggggtatatacctggaagtagaattgctggatcacatggtagttctatttttaaatttttgaggaactgctccactgtcttccatggtggctataccattttacatttctactagccatgcataatgattccagtttctccacatcctcaccaacacttactttccgtttttttttttttcgatagtagccatcctaatgggtgtgaagtggtatctcactgtaattttgatttgcatttccctaatgatctgtgattttgagcatcttttcatgtgcttattgaccatttgtatatgttctttagggaaatgtctatttaaatgctattcccgtttttaaatcatcttttttgttgttgagttttaggaattctctatatattttggatattactctcttatgatatgattttaaaatattttctttcattctttgagttgcctttttactctgttgatagtgtcttttaatgcacaatttaaaaacaactacgaaatccaattagtctattttttcttttgttgcatgtacttttggtgtcatatccaataaatgactggccaaatcaatattatgaagcttttgccctatattttattctaagagtattatagttttaagctcttatgtttacctatagaatccatttcaagttcatcttggtatgtggtgttaggtaaaggttcagttttattcttttgtgtgtggacatctagtttctccagcaccatttgttgaaaagactgtcctctctccattgaatggtctcagcacccttgtaaaaattcagtagtatctcttaaccatatatgcaagcatttgtttatgggctatttatgctattccattggtaatatattagtctttatgccagtaccacactgttttctttcctgtagcttcctagtaagttttgaaattgggaaatgtgactcttttagctttgttctttttcaagattgtttttggggttctttgagattctatatgaattttagtataaatttttccatttctgcaaaaaaatcattgggatttttatagtaattgtattgaatctgtagatcactttgaatagtatggacatcctaaactgctttgttaaattaattcttaagtactttaagtactttttgatgctatcataaatggaaatgtgttcataatatccctttcagagtgttcattgttactgtatagaaatgaaaccagtttttatatgttgattttgtattttgccactttgctgaatacattgttaattctaactgtttggggtaatccttagagttttctacttataaaattatgtcctctggaagcagaaaagttttaattgttcctttccaatttggatgccttttatttctttttcttggctaacatctctggctagaacttccagtacaatgttgaagagaagtggtgaaaggaagtatccttgccctgttcctgatcttagcggagaagctttgaagtcttatcattaagtataatgtcagttgtgggatttttatatatggatttttatcatgttgaggtagtttccttctacctcatgactgagtgtactttgaatgtttgtgtcatgaaaggtgttgaattttgttaaatgccttttctttatcaattaagatgatcattttgtttttctccttcattctattaatgtggtcattacatcgatcagctatcatacattgaaccatccttgcattccagaaatctcaattggtcatagtgtatactcctaatatagtgcagtttgccagcattttactgaggattctgcatctatgttcataatggttattggtctgtattttttctttgtagtatatttgtctggctttgatatcaggataatgttggccttataaaatgagttagaagatatttcctcttcttcatgtttttggaaaaatttgagaagaactggtgttaattcttctttacatatttgaaggcattatgtccagaaattttcttcataggaaggcttatgattattaattaattaattaaattattaattaaatctccttatgagttaggagtctgttcaggtttttaagttcttcatagtgttgataggttttgtttctaggaatttgtcagttttatcaagctaatccagttcattggtaaacaattgatcttggtattcttataatcctttctatttctgtagaattggtagtaatgttctcacttttattcctgactttagtaatttgagttttctgtctttattagtacatctagataaaggtttgtcaattttgttcatcttttcaaagaaccaatttttggtttccttaagtttattgttttactctgtattttatctccactttaatctttatttccttccttctgctagaatttagtttatttatttatttatttttctatttccttaagttgtaaagttaggttgttgattttaaatttctcttcttttttattgtaagcatttatactaataaatcttccccctagtacttctttcactgcattccataagttttgggatattgtgtttatatttctatttgtttgtaagtattttctaatttccttagtgattccttctttgatccactggttccttaagagtgttttgtttaatttctatagctttgtggagtttacagttttatttagattatttttccaaatttttaatttacttttttattagaaattattattctaaattttttgatacattaaacaatttatttttaaatttttatatattcatggaggtacatgtgcagttattggtgaagttttgacatccagtgtgcctgtcacctgaataatgaacattgtctccagttatttttcaactctaaccctctgattcttcctcacttttggggttgctggtgcctattatttccatctttatgtccatatgtacctattttttagcttccacttacaggtgagaacacatggtatttgattttcagtttctgagttagttcatatatgataatgatgtctacctttatccatgttgctgtactgcatgggacatgatttaattatttttattgctatgtcataattcatgtattatatatccttatatgtctagatatataattcatttattatatatcataatatataataaatgtatatatcatatattaatatcatatatttatatatatatttatatattatatatttatttatataatatattatataacatattatatatttatataatatatattaatatataaatatatatttatatattaaattaatttatatatatttattatattataataatatataatatattatataatatattaaataatatataatatattatctaatatattagataatatataatatattatctaatatattataatatattagataatatattatctaatatataatataatatatattatataatatattatatagtatacaatatattatataatatattgtatactatatattatattatattaatatatataaattatatattaatataatataatatatagtatacaatataatatataatacattatattaattcatacataataaatgaattatataattcatatataataaattcatatataaataatatataataaattaattatatacctagatatgtagatatataatacatgaattactacacagtaatgtatataatataaatacataaataatgtataacataaattcatttaattattgtatatgataaatgcatatattatatattgtataattaatgtaatttattatatataatgaattcttatatataataaatgaattatatatctagatatataaagatatttataaaagatatttatatataaaagataaagatatatatctagatatataaatatctttatatatctagataaataattcatttattatgtattatatatttatataattaattatatattatatataataaatgaattatatatctgttacctttatacctgaattatatatatgtgttaccttttctccacatgaattatgtatatgtgttaccttttcttcacatatatataattatctataagtgttaccttttatccacatcctcaccaacatctgttgtttttagactttttaagaatagccattctgaggcatggcgcggtggctcacgcctgtaatcccagcactttgggaggctgaggagggtggatcacgaggtcaggagatcgagaccatcctggtaaacactgtgaaaccccgtctctactaaaaatacaaaaataatagccgggcctggtggcaggcacctgtagtcccagctactcgggaggctgaggcaggggaatggtgtgaacccgggaggtggagcttgcagtgagcagagattgtgctactgagctccagcctgggcaacagagtgagactctctctaaaaaaataaaaaataaaaaatagccattctgactggtgtgagatggggcatcatcataattttaaattacatttctctgatctttggtgatgctcagcattttatcgtatgtttgctagccactcgtatatcttcttttgagagatgtctgttcatgttctttgcccactcgttactgggattatttgtttttcagttgagttgttgcattcctggtggattctggatatcagttctttgttggatgcatagtttgcaaatattttctcccattctgtaggttgtctgtttactctgttgttatttttttgctatgtagacacttttttagtttaattaaatcctatctatctattttttttgttgttgcatttgcttttggagttttagtcctaagttctatttggggttttaatcctaagtttttgtccagaagagttgtttcctagactttcttcaggaattgttatagtttcaggttttaggtttaagttttgaatgcatcttcggttaatttttgtgtattgtgaaaggtaggggtccagttttattcttctgcatttggctaaccagctatcccagaaccatttattagatagagagtcctttccccatttcttattgaattttgggtgtggctcttttatcctgcaactgtcctgtgttaaattagttgtaggagtttgattgtggacttcttgggatttttttatgtagaaaataatttggaaatagagaccattttattttttccttttcaatctgtatatgttttatttctttttcttgctttactgcagtggttagaacttacagtatgatgttgaataagagtgttgagagaggatgtctctgactttttcctaatctaagaggaatgtattaagtctttcatcattaagtatgttagatgtagggttttttcttttttgcagatgccccttaagttgagctaaccgtcttctactgctaatttattgcaggtttttattatacttgtgtcttgaattttgtcaaatgctttttgtgtgtcgattgatgtggtcacatgagttttcttctttagttcattgaatgttggattacattaatcaatttttaaatgtagaaacagcattacatacttggtattaatatcacttggtcattgtgtataaattttttatacattgttgcatttagtttgctaatattttgttgaataatctttgtaaccaaattcatgaggggtattggtctgtagttttttttttgttgcaatgtatctatctgattttggtcattttatatggcattataaaattaattgaaaactgtttttcactcttctatttttggaaagagattatgtaaaatgtatgttaatttttttctttaaatgttgatagaattctctagtgaaatcatttgggcctggaaatttcattttttaggaggttttaaactatgaattcaatttcttcaattgttgtattggtcttcagattataagctgtttcttggtgatttttggttgctcatagtttcccagaaattggtcaatttcctcaaagtttctgaatttataaatataaagttgttcatagtatttctttataattctgtgtaatggctgcaggatctgcaatgatatcctctatctcatttctgatattggtgatttctgtcttctttttttaacttctcagtcttgctaaagttattaatttcataaaaaattttcaaagcatctgctttttgtttcgttggttttctcagtctagctaaaaatttattaatttcataaaaaatttattaatttcataaaaaatttttaaagactccactctttgttataatggttttctttattattttccagcttttaatttcatatagaactagcaatcaatttcattgatttctgcttttattatcgtttactttcttttgctttgagtttaatttcttcttcctttcctccagtttcttgaagtggtaacttcaatgattgctttgaggctttttctcatttatagcatttggtcttataaatctccctctcagaactgttttagctgcatcctacatattttaatgtatatttttgttttcctttgattctatgtatttttttttagtttctttgagggctatttgatacatgaattgtttataaatgtattgtttaatttcaacatatttagaaattttcctgttgtatttcttttattgatttcaggtttgattttattattatcagagaacatgttctcataattttaatttttaaaaacttgttgaggttttctttatggtaaggagtatgatatatcttgctgcatattccataggcacttgtagaaatgtatattctgttgatacgggttgtagtgacctgtatatgcatcagttaaatcctgttttgtccagattcctgtatatctgctgactttctgtataatttctgtaaattgctgagacaaaggtgtcaaaatatccaactgcaattgtggctttgtctattttcctttcagtgctattactttttgccttatgtttggaggctttgtggtttgggatgtagacatttaggagaactgtgtattattgttggaatgattatcatatcatgacataatgtcttcatttgtctctagtaattttctttgctctgaagtctactgtatcagatataaatatagctactcctgcttttatggataaatgtttgaatgatatattttttctgtcctttttatttaaatctatctctgccattgaattcgaggtgagtttttaaaagcatcacagagttgagtcatgccttcaatacagtgtggcatgtcttttggttggtataatgttattgcctaagtatgttatttcattatttgtttcctctggttcccattcttatttttctcttttcttgcctttcaatgggtgatttaaacattgttttaggatgctatcttgatccagttatagtgtttctaagttagccatgtctttctgtagttttcatagtggctgctcaaggttttatgatatatgtatgtggcctaaagaggctactgctataaacattttgccactttgagtgaaatgagaaaacaacctcattcccattttagttgtgtttaccttccctacatttaagtatcattggtggtgttataatttttgtttcaatcattaactataattttaaaaacctataaagaaatggatagtccattttatttactcatcttcctttccctgtttttttcttcctttgtggtgttccaagatttttgataaacatttctttgctatttcaagtttactgatttaagctcagtcacttggctttttttaaaatttaggttattgtattttttcattctataattcccatttggtttatttttatatcacctgttcctttgctaagatttttgtatttttttatttgtttcaagaagatttgtaattgattattgatttttttataatagctgctttacaatccttgtcatgtaatcccatcatctgaatcatcttggttctgatatcagctggttgtcttttatcattcaagttgtgattttcttagctcttggaatgacttagttgcatccagaaattgtatttattatgttaggagactctgtgtcaaatataaagcactgttttagcaggaagtgatcttgtttaggtcttggccttcttttgtgggctgttccaaaggcagttcaatgttcagagcctttacaatattatttggttggcttggtttacctattgccactggggctctccatggtctttgctggtgcctcctggaaggataggagattcatcaggccagccaactgcatgtctctctgtaggggagaggtgtggtggagttctccatcaggtcccgtttctcactcccacagttttccttatgtctctggatagagaatggggtctcagacctgcacattcaaacaagcctcctgtgctaatatatttgttatgtttccatctctcctttttgttctacccattcacctggtaatgtctttacatggtatgaattttcactcaaatgattaaataatctttaggtggaccttaggtgggcctcttaaagaatgtttaaatagaatattgaaaagttaggtaattctccattttccctatttatttaaaagttcagcagtatatgttattaatcatcttcacacctcttttaagagtaatataacattttagtaatttttatacacacattttttgatgttctgacatataatctaataattttgcatacattattagtgagtaaatctttagacaagagctgaagatctcaaatgaataatagttttggttgagtaagatattatgtgagcaagaatttttctttattagcatggtttttgcgataacatttcttgaattgtatttattgtttcaatagaaaagccaaatgtatgttggtttttactttttataatggactctgattttttcctgattggtagatgaatactttacttaaactgactattattatactattatgttctactataatataatgcacattattgttattatttatttaacataccaaaatatgaaaacaacattaacaattaatatagcacaaaataattatgcaatattattggagacatgtaatattctataaattaagtatatatttaatacaattttaatattctaattgatttaagtcaaaaagatactatgtgaagttaaattaacatactgtttttgagagaaagcttctgagtagacttgctaaatacaaatttatttctatttagtaacattttgataataaatagcacataaaaaggaaacagagtccctgttacttcttgctcattttgaaacatatggaatacaaatatgatctgaagcctcccttacccttgaaatctaaatgatattagctcaaacctccattacagagtcctgactctcctgtttctgcatatagtcattattatgacccaaagacaaaactcactccaggtataaaactctttcacaacgtggtgaatttagtgacagttttttgataattaaagaagatcacataaatgtatgtcataaattagaaaaatttaatttcatccatgaaacttttctttcttagaaggccttttatccagctcaccaagggagtttcccattgtcctgttacctcatataattacctgttgtcctttcttccctctttctttttattttatcatatggaatagtaaactatcttcccttgctgctcatactcatgattttaagatctcacttctctgctcaatagttctcaaacctggctgctcctgagaaacaactggatcctctccccagagtttttgatataatgctctcaaggggagcccacacatgggtatattttaaaatgttcttcagataattcttgaactcaaaggactaatcaagttatttttcccagtagtttatctaagttgacttctggtactaaatggaaagaaaataacacctctggcttcttacatatgattacatctttacaaactgaaagtacatagtttatttcatgtttacttcagtgtagtcacaatttttttttccactggacactcacagctttttaatgcaagtttttgataatatgaattctaatattttcttgaatttttgaatgtgttagccaggcacaaaatctgattttttgactgattttattttgtactttttggctttgtttttagtattgtttcgaaatgcattgtaaacatgttagattcctgatgaatttaaaattgtgtgatgcttctaatcattgtgatcgtcatggagtaagtaactgcaatgtttattttaaacaacttgcttttaacaatcaaacaatttgaggattttaaaaaaataaatgactttttttgtttgccatttttatgtcatttggtgtcatttaatagtctataatttataacctcaattttgtcttcttaagaaacttatcaaactatttattaaagaagacaaagagaaaacatttaagatgattctggatatattaaatgtttgatggatatgtgaggaggatgtgctataagcaatagaagatagaaactggtaaataaagaccattagaattttcttgctagtgctgcaagttaatttagagtctgggctgtcagctagcaagtaggttataattagtgacaggttactggtaatttgaggtatttgggcctggctatggggggagttaaaagaattttttagaaaaaaatttgatttgacaacacaagatagatgtactttgtgtagtatgaacattagcaagggaaaatttgacaaatttatctatttagataaattctctagaatgagatactctgtggaataagtatagattattcattagtctccatcgaaattattcttttttttattatttaaggtttgcaacaattttaaccattgccattgtgaaaagggatataatcctccttactgccaaccaaagcaaggagcatttggaagtattgatgatggacacttagtaccaccaactggttagtgttcttaaaattgtattaattatgcacagtatgtaagatagtaaattataggtttcaagccagattacaaagcaactaatgtcaacatgcttttttttatttataagatttaaaaaatgttgacagtgcaagtttatactgttctttctatatcagcattgacattctttactgagaaaaagtatggccaatgttaggcagttttaaaagtagaaattttggtgtgtaaaatttgaccagttaatttaaactgttcactttggattatctcctatatttatatttactattatatttatatttactatatttattataaactcctataaactagagtttataatagtgtcagtatagtcattattatattaatgcccctagaatctttcaggctgtcttttcttcctattcacttataattggttatttttctcctgcattgtaagggctccatgctaatctttggagatttgctctttctaatcctgtcctgatgttcctgagtagtattttgagattaatcaggcctagatgaattgggctcaactggtggtgaagggcataccctggttctagaaggtatgagcctacccaaaataactgggagcatagatgggctgcgaactctacccccatctctctcttttttgtgtgtgtgagacggagtttcgctcttgtcccccaggctggagtgcaatggcacgatctctgctcactgcaacctccgcctcctgggttcaagtgattctccagcctcagcctcccaaatagctgggattacaggtgcccaccaccacgcccagcttatttttgtattttcagtagagacgggtttcaccatgttggccaggcctctacccccatctcttttaggaccttgcaagaaagtcctgaaactttggggcagacttatctgtagcttgggtgctatataaacacatacctaggttgatcaactttttaaagagacaatacaaagccacatcaaactatgtatcagacaaaaaaaccccataataatttagcctataacctgtaactatacgcatatattattattttcacatgataacatgaaaaatacatgtttatttgaattatgtattttcagtaaacagtagtttacaatgagaaacagaaagtcctataatatagcaatttaactctttaaaaatcctttactagttcatatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagaccaatggaacaaaacagagccctcaaaaataatgccgcatatctacaaccatctgatctttgacaaacctgacaaaaacaagaaatggggaaacgattccctgtttaataaatggtgctgggaaaactggctagccatatgtagaaagctgaaactggatcccttccttacaccttatacaaaaattaattcaagatggattaaagacttaaatgttagacctaaaaccataaaaatgctagaggaaaacctaggcaataccattcaggacataggcatgggcaaggacttcatgtctaaaacaccaaaagcaatggcaacaaaagccaaaattgacaaatggatctaattaaattaaagagcttctgcacagcaaaagaaactaccatcagagtgaacaggcaacctacagaatgggagaaaatttttgcaatctcctcatctgacaaagggctaatattcaaaatctacaatgaactccaacgaatttacaagaagaaaacaaacaaccccatcaaaaagtgggcgaaggatatgaacggacacttcttaaaagaagacatttatgcagccaaaagacacatgaaaaactgctcatcatcactggccatcagagaaatgcaaatcaaaaccactatgagatatcatctcacaccagttagaatggcaatcattaaaaagtcaggaaataacaggtgctggagaggatgtggagaaataggaacacttttacactgttggtaggactgtaaactagttcaaccattgtggaagtcagtgtggcgattcctcagggatctagaactagaaataccatttgacccagcaatcccattactgggtatatacccaaaggattataaatcatgctgctataaagaaacatgcacatatatgtttattgtggcactattcacagtagcaaagacttggaaccaagccaaatgtccaacaatgatagactggattaagaaaatgtggcacatatacaccatggactactatgcagccataaaaaatgatgagttcatgtcctttgcagggacatggatgaagctggaaaccatcattctcagcaaactatcgcaaggacaaaaaaccaaacaccacatattctcactcataggtgggaattgaacaatgagaacacatggacacaggaaggggaacatcacacaccggggcctgttgtggggtggagggagaggggagggagagcatttggagatatacctaatgttaaatgacgagttaatgtgtgcagcacaccaacatggcacatgtatacatatgtaactaacttgcatgttgtgcacatgtaccctaaaacttaaagtataatttaaaaaaataataaataaaaaaataaaaatcctttactgggcatttaaatttttatttttatttttatttaaatttctatttttatttaaaattttcagcctatattatataccctgaaggtacataaatgtaagactttcaaagaaagaacataaatcagctaattgcttcaacttgggaggtggaggttgcagtgagctgagggcatgacactgcactccagactaggtgacagagtgagactctgactcaataataataataataataataataataataataataaatacagtcatttagcctccttatctgtgatatcttggtcatgctggtgttcgtattataattgttctattttcgttatccaagttcttagaaaacacaattacaatattctcaatttgaaaaattatatgtgtgctatcttgatgcaaagcacaacagtgattttgtagtgtacgtcaaagatggactgttaacactgatgcttttgatacctttaaattgcacatttaagttacattaatcagagtgaacacacaaattgtggttgccaacgtcagcagtaatggaaagaaaaagaaaaaaaagcagcaatagcaactatagaagatggataatcggtgatttagtcatttgacactaaaacagtgttgcttttagtccctatttttttcaccttttatatttcgttttatattaatattttatatttggttcttttccctgcaaccttccacactagttgccaaccagaaatttttctgtcccagtgacagattcactagcatgtaagactttcagtactacaactaggataagttctaggcaaacctatgtgattggtatcctaggcctaccgctctaagtccagatggaagtccagatcgcagcacatgagcctgcagtcagagaaaaccttctaacccaactagtttcctttagccagctgccatgggctcttctttcatctcttccattctggggcttacaggtctaccctgaaagacctaggctgatatgctagttggctgtatgttttgtccccatgtagtccctttggaggccctctacccagtcaaggaggccttgagctttccccaataaagcctggactcaatgtgggagaaacacttgtgatcctgaatgcattttaggacataaagagtttgggctgcaatggtcatctaaatgagtccaggtttatttcatcatccccattctgcttacttttaatgtcactgctttgtgttaacataatatgacccagaaaaaatgtcaaattatggattttatgattgccttaattgtaagccaaaaacattgttgacttttgttactatttcatgaatattttcaaggaacttacaatctgttctacagctctatgtatatagatataatcatataaaatatgtacataattgaatatatatgtgcttgtatgtatgactatcagctttttgcatatgctggagtctaaattcacatatatttttgcctaattgactacttagtatataaaattataaagagtatattttaatctcactttatgatttttctttccatagtttttcattttatcctaaacctcagagatgaccattaataatactatatacattcctgattttcagaggttattattaacccttttaatatttgacaagttcatagaccagaaaaaattatattctacttacatttctttaatgttatggggcttcccagttgcttgatggtgataggaaatttataatttttctatgaattactatttcatcaccgttgtctctctattcttatgggtttgtttgaccttttataacatacgcatgcaaacacacacacacacacacttaagtgttgcacaatactcataaaatttaccatctgaatgctttttaagtgtataattccatgacattaagtacattgttgtgcaacatcatctctctgcagagctctttccatgttgcaaagccaaaactgtaaatcaattaaacaataagccctcattcctcctcttcccaggccctgcaaactattattctattttctgtctctgaatctgacaacttcagtaactcaaaaatggaatgaatcatgctgtatttgtcttttttgaaaaagcctggcttttttcactaagcccgatgtccttaaggttcatacatattgtagtgtgtgtcagaatttcatttcttttaaaggttgaataacattttattgtatgtatataccacattttgtttagctgttcatctgtcaatggatacttgggtttcttccacatttgggctattgtgaataatgtttctgtgactatgggcttacaaatatctcgagactctgttttcagttattttgtgtatatgtccagaagtgaacttgctgtgtcatatgatgattatatttctaaatattttgaggaatcaccatactattttccagcagcgactttgttttacattcccactagcagtgtacaagttattttctgtttcaatttctccacatccttgtcaatacttgttattttctgttttttttttttttttttttttctgattatagccatcctgatgggtatgaagtggtatctttttgtctctttcatccctgtataggtataatagggtcttatagatcagaaatttatcatttttaaaaagggcatggttttgttaaaaattggttattgggagatattttctgtcattgtatttcaacattacttgttacatgtagaaaatctactgatatttgtgcataaattttatcaatggattatcactatattgagaagtctatttgtttatttttggggatgaacatttttgaaatgatgtaaactgcaattaacagtaattttgccacatcttttcaacaataattctgtgaatggagagagagagagatagagagagacagaaagagagagagggagggagggagcacatgcattctggtctctcctctttttatgaagacaacaatcccatcagattaggaccccacacttattacctcatttaaccctaattatttctcaaagtcctcatctccaaatatcatcacattgggggttgaggcttaaacatatgtatttagggggacacaattcagtctataaaattccactctgtgttccccaaattcatgttcttcttacatgcaaaaaaattcatcccatgccaagagtcccaaaagccttaagccattccagcatcaattttaagtagaaagtctcatctgaatagcatctaaatcaggaatgggtaacatttgagatatgatttatcttgagacaaaatttctccccaactgtgaaagtgtaaaaccagacaaattatgtgtttccaaaatatattttatttatttatttatttattttgagacagagtctcgctctgtcgcccaggctggagtgcagtggcgcgatctctgctcactgcaagctctgcctcccgggttcacgccattctcctgcctcagcctcccgagtagctgggactacaggcgcccgccaccacacccggctaattttttgtattttagtagagacggggtttcactgtattagtcaggatggtcttgatctcctgacctcctgatctgcctacttcggcctcccaaagtgctgggattacaggtatgagccaccacgcccagccctgtttcaaaaatatagtggtgaaataagcataggacagacattcccattccgaaagggagaaattagaaggcaggaagaggtgatgggtttcaagaaattccaaaacctagcagtgcaagttccgttgtgtcttaggcttgagagttggccatacactacacaccagacacctcaattgctttgtctttagtctcccatatgaactgagatgtaaattaaatcctatccaaatcctatttggctgaatgttcttccttccaggctcactgaggtggtgcattacttccacaatcctaggtggcagtcccactcccttggcttgggagcctaccctgttcatactatctttacaatgtcccacccataaggcactgggctagggcaacttggtccgctgaaattaaaaaggaggccccgccctgtataaccaaagagaatgcagccttgatcctttggtctgtggcaccccgataatctttgagtcaaaggcgcaattattctttacttttcttgaaagataaagcatgctcatagcaaaatagcccttttgtcccattctttttccttcatttccaactggcaatgtctctgccagtataattccatctatgctggtattgtcttatgtttctgatttctgctgagatggctgattaaatccattattcacatccgtaatctctttatcaaatgattttctagccacacccttggtattctctccagaacacgttttctgattttgggaaatatggataggctgagaatttctggctaacaattatttcaattacttctttaatccatctctcctctctttcattttaccataagcagtcaggaggactcaggccataacttgaacattttgcctaggggtcacctcagctgttatctaacgtcagcttgcaaactctatctttcacaaaactttagaacacaagttagccaagtctttgccactttttaacaggaatgacctttccttcattgtccaataacatgttgctttatttctgtctaagacctcactagaagcacctttaatattcatatttctcccaacattctgttcatgattatgtacatattctctaagaagaggtaggcgttcccttttctctcagtgccctcaccagaatcacctttaatatctatatttctatcaacagtcctttattgcaatctaggctttttttagtttacaccttaaaatgattccaacctctacccattacccagtcccacagccactgctgtatttttaggtatttgttagagcagcacctcatatcttggtaccaaaatctgtattaatcagggttctccagagaaactgatcgaataagatattagttcatcatatggtggaaggttgagaactcaaaaatcatcaataaaacactagtaacatcccatttggtacattagtgtttttgtttttattatattcactttatatatataaaagaaatgtttgatgtttggaaatgatgttggtaatgatatcttctccttttcattgggataataaaatctctgacgtaacttaaaattgctgtttttcattccagagagaagttacatggaggagggaagataggccacttttcaaaaacaacggtttcaactcattttctacatttctctacctgtgcttcttattactactgccattttaataaaacagaaaaaattgagagagctatgctatagaggggaaaatgaaagtgagaggtatgtatatacatatatatgtaaaaaaatatatatacatatatttactcttattacattaagaaagacaagaaaaatgtatttatgtttcatcaggaataatctccaactgtagctaaggcaatataaagagaggctcagggagacattttaaaaatggtttgatgctgtttgttatttgttttgatattttttctcatcttacaaattactaaaactacagagtttaccactagtatcatggtaagagcagatatggctgccaggagaattttggaggtttatttagcctcttagttcaccgaccctgtccatacagtcatatcacctatgagctctattagaattatatgacactgcatttcaagggaacttccaaaaactaaatttattagatacagattttcaggccagtgataaacatctttattagaacacctctctcaattagagataatatctataaacctattttgacaatatttatttttctaaatatagatattgctgatttgtaaaatcatttcttaattagaaactacatgtgtagttaataatgtcaggttaaagagacaggaggcaccaccatgtaggaagagaattacgcttagcttcaggaaacctcgttttaagttataaatcttgcatgtaatactgtgataccgtgagtaagtgatttaatctttatttccttaagattattctctataactctacagaatgggaggtaataatagcttttcaatttatctaaacttttgagtacatccatttaatgagtgaaatcatcatgttatctgtaatcagttgcacaaatttttaaacatcatattgagccccttattcataatttacaatatttcatcacagatatatttacatctaggtttaccctccgagaactgatgcaaagataaaacgtgtttatattttctgagagagagaaagaaatatattgatctgtaaagaaaaagtatttaaaatttttgagtgctactttatggtttgccttattggaacggaggaattagggatatcataaaataaggggagctgcctatataaatgtgggtttacaaacataaattcttgattaaatgtagaatgagaatgagaagactcagttaccagactgaggtaactgatggcatttgttctaatattgaaacagtacctgtttaagttgttaaaaggagacctttcatttatttgaatcgctgtttctttgaagaacagttttcattcagttgtttaattattcaagaattacaattttcatcactttaaaacaaagtttatcaattttatagctctgtgtcagaagaaagcagcagtaacagcaagtcatccctcagtgaaaggtgagtatgggactatgtgttgaatcattttgcattgtaagttttgatcattgcttaggagcacttaaaaatggttagtttgaaaccaagcattctttatgtatttgtttaattctctccataggtcattttataataataaataataaaaccttggttttgtgaaatctcagcctctccttgacctataaaaggagagatttttgtgcactcacactggcaactaccatctatgagcatgtaaattgtgagttgtttttttttttttagcatcggggttttttttttttaagcatttttttttttagcatgtgttttagtgatatcttactggcatataaaaagataactgatgctctaatcagcggtaccatcctttttggcatcatggaccggtttagtggaataaaatttttccacagggtggggtagagggggatagtttcagctcacatcatcaatcattagttagattcccataaggagtgtgcaacctagacctctcatacgtgcagttcacaatagagttcatgctgctatgagaatctaatgccactgctgagctgacaggaggtggagctgaggcagtaatgcttgctggcctgtgctcaccttgtgctttgtggcctggttccttttatttatatgtgtgtgtgtgtgtgtgtgtgtgtgtgtgtgtatatatatgtatgtgtatatatatatgtgtatatatatgtatatatgtatatatatgtgtatatatataaattatactttaagttctagggtacatgtgcacaatgtgcaggtttgttacatatgtatgcatgtgccatgttggtgtgctgcacccattaactcgtcatttacattaggtatatctcctaatgctatccctccccctccccccaccccacgacaggccccggtatgtgatgttccccctcctgtgtccaagtgttctcattgttcaattcccacctatgagtgagaacatacagtgtttggttttttgtccttgcaatagtttgctgagaatgatggtttccagcttcacccatgtccctacaaagacatgaactcatcattttttatggccgcatagtattctgtggtgtgtatgtgccacattttcttaatccagtctatcattgttggacatttggcttggttccaagtctttgctattgtgaatagtgccacaataaacatacgtgtgcatgtgtctttgtagcagcatgatttataatcctctgggtatatacccagtaatgggatggctgggtcaaatagtatttctagttctagatccctgaggaatcaccacactgacttccacagtggttgaactagtttacagtcccacgaacggtgtaaaagtgttcctatttcttcacatcctctccagcacctgttatttcctgactttttaatgatcgccattctaactggtgtgagatggtatctcattgtggttttcatttgcatttctctgatgaccagtgatgatgaacattttttcatgtgtctgttggctgcataaatgtcttcttttgagaagtgtctgttcatatccttcacccactttttgatggggttgtttgttttttttcttgtaaatttgtttgtgttctttgtagattctggatattagccgtttgtcagatgaggagatagcaaaaattttctcccattctgtaggttgcctagtggtctgctttctaagaagccatggctgtggggttggggacccctgctctaaatgatgtcataggtgcttatagttctgctattatttcagaaaaaaaattactgagagtaagtttgagcattgaaattatcattcatttccctgtctcaattcatctgagatagtaaatttagggatcagattatgaagaatcaaacacaacattttataaaattagatatccttcttttactatcagtatatacagattttccctaccaaatgttggatagactataaaatgggagagtatttcaagtagcatccaatattatttctcatgttctctcttcatccttggagtacaaagttaaacactgactgtgatgattcatttagtaaatattgagatacatatctgcagtgagggaattcctgcttttaagagaagcactgttaaatatgggccatcaccgtcctaattctattgttaatgttggctgctttaggttctacaaaaattaagcatatctctgctttctaggcaagattatctttgatccttactttgatcactttgtgatgcatattatagaagagaaaataatcaaaagtgtttttattataattcctaccaagaagatagaaaaaagagctacttacactcaaaaattgtggatggaaggaagtactaaagagcagaaataatgtagaggaaaataaacagataaaaacataagcaaagacaaaagctgattctttgaaaagattaatataattgataaacattagctaatagttcaaaataaaacgagaaatgatacaaattactatcatgtaataaaatgatatcatgtctaattttctggacattagaagaagtcaaagttgataagtttaaatatttagttaaaatacaacacatttttaaaaaaacacttctttccatcttcccaaaatggaatagagagaagaaaaagaaagtataaagaagtctatatttattcaagacctggaagctgtaatttagaactttctcacaaagtggatacttgagcatgatcttttcatggcatgcatcagaacacaaagccaagccaaattcagtgaacatttcctcaattccatcagcttatgttttattatataaacaagtaacaatgtcaaactcagtgtcaatgaaggtggtgtgtgtaatatactccatccactataatgggagatactacaaagtcacatggcaaagaacatgtataaataatcgtatcttaagatataagtgaaaaattgaggacaataattcaaactattacatccagatgtttaaggaggaaatacagaaatacagcagtcctcccttatctgtgtgtgtgggagacattccaagacccgtaatggatgtctaaaatcacaaatagtaacaattctacatttacttgttttttcctatatatatgtacctatgattaagtttaatttgtaaattagacacatcaagagattaagaataaataataatataattgaacaattataatagtgtaatgtaataaaagttatgtgaatatgatctctctgtctcaaaatactggagttttttttgaagtgtggttgactgaagataatttaaagcataaaaaacaaaactgcagataagaggggactactgtaataccactcttacatatacttatgccgagaatacaacaaagggagcatttctcatcatgttttatgaggtcagcctagctttatggcccccaaatttaagggaactatcagaaaagaaaattatagatctatttctaattagagatgtagaaatgctaaataaaagatttctaaataaatccacttagtattatagaggatcatatattatggccatggagatagcctaggtatctaagaatgaaaaactagtttaaaatatgttttaccatattaaggaaaaggagaaaaaattatatgataatttctatatataaagaaaaataccctttaaagaaaaaaaaacacttttatgataaaaattcctagttaactagtgaaaaaaacttttaaaaactgataaggaacatcttcaaaaaagcatacaactattttagttaatagtgaaatcgtgaatgtttccttcctgaggtcaggaggatgtccgttattgttttcaacactgacattttcaacatcatatgggaaatcctagctggtaaaataaggtaagaaagaagtaagcaaatgtagtaagatcagaaatgaagaaagaatactgttattgtttgcagatgatatggcttcaaatttcaatgcacaaaaatttgaagaaataacaaaacaaaattaataaagaaaatataaggtttttggatacaaggctacatataaaaatcaattttatttttgtgtaagcaacagttataaaatgaaatttaaaaaatgcaactatatatagtatagggaaatatgtatatatgatacatagggatatatatccagtgaaaaagtgcaatacagttacacttgtaatataaaatactgctgagaattttaatatctaaaccagttgaagaacatactgttcaatatttttaagatataatttttccctaattgatatgtagatttaatgcaatcccaaaataaatatcttgacattttttggtggaaaattaaaattagattgtaaaatttatataaagataaatggagtcatatagtcaacaaaatcttgaaaacacaggaaaaagaaaacttatactacctgatattgacaacttttgttaagtaatcaaaacaatataggagcatcataggacagacaaataaaccaataaaaaagaaggaagtgttcagaaacagttgtataatatactcacatcttatttatacttctggtgccactattatttagtggataaaaaagtgatcttttcaatatatagtaggttttaaattgcatttccttgatgacatatgaattagtgatgtggagcacctttccatatacctgttcttcgtttttatgttttccttggagaactgtctgtctagcttatttgcccattttttgatcaatttatttgtttttctgcaattgaattgtaaaagtattttatacattttggatattaatcttttgccagagatgtggtttgcaaatatttttcctagtctataggttctcctttcattatattgcttctttagctgtacagaagcttgctagattaacatagttccatttattcatttttgttttgcggcctgagctttggtgtgatgtctaaaaattaattgctaaggccagtatcaaagagctttccttctatgttctctgttaagagttttattatttcaggtcaagaatttaggcattttcttcctttttgatttcattgttgtgtatggtgtaagaaagaatctgattttattcttttgtatatgaaaatctagtttttccagaaccacttattgaagagactactgtttccccattctgtcctctaggtgcccttgttgaaaattagttgatcatatatgtttggatttatttctgggctccctattttgttccattggtcaatgtttctgttttgatgtcagtgccattaatgtcttgattactatagctttgtaatataacttcagatctggaaggcaaagtctccaactttgtttttctttctcagtattggtttaactatttggaattttttgtggttccatattaattttaggtttgtttttctatttctgtgaggaatgccactggcatttctagagagattttgttaaatctgcatattgatttgaatatcatgaacatttcaatattattttgatccatgaacatggtatgtctttacatttatttgtgtcttcttcatctcctttaatcaatgttttattgtgttcagtgtacaaatgttccaccttcgtgattaatttgaattctaagtatattatgtttttgatgttatcagaaatggaaccgttttattaatttctttttcagctaggtggttcttcgtatataaaaatacttgtgattttttatattgattttgtatcctacaactatactgaattcatttattggttttttctaagctttggggttttctacatataggattatgtcaattgcaaatagagataatttacttcctcctttctgatttagaggccttttatttattttccttgtctgattgtatgtactagtacttccagtactatgttgaatagaaatgatgagaatgggcatttttgctttataccagatcttagtgcaaaagctttatgatgttagctatgggtttttaacaaatgtcctttattatgttgagaaaactgtcttatatatctaaactgttgaaaatattagaaaaggatgctgaagtttgtcaaaagcttttttgatgagtctgtcccacagactctggccaggcaaccaatgaaagaaatacacagacacaggtattttgcctgagaatgcagctagggaactgcacagcttagcaccgctgacaagagtgcagctccaataagctggagatgctcgtatttattcagtgcagatttaatgacaaaggcttggagcaaacacaatttgtgggtaattaacattgtccactcccctgagtatagagcagtcctacagtaaacaaatttatctagataagttcctttacattcccttgttatctaccctttgccctcagcctctggataagagaatttggctgccttcagccataattctcttctgaagcttttgcaaaactacccagccttccaagaaggtttgcgtctttcctatttttcccaccaccctgactgatcctcctacacttctttgtgtgtaaatttacatgatcatgaggtttttattttcttattctgttaatgtgatatggcatattgatttgcatgtgttaaagcagacttgcatgccaggaataaatccaacctggttatgatgtgtaaacttttgatgtgttgttgagttcagtttgctactgtattattgatgattattgcatcaatgttcatcagagatactggcctgtagtttcatttatttatttttttgggcagtgtctctgacttaggcatcaaggtgatgctggtcttgtaaaatgttttagaaagtgttcctttcagctctaatttttggaaaaatttaagaaatactgataataattcttccctgaatttttggtagaattcagctatgaaaccatctggtcctgggatttttatttgctgaaatgtttttaattcttcaagctatctatttcctcctgattcaatcttcagatgatatttttctaggaatctatctatttcctcaaagttatcaattttgttgacgtataattcctcataatcaccctttttaaaacttttttatttctgaggcatctggtagtgatgtctccacttttatttctaatttatttatttaagtattatctctctctctttttaaaaattactctatctaggagtttgccaattttattttttaaataatcaactcttggttttattgatttttttttcttgtttctcggtcatctatttgatttatttcagttctaatctttattatttcctttcattcaataactttggatttcatttgttctttttacagctccttgaggcacaatgtttggctatttacttgggatctttcatcttttctaatgtaggcatttattgctacaaacttctcttttagaactacttttgctgcatcctgtgctatgtgaactccaggaagctccctaggttggtgtcagtggctgtaaggactacaggattctccagtagcaaagagtgtggtgtctgtggtgataatgggaactgttggggtctactgcttacctttttccctgcagaaaaacttcccttcaggttttgatctgattctgactgtggggatggggtagcacagggaaagtgttttcttctcttctctatgcagccatcctgagtgtctatgcttcacaaaatttctgccactcccttgatgtacacctgagctctccttagtctttttggtcaaaactagcttatttgttgttttggtctttttgtgggaggagatgagcattaggcacctctagcttaacatctagctgatattcctcagaatatgtaatggtggtgggtaaatcacttttaattctactataatatcaaaagacaaaagcattaaaataattataagtaagaatatgttaatgggcacataatgtaagttgtaatataaagtgtgacatcagtaacaaagtattattgggaggacaataaaagtgtattattgggaggacaataaaagtgtattattgggaggacaataaaactgtagtgtttaaatgtgattaatagtatcagttcaaaacaaactgttacaagatttttaaatataagctgcatagtaataaaaatacttacagaagttacacaaaagtgaaagagaaaggaattatacaataaaaaagtaaatgaaacatgaaggaatacagcaagagaataaaagagggacaaaataaccataagattaaacagaaaaagataattaacaaaaggcattagtaaggcatgatggctgaatagaatccttcagcaattgtacgcactaccaagaacatcaagtcaaacaattatcaatttaagaaagcatcttcataggagcccaaaaccagataagcaatcacattacatggtgttagcataataacgtggaaggatgcactgaaggaggtcaaaaggacagagttccatttcctgcatcacccctcccccagtgccaggcagtatatcacagaagagaggctgtgctcttgggggagggaaagcaaagttggtgtggaactttgcactgaaactcagtgctgcactgtcacagcggaacacagcactaggcagaattccaccagtgctgacagcgagcatttagatcagtcgtgggccaaggggactccactgcttcagcacgaggaacccaagtctcagcctacttcactgcaggctgatgaacatggcctggggccccaaataaccttgagtggcagctaggccatagtgactacagtccttgggtaagccctggtgctgtcctggtctcagatgctgtaggcttgatgtacagcccagcgcaacactagctgtggcagccatgagagtgcctacatcacccctttcccaattccataccatgtagtatggagagagactttttctgcttgggagaaggaggggaaagagtacaatagactttattttgcaaccaggtaccagcccaggcacaggaaaataaagcatacggcagaatcccaaagtcctaatttcaggtcattgctcctaaatggtgtttctaggtcttctaaactttggttagaagagatctggctgcccttgtgggatggaccgttgtccaacctgtgtgatgaaccaccagttaactaaagtagccttgaataaacatcaatggcagtcaggcaatggtagcttcggtcctcagatgagccccaggtgagccccagtactatgctgatctgggaggctgtaggcttcaggtgtgacacagcagggtaccagctgtgatggccacaggagtgctcgtgtcttccctttcccaattccaggcagcccactacacagacagattccttctgcctggggaaaagagagagaagagagcaagggactttgcctgtgaacagaggaatttctccctattttcctccaagtccatcagagttgtgtatttaggagtctgcaagagatacagcatatctgggcttagagatccctctagcactgaaacgcctgtagaggcaacagacttgagtaacttaatactcaatcttctttaaattcttggaaagtcatttgaagaagggcaagtaaaaacaaagccagactctgaagactagaataaatacctagagacatcaatagactgcaatgcaatagtagtaggggccttttaacaccacactttcagcaatggtcagatcaccagacagaaaatcatcaatgaactattggaattaaacaacactagatcaaatggccctaactgacatttacagaatattttatgtaactggtgcagaacatatgttaatttcatcagcacatagaacatcctccaggacagatcatatgtaaagccacaaaacaagtcataacacattcaaagatggaataatatcaagtatcattttgaaaaacaatggaatgaaactagaaatcaatgaaaagaggaactttggaaacgatacaaatacatgaaactttaacaatgtgctcctgaaagaccagtgtgtcaatagagaaattaagaaagaaatatttttaaaaattgaaggaaacaaaaatggaaacagaacataccaaagtctgtggaatgcagcaaaaccagtactaaaaggaaagtttatacctatacatactgacatcaaaaaagtagaaagacttcagttatgcaacctcatggtgcactgcaagaaaaaaagcaaggacaaaccaaaccacacattagtagaagaaaataaataataaaaactagagcagaaataaatgaaattgagaattagaaaggtccatgaaacaagaagtttgtttttgaaaagataaacacatcttttgctacattgactaagaaaaagaaaaaaatggattgaatacttaaatgtaagatacgatttatatgaacccaaatcagagaaaaatcattacaattgacacttcagtaatttaaaggcagcattcaagtagagatattatgagcaaaagtgtgtcaataatttggaaaacctagaagaaatggacaaatttctagacacattcagcctatcaagattgaaccatgaataacagaaaatctgaacagatcaataatgaataatgacatagtagctgcaataaaaagttttccatccaagaaaagttcaggactagatagctttaatattgtatcctaccaaatatttaacgaagaactagtaccaattttactcaaactattccaaaaccttgagaaggagggaatattcccaatatcattctacaaggccaacatttccttcaaaaaccttacaaagacacagcaataacaacaaaaaactacaggccaacatcctgatgaaaatgcaaaaatcctcatctctactaaaataccaaaaaaaaaaaaatttagccaggcatggtgatgcaagcctgtaatcccagctacttgggaggccaaggcaggagaataacttgagcatgggaggcagaggttgcagtgggccgagatcatgccaccaacctccagcttgggtgacagagtgagactccatcttaaaaataaataaaaatgaaaataaaaataaaaataaaacacttataaaagaaattaaagaggacacaaaaaagtggaaatatatcccaagctcatggattggaagaattaatactgtttaaatgtccgtataacccaaagcaatctacagattcaatgcaatcgctatcaaaataccaatgacgttcttcacagaaatagaacaataatccaaaaattcgtatggaaccacaaaagatagtctctttaacaaatagtgttgggaatactttatatcctcatgctaaagaatgaaattgggccattatacacaaaggccaactcaaaatggattgaagacttaaatgtaagatatgaattataaaactcttagaagaaaacatagagaaaaatcttcatgacattggtcttggcaatgatttcatggatatgacatgaaaagcacagacaacaaataaaaaaaagacatatggggcaacattaaactcaaaagcttcttcatagcaaaggaaatgctgaaaatccaatggaatgggagaaaatatttgcaaaccatttatcagttaaggggctaattcccaaaatatattaagaactctttcaactcaatagcaaaaaactaataacctgattaaaagttagctgaagacttgaatagacattttgccaaagaaaatatataagactcttacaactctgtagcaaaatacctaataatttaaaaaatgggctaaagacttcaatagacatttctccaaagaggacatacaagtggccaataggcatatgaaaagatgctcaatttcattaactatcaaatgtatgctaatcaaaaccgcaatgagattcacctcacacctgttaggatagatcttaaaaacaacaacaacaacagagaaatgttgaggaggatgtggagaaattagaatctttgtgtatactgttggtgggaatgcaaaatgttgaaaccattatggaaaatgacatggagggttatcaaaaattaaaaatacaattacaatataacccagcaattctacttcttgaaatttatggaaaagaattgaaatcaggaaaccgaagagatattagcattctaatgttcactgaagcactattcacaactgccaagtgtggctacaacctaaatgtccatcgataaataagtggataaaaataaatgtggcatctctctcctcctttctctctctctctctctcgctctctctttctctctctctctctcactctctctctctttctctctctctctctctctctctctgtgtgtgtgtgtgtgtgtgtgtatgtgtatgtatctaatggaatattattcagccttaaaaagaagatcctgtaatgtgtaaaacatggatgaaccttgaggacaaacactgaataattccacttatgtgaggtatctaaaaagtcaaactcacaaaattagagcagaatggtggtttccaggaaccagggggtggagcaaatgggtagttgcgtcagtgggcataaagtctcaaatatgcatgatgaaaatgttctagagatctggtgaaaaacattgtccctaaaattaacaaaaccatattgtacacttaaaaatgtggtaagatggtcgatctcatgctgtgttcttaccatatatagtacaaattttttaaaataaatacttttgccatttataagatacccttaagaagggaaaaaggaaccgcagggatgcggttacactggcgagaaaacagttttggcggcggggagagttggggagggtggagggggtgttgtgatgggaggggtgatttacagagtgagtagcagatgtggaaggtgggctctacagataaagacttcgaggaaggttgtttcccagggcaagggaacacagagagtgagggagtcttgtcttgaaagcaggaaacaaaggactaggaaacttaaacaagttaaccctttgaagaagaatgtcttactgtatttaacattttgaaagtctattattgtgaatatttatgccacttccagtttttagttattacaaatacaccgtaataagcattctggtatgtatatatatctgtgagcaattgtcaagttatcgcctgagataaatccctagaagatatcaagaataaatatagtgtaatatgaagacttttgttgttttaaaatatctattactaaattatcagtccatttgtatcaagttgtaactttcataatttattaatttattagctagtttggatatgtgagtggtatactttctgagccctagcatatcttaaattctacttcttttattttactaccttactgaattttctttgtaattttccactatgtcactttgtaatgagctatttctataaagaatatagaaatagaagtagaaaatacgaaatatgaacatctggaattagaggcattttgagactccctttagtatgaaggaagcttagcatattttacctttaaaaaatctctcccttcactaatctttctgttatgtaaattgagattttagacctagcctactgttaataaatttctgcttttaaatattatttattttggttctaaaatattttgtctttttcagttttataaagtttacagcaaacattttgaattcatttatatttaactggttttattttttaaagttctaaagaatgattttaacttttaatggtgttaagatccttttctagccagagaacttggaatgcatgaatcttaactttaccatcactttcttctcttattcaataaataatgtgtgcatgtgagtgtgtgaatcattcttattattatagtagtaacacataataaacattgattaaaatatatatgtgagtaaaagaatgaaatggtaatcatcattagtcccagcaccaggggtgatcattctttaaaaatttcattatatagatatacacaccaatgtgcatgcatgcatgtgtgtgtatatgtacatgttggtgttatctaataaaaagatacttagaattaccacctttcaattttaaaataaaattgttgcatatatttagaatggagttttcaagtcactttatttattgatgtaaatagttaccaaacatggataaaaaaccagtgtactttaaccagtcacttctattttaaaactaagagtatcttcagtcgtggtaacaagtaatatttttctggaatttttattttcttaattttttgcttttaatcacccatagttttaaaattacttgagttagaaatgtgttagctacaagaaagaaaaatgagcaacattggcgtttgttttgttttctcctacagcaccagtctctaacaaccttgaatgctactgcttggagagaggagagtaacaaatacattatcagaaactggcccaaaccaaggaggaacaagacacaatttctctctcattgctcttgtcactgctgagggttttaaactatgaaataaatcatctggcctgaatctcatgacttacgtccattgaattctctgtatttgcagtccaaattctaccctatcaaatttggatccataagatgctctgaatcaggtgaaaggagcctaagaccctcatctcataaaggcaagagggactgccagtcagcctcacagcagagagtatctgttttcccttctgcttcttaggttgaccagaatctccctcaagtctgacctatcccctttccttcagagttcctagcgtctaggtattctgtgactggttacagtgacatttatgcagatggtatctgagtccaatccctgtcttcttactcctgctcatttatgaaagctgtaaagccactttagtgtgttaaaatacctgtttgccaaaagtagatttaccataaagctaaggaagcaaaaacttaagagcaacttagttgcacagattctcttcaaagtcatgaagctaactttgtattcttagagtttatcaaattttatatggtcaggccccattgagcctgaatcatctcgctgttcacaagttcccttggcagtggtgtgctagagccatttcatactatctcaccagagctcaccagttaaaatttcagaatatttgcaagtcagttgttaaacagccactattaaaaacattacttaaatctaaataaattaaaaatcaatacttgaaagacaccatttattcattattttgttgtatttttatctttgctttttaggttataattattgcatctttatggtggaattagtatattatggtaatgtatgacttgcatgtattaccaactcttctagaaatatcaaatggtagcttgaaattagcctttgctgagactgataaacctatcaatgtggacttcctctccctcacatcacagaaatagctgtataataattgctagcaaaccactgttcttgggggtagttcaccttttttctatttttgttttcaatagcttgttgaagctacttttctatcatggctcaaatctatctccaactctttctgaatatgattacccaattggtatcaaaaaattgggtatagaaagaatataactaaacacaataaaggccatgtgttaaaaattaaaccccacagttaacatcatactgaatgaggaaaagctgaaagcttttcttgtacgatctggaacaaggcaagcttctcacttctaccacttttattcaacatactattggaagtactagccagagcaattaggcaagagaaagaaaataaaaggcatataaataggaaaggaagaagtcaaagtatccctgtttgccgatgacataatcatatatatagaaaatcctgaagacttcaccaaaaaaattgttagaaaaaataaatcaagatagtaaagttgcagaatgcaaaattaacatacaaaaatcagtagcatttctatataccaatagtaaactagatgaaaaagaaatcaagaagcaaattaatttacaatagctataaaattttaaatatctaggaataaaccaagaaggtgaaagagctctacaatgaaaaatataaaagattgtaaaagaagttgaagaggacacaagtaaaaaattccatgttcatggatcagaagaattaatattgtcaaaatgtccatgtttatccaaagcaatcttcagattcaatgaaatctctatcaaaataccagtgaaattcttcccagaaatagaaaaaacaatcttaaaatccatacggaaatggaaaagactctagtagccaaagccatcttgagcaaaaagaacgaagctggaggcatcacagtacccacttcaaaatatgctacaaaagtataataatgaaaacagcatggcactggcataaaaacagtcacatagaacaatggaatcaaatagagaaataaatccatgtatttagggccagctaattttcatcaaaggtagcaaaacacacattgggagaagaactgtctttgtctcctcagtaagtggtgctggcaaaactggctatccacatgcagaacagtaaaaccagggcactatctctcaccatatacccaaacttaactcaaaataaattaaagacttaaatttaagaccccaaactatgaaactactagaagactataggggaaatactttataaaattggactaggcaaggatttttttcaataagacctcagaagaacaggcaataaaagtaaaaatagacaaatgggattacatcaaagtaaaatacttctgcacaacaaaggaaatcaatagtgtgaaaagacaatctataggttaagaaaaagtatttgcaaaatatacttctgacaagggattaatacccagaatatataaggaactcaaacaattcagtagcaaaacaaaccaagtaatccaatttaaaaatgggcaaacgacctgaatagacatttctcaaaagaagaagtaatggccaagagacatacaggcatatgaaaatgtgctcaacataattgattgtcagaaaaatgcaaatagaaactaccatgagatatcatctcaccccagttaaaatagcttatataaaaaagataaggaataacatatgctggtgagaaagtggagaaaaaggaacccttgtacactattagtgggaacataaattagtacaaccagtatgaataacagtttgcaggttcctcaaaatctaaaacttggggtaccatatgatctagcagtaccactgctgggcatatacccaaaagaaacaaaatcaggccaggtgcagtggctcatgcctctaatcccagcactttgggaggctgagacagttggatcacctgaggtcaggaattcgagaccagcctggccaacatggtgaaaccccatctctactaaaaatacaaatattagtctggcatggtagtgggcacctgtaatcccagctacttgggaagttggggcagaagaatcgcttgaacctaggaggcggaggttgcactgagccgagattgcaccattgcacttcagcctgggcaacaagagtgaaactctgtctcaaaaaaaaaaaggaaagaaaagaaaaagaaaaagaaaaagatcagtatattgaagagatatatgcactcccatgtttgttgcagcactgttcacaatagccaaaaaattggaaacaacctaagcatccatcaacaaaagaatggatacagaaaatgtggtacactgccgatcattatgttaagtgaaataagccaggcacagaaagacagacatcaaatattgtcacttgttagtggtatctaaaaatcaaaacaattgaactcatggagatagagagtagaaggatggttaccagaggctcggaatggtagtggcaatgagggtgagggttctggaggggagatattcttgttcattcatggaattttactcattcataggaagaatgaataagacctactatttgctagcacaacaaggtgactataataatatacttgtacatttttaaataactaaaaatacagttggattctttgtaacacaaaggaaaaattgagggaatagataccattctgcatgatgtgattattactcattgcacacctgtatcaaaatatctcatgtacctcataaatatctacacctactatgtatccaaaaaaatttaaaaataaaatggccaagatgtacatgaaaaaatggtcaacatcactaatcatcagtaaaattcaaagtaatagtgagatactatttcacctcagttagaatggctcttatcaaaacaccaggggtttggtcttggttctgctgctcactgcacagaaagccaataagtattgccagggaagatggctttaattgggtgctgcagccaagtccaaattcatctccctgatcaaattagagatttacatagtagggaagaaatatgtaactatgtgtgggaaaacaggaactcaggaggggtaaagaagcaatcatgggctgggtgtggtggctcacgcttgtaatcccagcactttgggaggcagaggtgggtgaatcatccaaaggtcaggagttgaagaccagcctggccatcatggagaaaccctgtctctactagaaatacaaaaattagccaggcttggtggtggatgcctgtagtcccagctactcaagagattggggcaggagaatcacttgaacccaggaaggggaggttgcagtgagctgagatcgcaccattgcactccagcatggatgatagagattctgtctgaaaaataaaacaaaacaaagcaaacaaacaaaaaaacaaataaattaaagaagcaatcgtgatgaatgagagaatgaattattgtctgaatgtgatgatctggtgagtttcagttttttgataccttctgagaggcctgggaatcctttcctgaggaaggaactcagataaaatgaatgtaagtgtcaagctttaacaccagaagggtcaatttctatgtttatcaaaaacaaacaaatgaaaacaaaactgtccatgggactcttggattggcttcatggctatgaatacaaaaaaaaaaaaagtgaatgctgatgagaatgtaaagaaaggggaactcttttgcactgttaatgggaatgtaaattagtacaaccattatggaaaacagtaaggggatgtctcaaaaaactaaaaatagaactaccatgtgagcctgcaatcccattactgggtgtatatccaaaggaaatgaaactttatgttgaagagatttataccatcgcttgtttattgtagcattattaacaatagccaatatatgaaatcaacgtaaaagcctatctactgattaatggatttaaaaatgtgatatatatacaaaacaaaatattcttcagccatatgaaacaatgaaattctgtcatttgcagcgacgtggatgaagctggagggcattgttaagtgaaataagccaggcagtgagacacaaatgatctcaactcacgtgggatcaacaaagttgatttcatagaagttaagtagaatagtgattactagagttttgaggtgagggtactgtattagtccattttcatgttgctgttaaagacatacccaagactgggaagagaaagagttttaattggacttacagttccacatggctggggaggcctcagaatcatggcaggaggcaaaaggcacttcttacatggcagcagagagagaaaatgaggaagaaacaaaagtggaagcccctgataaacccatcagatctcaggagacttattcactatcacgagaatagcatgggaaagaccagcctccatgattcaattacctttccctgggtccctcccacaacatgtgggaattctgggagatacaattcaagttgagatctgagtagggacacagccaaaccacatcattccacccctggtccctcccaaatctcatgtcttcacatttcaaaaccaatcatgccttcccaacagtcccccaaagtcttaactcatttcagcattaactcagaagtccacagcccaaagtttcatttgagacaaggcaagtcacttctgcctatgagcctgtaaaatcaaaagcaagctagttacttcctagatacaatggaggtacaggcattgggtaaatacagccattccaaatgggagaaattggccaaaacaaaggggttacagggcccatgtaagtttgaaatccagcagggcagtcacattttaaagctccaaaatgatctctttgaccccaggtctcacatccaggtcacactgttgcaagaggtgggctcccatggtcttgggcagctccacccttatggctttgcagggtatagcctccctcctggctactttcatgggctggcattgagtgcctgtggcttttccaggtgcatggtacaagctgttggtggatctaccattctggggtctggaggacggtggacctcttctcatagctccactaggcagtgccccagtagggactctgtgtacgggctctgaccccacatttcccttccacactgtcctagcagaggttccctaaccctgcagcaaactttttcctgagcatccagtgtttccatacatcttttgaaatctaagtggagggtcccaaacctcaattattgacttctgtgcacctgcatgctcagcaccacatggaagctgccaagacttggtgcttccaccctctgaagccacagcccgagctctatgttggcccctttcagccatggctagagcagctggggcacagggcaccatgtccctaggctgcacacagcacagtgaccctgggcgcagtccatgaaaccactttttcttcccggggctccagacctgtgatgggaggggctgccgtgaaggtctctgacatggcctggagacattctgtcatggcttggggattaacattaggcttcttactaatgcaaatttctgcagtcagcttcaatttctcttcaaaaaatgggtttttcttttctactgcatcatcaggctgcaaattttctgaacttttatgatctgtttcccttttaaaacagaatgcttttaacagcagtcaagtcacctttggaatggtttgctgcttagaaatttcttccactagatacccccaaatcatctctctcaagttcaaaattccacaaatctctagggcagggacaaaatgccaccagtctctttgctaaaacataacaaaagtcatctttgctccagttcccaacacatttctcatctccatccaagatcacctcaacctggaccttattgttcatatcactatcagcatttttgtcaaagccattcaacaagtctctaggaggttccaaactttcccacattttcctgtcttcttctgagctttccaaactgttccaatctctgctggttctaaagttgcttccacattttcaggtatctttcagcaataccccactcctggtaccaatttactgtattagtccgtttacacactgctgatgaagacatacctgagactgggaagaaaaagaggtttaattggacttacagttccacatggctggggaggcctcagaatcatggcagaaggcgaaaggcaattcttacatggcggtggcaagagaaaatgaggaagaagcaaaagtagaaacccctgataaacccattagacctcatgagacttattcactatcatgagaatagcacaggaaagaccagcccccattattcaattacctccccactgggtccctcccacaacacatgagaattctgagagatacaattcaagttgagatttgggtgggacacagccaaaccatatcaggtaccaagatacattggtaaacgagtacaatgttacaattagataggaagttatagtgttctactacactgtagggtgactatagaaaataaaaatgtatatttcaagatagctggaagagaagactatgaattttaccaccacaaagaagtgataaacatttaaagtgataggtacagtaattaccctgatttaatcattttattcaacgtttacatgcaatggagaatcacactgtaccccataaacatgtacaattattgtgtatagattataaataataaaaatgaataatacaaaaaaagaatacttaattttctgggtccctaggacatttgacatagtttggagtgagcctaagagcaacatctgtcagagttccaaaaggtaaatttcagacctgctctctgttatggagggtggaaaagctgctaagagataactagagttgcaccaccaaaaatgacaaggctaccaagtctgtggtccaaggaccttacccttagagctattcaaataccgatgagctggtaggtctgagaagaggaacagtacgtaaggcaaacatttaccaattgctatgattaaatataccaagtttatgaaaacctaaggtaagtgaaatattctcatggctctgggccagtgtgagtttgggacattctataaaatagcatttctacttttcctgacatctaccctgaaattgtagaaagaagtggaggggtgaagaaatatttgaagatggagtagaaatttcttgaaaaaagtgacttttgcttttagatctgaagagagagataggtgctacaagtatgaaggtgctgcaaaaagaaaatattttgctccctggaaaaaaactttcctgttactcagaactccatacaaactgtgtcaaaagccagtgacgattttggtcccttaatttttttctgaaattactctggaaaactcatcacttacctctacagtgttaaatttatgaattcctattcctcttttttttttgctttttaaattgatatttgattttctttttttaacttactcctttcatttctaaaatgtttttatctgttttgatttttagccctatgtctaatctctccaagagttttttctcactttgctttattaccatccacttatttgtttattaatgtttactcactcttgacttctatctcttttcacttcataccagtagttcataactaagtgtgtagattattctacttggagagattttccaaatactcattgcatagcaccaattctaaagattcttattcagtaggacatttctctgataacatcagttattctttgggtacaaatatttgtattgactaatgattcaaatatacaaatataaagctcaatattttaaccgaattcttatgcctaatgaacttgagagtaggttcatgatgaactgaacacagatgaccaattctccatgagtattttatgcaactttatatttttttccttttagattcagtgtgcggatgtgcaggttcattacatgcatacattgtgtaatggtgaggtttgggcttctagtgaacctaccacctaaatagtgaacattgtacccaacaaatagtttttcaaccctcattcacctccactgtccttgcttttggagtctccagtgtctattatttctgtttttgtgttcacatgtacccatggtttaggacccacttataggtaagaacatgcagtatttgattttctatttctgagttatttcactaaggataatggcttcaagctccatccatgttgctgcaaaggacgtgatttcattttttgactgtaaagtattccatggtgtgtgcgtatgtattcagtccaccattgatggacacttaggttgattccatgagcaaattcattttttgaattccagggcaaaggaagaagcctacttaaacagatatagcacacatcatgcaggacatctgtgtggaccaccaaagggaaacctataaacttgcctgcttcaccagaattatagttaagaacaaagacaagtttcggaggatgctcttacccaggataattgagatgagccatcctaacattttagaatttccaacaatttaaaatccatctgatgttggttatcatatatcatcttaggtgggtccaacaattttcctgggcagtagagtctgtcctctatgtgataactagatatccaggcttctttagtcttgtggctccatattctcaccacaagatcccacagttgccaacaaaatggaaggaagtgtgaaaaactcataatctgctcactaactgcctctaaccagcagtgatacaacaagtagtttattctcatggtccattgacccaatctagtcacatagtcctaactgcaaaggaggctggaaaacatcaagataacctatagaatatttggtgagtgctacttccctctcacactgtgaaatagaaactatgaaggttgtaccatctgtgactaggtataggcatgtcgtagttcccatattggaatgaacatcttctaaatcactctgtgacaggactgtgatcatttatttggcaaatgcatcccaactcctttcctccttattgaagtacccttgttatctaggatggatgaaacaagttcctgtagactcagtttgctagttttcaggttggatgtcaaataaatctctgagttacatcaatgttggaacagcgttgtcactgcgctgacaaagactagagccatttttaaagcctggaaattctggaagcaggtatgcatatcaattgattcggaaaagcattcacaaacactaaactaactgggaataaaagaaaaatgccttcatatgataaaagccatagacgaaaaacccgtagttaacataatcgtcaatggtgaaagtttgtaagatttttctctaagatcagaagcaagataaagatgcctgcttttgcataatctgagtggtatgggtggcaccatgggagtgccacttggagatctcccactacaaggagcataaacaataaacggtctgagcagctgcaggctgaaatgcatcagtgcatttttgtgaagtccacacttcccatggtgtgctcccaaccactgatggaaaatgatggagatcctaaggaaggcattcctaggagacctgagattcccctgacagtggatctagcttgaggactctccaacagctttgtgaaaacttcctggcagtgcatgggccttctttaagctgcataaagccaagacagcttccatccagctttctctccttctcttttttacttcagtgtctggcagctttctcaggcttttcatctttctttcctttttttctttttttgcaagggctgtttctcctgataaaattctggaacatttaatactgtcttggtgtctatttctcggaagatccaaactaaaacaagtgataatgagactattataagtatacagggggtaagatgtgaatttgtcttggcttaactaaccctgcaactgacagaggacatgatcctggttgggaggtggggcacagatagtccctgccatgaggtgacagtagaattctaaaaattttttggcaactgagaaaaatgttccaatagagacaaatttgacagatgcaataaagcagacatttaaagtcagtgaagtttggccaggtgcggtgactcactcctgtaatcccagcactttgggaggccgaggtgggcagatcacctgaggccaggagttcgagaacagcctggccaatgtagtgaaacactgtctctactaaaaatacaaaaattagctgggcgtgattgcggccgcctgtattcccagctactcgggaggctgagtcatgagaattgcttgaaaccgggaagtgaaggttgcagtgagccgatatcacaccactgcactccagcctgggtgacagagggaaactctgtttcaaaaataaataaatagataaataaataaaaaagtcagtggctttagctggttgccgctaagtttcattgattattgatgccatgcacaaggataatgagagattgaaggctgttaacaagcaattactggctatgattgagacccagagaatctcagtggtagcttacaaagaggccttaatcagtcatagttagacagcagataggagaatggcaggtgggagttctgtttgctgcagtagcaagctctagagaatctaaacactcagccaaaagagctttgttgtgctaaggtttcaacattgtagggaaaatttggaatcctgagaactggaaagaggacttctggatgtatgcctctgaggatattgactttacaaaacccacttctactgggctcattgggtttgcagaatggcccagttttgcatttccacagggattgtagatgctgcagagcatgttagaatcctgtgtccagggatcaaataacaaacaaatgaacaaacaaacaaaacaaagaacaatcactgtactgttaaggaaaattgactctaatcagcaggatgaggtaagggtgttttacccaatggaggcagcagagagtataggtggaacccaaatgatctatttgggattattgcactgtaactatgaatggacatgtgcaaccctggcatgagaaaagtatgacgattcatggtgcaagcacttcacgataaaggcttgattacacattcgttaaggcatggagccaggccatgtgagacctgagcaggagggttgttcagaatgtgcagtaggtattaggggctaatttataacaaatagtaagatactattttcccgtaaagtttagatacatctttttttaaaaaccctttatgttacctaaaatcaggaatgtactaaaatgtagatttgttgtataaatccatttttcaatataagattcattaggtctagagttctagatccatgaaacccttgcattttagttttctagtttgttattttgaagctaacaaataagctacaccattataaatttcgagttgagcataagcaattgaatccaagaacttcaagttctgtattaagtacatttgatgtgaaatctaacttgctgcaaaacaaggggttggtggtggaaaatgcaacttctggcatgtgtttttatagatgtaatacatctatgggtctttaaataactttattgagatatgttttacatatcctaaaatttacctacttcaactgtacaattcaatatttttaacaacttgtgctgtggccatcatcataaatcactttaggccattttcatcatcaccccataaaatctctcttgtcaatttacagataatccctgtttccaaccatagccccaggcaacaattaatttatgttctgtctctataaacttgcattttcactacatttcatacaagtggaatcaaaatcccttatttctgcctgagtttttagagttgaacaaggctggagaaaattattctcacataattcattaacatctccacttaattcaggctcactacacttgcattggccttaatgcctctacaattccattagatatgctctttgttaaatttttggtaactttcatgtttctaaatgcaatggttatttctttttatctattattttaggtccgaggggcacatgtgcaggtttggttatgttggtaaatagtgtgccactgatgtttggtgtatgaatgatcccatcatccaggtagtgaacatagtacctgatagtttttcaatcttctcccacttcctgacatccctcctctaatagtccccactttgtgttgtgcccatccttatgtccttgtgtacccaaagttcagttactacttataaatgagaacatgtggtatttggttttctgttcctgcattaattcactaagataatggcctccagctgcatccatgcaaagggcatgatttcatttttcttttatggctgcgtagcattccatggtgcatatgtacacattttctttattcaatccaccattgatgggcacctagattgattccatttctttgctgttgtgattccatgtcattgctatgttgcaatgaacatgtaagtacatgtgtctttttggtagaatgatttatttctctttgggtatatacatagcaatgggattgctgggtcgaatggtaactctcagttctttgaaagatttttaaattgctttccactgtggctgaactaatttaaattcccaacaacagtgtatgagtgttccctattctctggaaccttaccaacatctgttatcttttgacatttgaataataaccattctgactggtgggagatagtatctcattgtggttttgagtagcatttctctaatgattagcgatgttaagcattttttatatatttattggccacatgtatgtcttatttcaagaagcgtctgttcatatcccttgcccaatttaaatggggttattttttgcctgtgaattgtttaggttccttacagattttgtatattacaccattgtcagatgcataatttgtgaatattttctcccattatgtaggttgtttactctttagttactttagctatgcagaagctctttagtttaattaggtcccacttgccaatttttggtttttgctgcaattgcttttgaggacttagtcataaattatttcccaaagctgatgtccacaatagtatttcctaggttttcttctcatatttttgtggttttaggtcctgaatttaatattttaacccatcttgagttaatttttgtatatggcaaatggaaggggaccagtttcaatattgtgcatatgtctagtcagttatctcagcactgtttattgaatagggagtcctttcaccattgtctgttattgttgactttgtcaaatatcagatagtcataggtttgtggctttatttctggatcctctaaccgtttccattggtctacctatctgtttttgtaccagtaccatggtgttttgattactgtagccttgcaatatagtttaaagttgggtactgtgacacttctggctttgttccttttgcttaggattgctttggctattcaggcctttttttttgttccacattaattttagaataatttctttctaattctgtgaaacataacacttgtagtttgacaggaatactactgaatgtgcaagtcattttgggcagtatcgtcattttaacaatattgattattcctatccatgatcatggaaagtttttccatttgtttgtgccatctctgatttctttttgtaatgttttgtagttcttactgtagagaactttgtccattctagttagctgtagtcctagagatatttttttctctttgtgagtattgtaaatgagattgccttcttgattttactctcagcttgaatactattggcatatcaaaatactactgatttttgtacattaattttgtatcctaaaattttacttatgttgtttatctgttctaggagcccttggcggagtctttagggtttaggtacagaatcatgttgcctgcaaagagagatagttgaactttctctatttctatttggatgcctttaatttctttgtcttacctgattgctctggctaggatttctagtactgtgttggataagagtggtgagagtgggcatccctgacttgttccagtaattaaaaggaatgcttccagcttttgccacttcagtatgatgttggctgtgagtttgtcatagatggctcttactattttgaggtattttcctttaatgtgtaatttgttgaaagtttttaacatagaggaatggttgaattttattgaaattcttttctgtgtctattaagatggcaacatgatttttgtttttaattatgtttatgtggtgaatcccctttattgatttgcatatgttgagccaaccttgcatccctggaataaagcctactcaattgtggtgaattaactttttgatttgctggtggattttgtttgctagtattttattgaggagtcttgcatctatgttccttagagatatcggcctgaaattttcttttttgttgtgtctctgccaggttttggtatcagaataatgctggcttcatagaataagttaggaagttgctccacctcctcagttgtctggaataattttgatgggatttgtactgccttgtctttgtatgtctggtagaattcagctgtgaatctgtctggtccaggtctttttctgataggtaggttttttattagtgattcaatttcaaagctcgttattggtgggtgggagtcggggccaagatggctgactagaagcagtggcaatcagaggctctcatcgaaaagatccaaaagagcatgcaaatcctgcactggtaactgaggtatccagatcctgttattaggactgactaggtgactggtatgacccatggagaaaaaggaagaagagtgtggtgcagcagcccatcagagagccatacagggcaggggagcccccactcccagccaagggaggcagcgagtgagcatgatacccagcctgggaaaccatgctctttccatggaaatgtgcaacccatggattggaaaatcccacttgggagcccatgccactggagccttgggtcccaaccatggagccatgcagattatcaacatcttctaggctaggatcagcctaagcctgagttcccatggggaacactgctgtggctgcctgcagtctaagccatctgagctccttgggggaggggtgggagccaacactgtggctgcagtgcgtccctgcaggaactccaactccagtcaggggcttagggacagaactatgatctctctgggcctgagccgccttggggaaaggtggccatatgctccatggaccagcagagttagtcttttctcctgctagatctgaggaatctgggcagcccagatgagtgggttttcccccagcacagcacactctttccaccaagggacagccaaagtgcctcattaaataggccctgcttcccatgccactcaactgggtgagacccccccaacagggattgtcagacaactcatacaagggtgttcctactggcattaggtcagtgcccctcgaggtcagggatcccagagaaaggagcaggtaaccatttttgctgttctccagcctcttcgagtgacatctctaggtatgggagcaaaccagatgaatagggcctgaagtgaaaccccagaaaactgcagcagccttagagaagagagacctgactattgaaagaaacaacaacaacaacaacaacaaaaacaaacacaaaacaacaacagcagcatcatcaacaaaaaacgtctccgcaaaaacctcatccaagtgtcatctgaggacagcctcaaagatcgaaactagacaaattcttgaagatgagaaagaatcaataaaagaacattgaaaaccaaaaggtcagagtggcttgtctcctccagatgatcacagcacctctccagcaaggctccagaactggacagagggtgagatggactaattgacagaagtaggcttcagaaggtgggtaataacaaacttcactgaggtaagcagcatgctctaacccaattcaaagaagctaagaaccttgataaaaggttagaggagctgttaactagaataactagtttagagagaaacataaatggcctgatggagctgaaaaacacagcatgagcacttcatgaagcatacacaggtatcaatagccaaatcaagcaagcagaagaaagaatatcagagatggaagactatattgctgaaataaggcaggtagaaaagattagagaagaatgaaaaggaatgaagaaaaccttcaagaaatatgggactatgtaaaaagaccaagcctacgactgattggagtacctgaaagagacagggataatggaaccaagctggaaaacacactttaaaatattaaccagaagcacttccagcctagcaagaaggccaacattcaaattcaggaaaaacagagaaccccattaagatactctacaagaaaatcaagcccaagacatgtaattatcaggttctccaatgtcaaaatgaaggaaaaaaatattaagggcagccagagagaaaggccaggtcacctacaaagggaagcccatcagactaacagtggatgtctcagcagaaaccttacaagccagaagaaagtggggaccaatattcaacatttttaaagaaaagaattttcaacccagaatttcatatccagccaaactaagcttcgtaagtgaaagagaaataaaatccttttcagacaagcaaatactgagggaattcatcaccacaagatcttccttgcaagaactcctgaaggaggagctaaatatggaaaggaaaaactggtaccagccattgcaaaacacatgaagatataaaaaccaatgatactatgaagaaatgacatcaactagtgtgcaaaataaccagctagcttcatgatgagaggatcaaattcacacataacaatattaaccttaaatgtaaatgagctaaacaccccaattaaaagacagactcaaaaactggataaagagtcaagacccattggtgtgctgtattcaagagacccatctcatgtgcaaagacacacatagggtcaaaataaagagatggaggaatatttaccaagaaaatggagagcagaaaaaagcaggagttgccatcctactctctgacaaaacagactttaaaccaactaagttagaaaaagacaaaaaagggcattacataatggtaaagggatcaattcaacaagaagagctaactaccctaaatatgtatgcacccaatacaggagcacccagattcataaaacaagttcttacagacctgcaaagagacttagactcccatgcaagaatagtgggagattttaacacctcactctcaatattagacagatcaatgagacagaaaattaacaaggatatgcaggagttgaactcagctctgaatcaagtgggcctaatagatatctacagaactctccaccccaaagcaacagaatatacattcttctcagtgccacatgacacttattctaaaatccaccacagaattggaagattctgcaaattcaaagaactgaaattataacagtttctcagatgacagtgcaatcaaattagaacttaggattaagacactcaaaaccacacaactacatgtaagttgaacaacctgttcctgaatgactccaggtgaaataatgaaattaaggcagaaatcaagaagttctttgaaaccaatgagaacaaagagacaatataccagaatcccttggacacagctaaagcagttttaagagggaaatgtataacactaaatgcccacaccagaaagctagaaagatctcaaattgacaccataattaaagaattagagaagcaggagcaaacaaatccaaaggcagcagaagacaagaaataaataagatcagagctgaactgaaggagagagatgaaaaacccttccaaaaaatccatagctccaggagctgttttttttttttgaaaaaattaataaaatagactgctaggtagattaataaagaagaaaagagagaagaatcaaatagacacaataaaaaatgataaagggaatatcactgctgaccccacagaaatacaaactactatcagaaaatactatacactactctattcaaatcaattagaaaatctacaggaaatgaatacattcctggacacatacacccttccaagactaaaccaggaagaagtccagtccctgaatagaccaataacaagttctgaaattgaagcagtaataaatagcctaccaacgaaaaaaagcctggaaccagacagattcaaagccaaattctaccagaggtacaaagaggagctggttaccattccttcagaaatgattccaaacaattggaatcataggtgggactcctccctaattcattttatgaggccagcatcatcttgataccaaaacttgacagagatacaacaaaaaaagaaaattcaggccaatatccctgatgaatattggtgcaaacgtccttgataaaatactggcaaaccgaatccagcagcacatcaaaaagcttatccaccatgatcaagttggcttcctccctgggatgcaaggttggttcaacatatgcaaatcaataaatgtaattcattacataaaccgaaccaatgacaaaaatcccatgattatctcaacagatgcaggaaagaccttcaataaaattcaacatcccttcatgttaaaaactctcaataaactaggtattgatgaaacacacctaaaaataataagagtcatatatgacaaacccacagccaatatcatacttaatgggcaaaagctggaagcattccctctgaaatcctgcatcctattcaacatagtattggaagttctggccagggccatcaagaaagagaaggaaataaaggtattcaaataggaagataggaagtaaaattgtctctgttttcagacaacatgatcctatatttagaaaaccccatcatttcagccccaaaactccttaagctgataagcaacttcagcaaaatctcaggatacaaaatcaatgtgcaaaaatcacaagcattcctatacacaaacaattgaaaagcagagggccaaattatgaatgaactcccattacaactgctacaaagagaataaagtacctaggaatacagctagcaggagatgtgaaggacctcttcaaggaaaactacaaaccgctgctcaaggaaataagagaagacacaaacaaatggaaaaacattccatcctcatggataggaaggatcaatattgtgaaaatggccatactgcccaaagtaatttatagattcaatggtatttccatcaaactaccatttacattcttcacagaattagaaaagctactttaaaattcatatggaaccataaaaaaagcccacatagccaagacaatactaagcaaaaagaacaaagctgaggcatcctgctacctgacttcaaactatactacaaggctgcagtaaccaaaacagcatggtactggtaccaaaacaaacatatagaccaatgtaacagaatagagacctcagaaatgaaaccacacatctataaccgtctgattttctacaaacctggcaaaaaaaagaaggaatggggaaaggagtccctatttattacatggtgctgggaaaattggctagccatatgcagaaaactgaaactggaccccttccttacaccttatacaaaaatatactcaagatggattaaagtcttaaatgtaaaacccaaaaccataagaacccctgaggaaaacctagataatacccttcaggacataggcatgggcaaagattttattctgaaattgccaagaggaattgcaacaaaagataaaattgacaaatagtatctaattaaaccaaagaactgcacagcgaaagaaactatcatcagagcaaaaaggcaatccattgaatgggagaaaatttttgcagtccacccatctgacaaaggtctaatattcagaatttataaggaatttaaacaaatttacgagaaagaaacaatcccatgaaaaagtgcttaaaggatatgaacagacccttctcaaaagaagacatttatgtggccaacaaacatatgaaaaaaagctcaacatcactgatcattagagaaatgcaaatcaaaaccacaatgagatactatctcatgccagtctgaatggcgattattaaaaagtcaagaaacaacagatgctgctgtggctgtggagaaataggaacgcttttacattgttggcgggaatgtaaattagttcaatcattgtggaagactgtgtgacaattcctcaagaatctagaaccagaaataccattttacccagcaattccattactgggtatatacccaaaggaatataatttattgtattataaaaatacatgcacacatatgtttattgcagcactattcacaatagcaaagacatggaaccagcccaaatgcctatcagtgatagactggataaagaaaatgtggtacatatacaatatggaatactatgcagccacaaaaagaatgagatgatgttttttgcagggacatggatgaagctgaaagccatcatccacagcaaactaacacaggaatagaaaaccaatcaccgcatgttctcattcataagtgggagttgaataatgagaacacatggacacagggaggggaacaacacacaccagggtctttgatgggaggtaaaggaagggagagcatcaggacaaatagctaatgtgtgcagggcttaaaacctaggtgatgggttgataggtgcagcataccaccatgtcacacgaatacctatgtagcaaacctgcaccttctatacttgtattctggaccttaaaataaaaacaaaacaaaaacagtaaaaaagaaagaaaaaagctcattattgttctgttgagggtttcaatttcttcctggttcaatcttgggaagttgtgcatttctagtaatttatccatttcttatatattttctggtttgtttccatagaggtgttcataatagtctcttaggatattttgtatttctgtagggttggttgtaaaactacctttgtcatttctgattgcgttatttagatcttctcttttttttctctttgttaacctagctagcaatgtatcaatcatgtttattctttaaagaaccaactctgggtttcaatgattttattttttccctttccctttcccttcccttcccttccctcccctcccctccccctcccccctcccctcccctccccctctcccctcccctcccctcccctcccctccctttcccttcccttcccttcccttccttcccttcacagagtattgctctgttattcaggttggatggagtgcagtggcaagatcttggctcactgcaacctctgcctccctcgttcaagcaattctcatgcctcagcttcctgagtagctgggattacaagcacatatcaccacacctggctaatttttgtatttttagtagagacaaggtttctccagatttgccaggatggtctcaaactcctggcctcaagtaatctgcctgtcttggcctcccaaagtgctggggttacagacctgagcaaccgtaactggactttcattgatttttttttttttttgatgtatgttctcattttcaattttgttcagttctgctctgattttggatactttttttttttctgctagctttgggggcagattgctcttgtttttctagttccttcagctgtgatgttaggttgttaatttgagatctttctaacttctcgatggtagatgtttaacactataaactctctgcttaacattacttaagctgtgtcccaaagataccaagtatgttgtgtttctctcttcatttatttcaaataatttttaaaatttctgcattaattttcttgtttgcccaaaagtcattcaggagcaaattgtttaatttctgtgtaattgtttggttttgagagatcttggtattgatttatatttttattgcttggtatgatttcaatttttgtggattatttgagacttactttatgaccaagcatgtgattgatcttagagtaagttctgtgtgcagatgagaagagtgtatgttctgttgctgttgggtggtgtattctgttgatgtctattcgatccaacggatccagtgctgagtttaagtgcagaacttctttgttagttttctgccttaatattttgtgaaatgctgtcagggggatgttgaagtccctcactattcttgtatggctttctaaacctttttgtagatctagaaaaacttcttttttatgtatctagtgctccaatgtcaggtatgtataaattgagagcagttacatcttcttgctgaatagaagcaatggttatttcttagtctttatttttttcgaccaatcagcagcatttggcatagctgatcagtctctcctgtataaaatatttcctcatttggctacaggataccacaggctttctttaactcttgctaatgtagttactgcttctgttttttttttttccaatacctcctgatctgtctctggaaattagctccatggtgctgtctttgaactttgtttttctagatacattattgcctatctcatctagtcttatggtttattattatatctttaaaaatagctaaaagagatgattttaaatgttcttgagtaaagaaataataaatatttgagttaatggaaatgttaattaacctgatttgatcattccacaatgtatgcatatatcaaaacattacattttaccctatatatagatacagttgtatttgttaaaagtaaaaatagtaacataataattatatattgttaattactcccagtatctatctcggctttatacttcttcagtgaactccagattcaattatttgactacttacttgatagttccacatgaagatacttactagaagtctcatatttaacatgttcctaatggactcctgatcacattcccaataccatctgcattattctagtttttcagaacaaaaccttggagtcattttgccatctttttttgttacttttctttcccctcaaatccagtgaattattaaatctcatgtttctctctttaaagtatatccagaattgggcctcgacccctgctactattctatttaaaaccatcatcatgttgtgtggatgactgtaatagtcttctaactggtctccttacttctgcttatttgccctgaagattattctatgaaaatattggtctgatgctgtcacttatttgttctaactctctgatgatgtctcatttctatgacaccatctgtaactacattcacactcactccaggcacattgtcccctagctgttctttgtataaacaaaggatactttggcctcagggtctctgcattttttcctaactctgtctggaataacatttatgtgaaaatacatgttacttctactttatatctttatttacctattcaatgaaattttccatgtcatccaatttacattttgttaccatcagtctttcacacccaggcttaatttattgttatctaaaatgctagaaaactaagaattttgtcttttgtttactgctgtatcccagtgcctagaagagtgtctgtcagatagtagacactaagtatttgttgagtgaacacatacacagccacacatgctactatctgatacaaaggagtcacagagtctgttccagtgttaagaaagtctgaactctctgatgcaccatttcagtgaatttcaaccaattacttaattgctaagacatagtgaaattaccatcatcaaaaaatgctgttatatgaatcctatacattcatattaattttattgtttataaatgtgtataatattaaattcataactcaaacattatttctatttatctttgataattcttattccagaagtatttgtttcatgcatataataagaaatcagctgtttgtattctgattcttcacattttaaagcaagacttagctgtctttgacatttgtcacatgcttctctcttgagctagacatattactcaagattgatatttttttccatgttgagtatttagttcaaatattttattgcatttatttgaccactacttcaatttgactgtcatagatagaaggtgcatgtgacagtgataaaacccaggcacaagagagtacttgttgggccataggtggaaaagagtacagagagttttcacaacttttttcttcctgtaaatgtatattaataattctgtatgattgacattattgttattagcaaatctttgagagagctgagagaaagagaaagaaagagagaataactgcaatggcaagaattaaatcatgagactggaatattctagaagctaaatgaagaaagtaattcatggagtagacacttaccagctatgccaaatgctgcaaataggatcaacaaaagtgaagattaaaaaacagcctttggcattaaaaaatataaggaccactgatgatctcttaaaagtaaacatttttattgctgttgtagagtcatgaaaggccatgaagtttgtaaggcttaattaattagggtggtcatgaattaagtgagaataattttctccagccttgttcaaatacatggttgcaggcagacaaggggcagttgttataaatatgtattttaaaagatgcaggcagagaaaaggctatttgatttcatttgcatgaaattgtgaaaaaaaaggaaagcaaaccaggaaagagaaagcagagatttattgttgcctggagctgtgggtgagaacagagattaactgaaatgacataaagctcttatttggaaaacaaaatgttctaaaactgatacatggttgatggctgcaaaagtgcataaagttatttaaaaaattgaattttacatgtcagtgaattttatgatatgtaaaatatactaaagtttttaaaaaataaacacatacgatttacacattataaatattaataagtatgcaactagcttaatttctcaccaataaccacttgtataactatattcaatttcacattagacataatatataacttgttctttatttcaatggcttatactcagttggagatttataaatatgtagcttatttctttaaaatgcaaaattctcacagatccaatatacaagacctgatgaatcctaagtggaaaataaatcaataaaacaactatacattttactgcatttgtgaatttaaatatggtacaaaaactttaaaaaggaaaatctaagcttgaagaaaaaataatatcttattgttagaaggtacaaacagatgataagtagaaggaataaattaaatgcttgatagcagagtaggatgactatatttaatgaaatgttacgtaatcaggtgatgggcaccctaaataccctcgcttgataattatatattacacacatggagtgaaatttcaaaaaaaacatgcaccctatacatttgtacaaatataaatataaataaaataaaaatgaaaataaacacaagaagtaaaaatgctttaaaattacaacttgtaaaatcaatattattggtcatttaccttctctgaaatttcatcctcattttaccctaccttctgtggaactggggtatgcaagaatattcctttagaatctgcagttgaaaaatattttttgattttatgttgtttgtatcaacaatcatctcagtcaagcaatgcttattaatcctgagtcaatggtggggtcaaaatataggaaaagttatttatgagtgtccactctccagtgtgatatacactttcacgacattatcaatggcacattgaaaatgactgagatacaaaatatcaaacaaaaaaatcagtcactgcagttccacaggatagtccagttcctcttctgaatcacactggagcccgtttctcctcagattgaaggcagtgcacccccacctctattctccatcatagagtggggagaccctgaaagtcttgctgcatgtgggtagctaagaccctgggccctgagctcagatatctcctctgctaatgtccttggctcacctggcctggtctgagacagtgtgacacatgggaggcaccagcatgggatctgggaaaggggttgtagagggtctcagagatacagggaattgttctccaggaatagtccaaccctcttctgagaaaaggaaaataaattttaggctactatgggcttaggtgggcttgtagccttccatgctcagcaaggaaggcaaagagaaagaacatggctttgccagagtgcaggaagcacagccaaggacaaaggccccctgaggttcatggcagctcttggtcactgggccaaagggccacttcagagtatagtgtgctgtccaaggaccctcgaggtgacaaccgaggttgctttctgcctgagttggctcagcattatggaatccaagggcttgggaagcttcaacagggcagggagaggaaacactagacacaagcacacacaatggagcacaactgctttgttgtggggaagcttaaattgtttaaaccctttagtagtgacgtaaaggcaaataagcatcatttgccctcatagtgaggttcttgaaaatgtctctgcatcacagttttttttttttgtggtaggatttatttattgtggagaaacaggaaaatagaaatattaattatcattactagcaattagtactaacaacttcttatgtaccactgctgacttaaatgtttaatatctttgcaaataaaaacaaatcaagaaaatgggactttatcctgataattccatcaaaaacacttttattcaactatgcatctttttaaaaatactagattagaatcagtggaggaaagggaaagaaaagctttaaaatgcaacctgattgtgttgtgtaaatagtgattctaagcactactgaagaacctgtggagatcagaaaggtagcaaggcgagggcagagaggaaaagtgacaccactgtaaaaggaagagtatgcatctgccttcctgaactttgacaaatatcttaaactgcacatgtccagaactaactcatctttttttttttttttttttttttttttgagatggagtcttgcactgtcacccgggctggggtgcagtggtgtgatctcggctcactgcaacctctgcttcctgggttcaagcaattctcctgcctcagtctcccgagtaactgggattacaggctcccaccaccactcctggcaatttttttgtatttgtagtacagatggggtttcactatgttggccaggctggtcttgaactcctgaccttgtgatccacccaccttggcctcccaatgtgctgggattacaggtgtaagccatagtgcccagccctaactcatcttttatcccatcccttacctaaaaccccagtacaccatgttacagggatgaactgtgttgacagtttgaaaataaaactctagtcaggactaaaactcaggcctactagagactggtacatctgggcaatagaaatcatgagaaagaggtaggacagtgagcatgatggtccaaaattgccctcattgccatgaggttgagataaatctagtagaaccatcccaatttgcattttaaacagccttattaagatataattcacataccacaaaagtcacccacttaaagcataagactaaatgatttttagtatgttcactggtatgtgtgatataagtttcatcttattatgaagaaactctataccctttagccatcaccctcccatacacaagttctttatcccacacctctactccctaaacaaccattaaactaagagctgcccccgttctggacgtatcatacaaataaatacacatgtaaatatctggtgtttgtgactggctttatttactatacataatggtttcaaggatcaaccatgtcgagtaaaagtgtcaatgcttcattcctttttagggctgaataatattccattgtttggatataccgcattttgtttatccattcttcagttgatggacatttggaataggaaaccctggacctctatgatgaggttcctctacctctgtcccaggagcatcttggtttgtgatggagactctgtaggtcctaattggattccaggtgggctggtggatccctaatccatgtgtaatgctctgtgatgtgtagaaatgcacccatcttagcaagagggggaggggaggggagactgaggcaagaaaatcttacccagaaaagcccagcttcagggaagacagagtggcaagtttaggttttcccaaaggacagagaaatattctagaacagtttatacagggccaaggaagcataatacctgatggtacaggtgtctatgacccacagctcagtttgaacaattcatttaaggtaggatttaggctaatgactaatgtgactgtggagctgaccttactcagcaatacctcctctctcaatattccaaaacttagaatgaagaggacaaggggataattaacgattaaaagggggtgggctgcaggtttcctctcttgggatgagagcagtcagcatgccatgggcatctgagagtgggcaggagcagtggacaatggaagtgatatggactgcagaaagggaaacacagggtggaagagggtggttccccagaaaaggcccgccctcaagcctggataccatggccctaaatgagaacaggaattcccgttttcatgcccaaaaagttgccttttggcccaccatgacccctatcttgtactcacataaaccttgaactctagcatccagaagcagacaagcagatgaggaggcaaaacaagcagacgggcagcagaatgacatggcagagaaagagagaagaggaggaaagtctgaacactgagaggagtttggctggggtcagttggagaggagtctggccacttgatggctcaactccaggggaaggtcatcttcccactccgttcccctcttccagctcctcatccatcccacttattgctacctccaccactcaataaaacctttcattcatcctgacagagcaggagcatcacgatcttggacaagcacggtcattttaaagttcaccttgatcaaaaactgcctaaatccaaagggcatcagcctaatgggtaaggtcagcatgaccataaaccacaaataacatctccgactagaaacattccaaacttctccctgaccacagacatatcagccccaagataacctcccctctggctggagagatgtcagcctcaagataacctcctctctgaccagagacattccaaccctgccataaacttctcccctacacagaaacattccaagcttgtgttaagctctctcaccctaaaaaaccaataaagactcttagtccataagagagagcgctcctgaccgaaatcatccagaagcctctctcaggttcattctccaaaatatatctgtctttgactgttgggccactttttgtgtttctttcctctttctttaactcttacacatcctttaagcccatgtgtgacccaattcttctgggcaggagctggaatacagaaagcagtcacattgtccctctgcccttgcgaaaaggcagagggtctactgagctggttaacataagccatatgtgaacggcaaagtggaaagagctttgtaacactggggttgcaggcacccaccccctagacactaccatgggtctggaacccaaagcactcaacctggctcctgcacctccctgtctgagtggtccccctcccattaggggtttgagcagtggtggcattgaataggcaagccacacccctgtcacacctcctgtgaagagatccaggaactctcctgtttcagctggggtcctgtccagaatacaaagaaaggtgagttaaaaagcaaaactgtcagatctgcctcttctccaagactctgccacctctctctttcctgctctgtttctctccggggaggtctagccaccacatgggactggagtaaagccatggggcaacgaaaagctttttttttttttttttttttttttttttgctgaaaggctccaggactgaattccgtaggccaagaccgcagacttcctttggtgtcttttcttctctcagtttaaaatggctcttatctcttcctttataacgtcaaaggctttgctacaggctgcggcaataatattaaatagaatgagcatttggctcagccatcaaagatgcaaatcagaacaaatacttcccatttgttcttaaatgtgccatccccagcctgacagccacaggcacgtgtggcccacagcacatcctctccttactccctcctgtcctgactcaggcacctagaggtgtccacagcatgcacaagagggacaggaaaagactgtggctgccacagggacccagcacagccagctacctgcccattgtgccaaaagaacatttcctccccagccaaggaatttagccaggtctgaaccagaggaagaatacaaggattaaagggacccactttgcactgagcaaggggttcttcctccaggaccttcctctttcgcctcataagctgttttttcttttttacattttctaagagagggttcctacccccagcactctgcttataatagagaaaataatggaagagtgacccctactggctgattactgaaaattcagcagggctcatttgagacaatctaaacagatacagcccctgaaatactttgtctcaaactcgattcgaagcgtcaggctgaagtcttagcaaggaaaatcagatttgagggatccaaagccaggcaacaggcacaatgtaaatgggcaggaccaattcctgccaactaaaccacccccacctcatgaaaggaggccatgttccatggcataatgaggcccagggaactcaaagtttgccaatagttgggaagatggaggcataggtgagagtggataattcctattctctaggccttccctgcttcaagggtgcatggtgcattagcacccatggtggcacctgctaaggttgccagaacttgaggacaaaaagatggaagagaaagggaggatgtttgctttctctctcacaccctgggttttcactgaaagaaagaatagagttgagggatgcctctattccctgtctttcagaacgggcaaccagctctctttaccacccccagcttatactcctctggagtgtattctgaaccactggaactgctttgacactcagaatgtggaggaaaaatgcctcatagccctctgcataaatttttggccaacttatggactggaagaccattcatttcaataccatcaggcagttggaccttttctgtagacatgaggacagatggtgtgaggccccatatgggcaggctttctataccttgaaaggcaatccagacctttgctaacagtgtaggattgatccagccctcctgtttgttgtctcaggaaaggctgcaaggggtgagccaagggaactaaagatacaaatcctagaggcacccccagaagaagagccagctccctccagccctgctcctccaggtccacctcaatctccctatccaacttcagcctctcacttaccccctcctagaaatcctcacctgagacaagccccagtctcactcttgcccttccaacagatgcctcagatgcctggtgaatttgaccccagtaaagtccagatccccttctctctacaggagttaaagcaaattaagggggatcttggcaagttttcagatgaccctgtccaatatatagaggctttccagaatttcatccaagtatttgaactcttctggagagacattgttacttttgaatcagaccctgacagacactgagaagcaggctgctctgcaagcagcagagatttggggatgagctttgtatcacatacagcatcagggaagagggcgaaaattatccaactggaagagagacagtactaatgaattaccctggatgggatcccaatggtgagatgagagactggaagaggagacagtttcaggtttgcataatggagggcgtgtgtaggaccaggaccaagcctctcaattacactaagttatccatgattgaccagggagttgatgaaaatcccactgccttcttggaaaggcttagagaggccttggtaaagcatctctttacctcctgattcagttgtggaacaactaatcctggaggataagtttattattcaggcagcccctgatatcaggaggaagctgcaaaaaacaggccctgggaccagatagtactttacataacctcctgaaagtagccatctcagtcttttataatagagacagggaggcccaggaaagacaggggaaatacaggaaagagacaagggctttaatatccaccaggcaagcccacaaaccccagaattcccagggtgtacctgttaactgctacagatgtggcaagacaagcagaccagcagatgaggggtttgagcggtgggtgaccgaacaggtgagccactcccctgccgcatgtcctgtgagggagatcagtgatctctcttgtttcagaaggctataaagcttatgatgtaacaacttccaaagttacaaagacacaaagccgctcatctcccactaaaggatcatggagggtagaagaatcaatagacacaagcttgtatgcttttagtcatatgatttatttttttctgtgaagttgaaagttttaagttaatggtgagtttcttggtaatatcctttcttcatccgatggctttgattttatcacttggttactgttgcagaggaaatgcagaaaaataaaaatgttaaatcttcattgttaataaaagctgttatttactattcaactattagtagaacacttaattagtataatgagacactgattatactggtgaagtctgtgtctgtgattcaggaagtttataaatctaaatttattttccataaatggattgtaattgctacattaaaagggaatattacaaattgatatttatatttttaatttacatagtctctaaactttacatggataaatgaaaatcatcaacaaagagacagaagaaaaatataaaggaaaaccacaaaaaggaaacagaaaaaaacagcaatataaatatgtgaaaaaataataaagaattactatacatttttctctatgtatctgaggaggaaaagaacttccaaaaaccctctgtgcatttccagtgggttcttaaatacacttgttcaaagacaaactaactcttcactcccctccacttcctcaccccaaaccaaaccagttatttctctactacacaatgtgtcactggtaaaaggtgtcactatccattctgtcagaagagtggaggtttttttagttctctcttttattctaacccataaacgtccatccagtcactactctaacagattgggcctctgtcatacctctgaaaatgtttttgtgcttttcctcctctccaatcctgtcctcatcacacctttcttgtgcattcagcagtctcttaactgcttcactactttccatttgtgactgaatctactttccctattttatcccagtgaaatttgtaaactgcaagacatatagtaccaaatccctttcttaccatcttaaaaagtaccttacctatgttcttagtcatatagaagaatatttaaactccttattgtggcatacaagatacttattttggcttatagttacctacatggattttacatctcagcattcataaacttgcaaattcccacactttgggaggccaaggcaggtggatcatgaggtcaggatatcgagaccatcctggccaacgtggtgaaaccccatctctaccaaaaatgcaaaaattagctgagcatggtggtgtgtgcctgtagtctcagctacttgggaggctgaggcaggagaatcgcttgaacccaggtggcagaggttgcaagtgagccgagatcacaccactgcactccagtctgggcaacagagtgagactccatctcaaggaaaaaaaaaaaaagccaaaattttgtaaataaggaagggtggttttactttttagccttgctattttcctgctgtatatcaatagccatattatttaagcattttttcttacattctgcatccaaactgtcagtacattctgttgtgttaccttcaaaatgtatccataagaccatccttaccacccctggtctgaagcgccatcttttctctcctggattactgcagtagtttctccacatctactcttgccatcatatagactgttttcaacaaagcagctttttaaagggtaagtcacatgcttagaatctgcaccatccagtgattcctccctttcactcaaagtaaaagacagatggcctccaagagtgccaagaccctccatgggtgttacttctctggccttatcacaactgcaaccctcttggtaactctgctccagatagaatgacatccctgatatttctccaacatttctgacttattttagcatcatatcatatatatgttttgaaagctgctgtgaagatatttgcatggataatgccagtatatgcctgtgtgggatagatttgatgtgcagctggaatggaaaagctctatctttatctctgggaaagcctggatgtctggttttgactttttcccaggataaggggagtagtatttatgatgagccatttacaatttaaaataagaaagcttgggccatagcatctctctaattcccaatgcttagtggcagataaggaaacagagacccactgacttaactataaacaaagtcagatatgagggaatggcagctaagtaattagatgaactgttgatctccactcttggttgaagttttgaattttccatttactcccagtgataggcctaacacatcaaatataattatttctttacacatatgaattagaactttgaacaatatatatgaatgtatatttatcccatcttaaagattaaaaaaaaagtatcgttctgcctttgaagaaaggtgcatttaacattttgcctggcatctcatgtgtctcaatcaatgtaaattccattcccaatccccagtcatatatcaggctatatttgttccagattgtggcaatcttaagagtttaaattctgaagtcggattgtcttaagttaaactccactacaatactcactaaaattctattttcctggggaatcaatttatttccttttatccatttcctcatctctaaaatatgggtaacaatacctatgacattttagtaaggatcaatcatcgtaaatgtggagagacaatctgtgtaaatcgcccaatgagaaccttacataaggccagaggagataatgattgtttatgaatattttacaaaaatatttataatctctttaacatcattccttattacaaaaatgttgttcaataaatctctggctaaatattagttaacattaaatatttctaaataagtataaaacataattaacatcaaatatattttcttatctttgttttactatatagtattaatacataggagtcaagatgatgaaatatgggaataatagttttctcatactgaggtattgttaaaagtaaaaaaatactccatgagtattatttcttaacaatttattttacgtcacctttaactctgtgactggctgctgttactaccgctgtcttctgagatagatctgtataaaagagataacattaggaaacactgtaatcttgagcgaaatcaagaaaagtttaaaaagctacatttgcactaattaatcaattaatatgtatcaagtggccaagtgcaagcagagcagtcaatttggaaacaatggacatagacaagaaggggtgatgtcaattataaagacttcgagtgacaaagagattgacctagttcctgatcatctggttcattgctattttgcttcagccctacttcatttcttaccctggcagccctgaaaccacttactgttataaaacttaggctgttgtgaccagattttgtcagttttaatcaatgatcccagttattctttcttttgaattatcaaatccctacatattcataaagcaaattatggtttgatgtggtgttagagttaaaaaaaaaagctgtgcaagtaccttacttataatttcagaaaaacatgagccatattaattatgcacaaaatacaaagtatcctatctgagttctctccctcattctgtaccatctccaatttttcttaccttctacatattctattcacaaaattttcttccctgactatttctgtggacctttttggcacaactggttgtcaatgcaagagaaatggggttccttgggaagtcaacagaacttcctaaacaattgtagaaaacttggctttctatgtgaaaggcaatgaggctttactgaatagctttaattgttcttggccctgtaagaacaggcaggatacttagatgattgaaataaaataaaaacataaagaaataaaaaaattaaaactttgctatatgctgagaacttactcaatatttcttgtctcactctgttgcccaggctggagtgcagtggcatgatctcggctcactgcaacctctggcttctgggttcaagcaattctcctgcctcagcctcccgagtagctgagatagctgggactacaggcacatgccaccacgcccggccgactttttgtattttagtagagacggggtttcaccgtgttgcccaggctggtctcaaactcctgagctcaggcaatctgcccgcctcggcctcccaaagtggcgggattacaggcgtgagcttactcaatatttctaaacattaatccaaaccatcctagagtctcttcttggattctgaattgcactgaattcttcccacaatgaattttaatattaaattaaaaataatacatttacttacctgctgcttactgttcccactttgctccgaaatctcttcattttattccatttaagactaacaatagcaattaaaatgagcaaaggtgaaaaaatgtagaaactgatcaaaagaccattgtttttaggagcagcacgtcgttttggaagcaagggtacacttttttctgaaaacatgagagtacatttttaactatttgaaaaatgatgaaatcataccagaatttgaattatagaaatttagaactcaacacagttaaagaatgaatatatttgaatttaaaagtgtttttagccttctctgactgggccccaaagtgcattatacattgtgtatgtcaactcaatacacttatacatataattgacaatacacagtcattggcaatatgtaatattgtcatgaatgtacttattttattgacagtaaaatttttattcacataaaatacatatttattgacataaatttacttataatcccttcatgtatacttaatatttacttatatgatataatctattttagtgtatcatatttctttttgtgaactgcattaagtacattcacattgatgtgcaaccatcaccaccaccctgcttcagaactttctcattctgcaaaacggaaatattttacccattcaatattaacccaccatttttccctctccccagaggagccaccattattctactttgactccatgaatctgactaacctaggtactaatggaagcagaactcagcaccggcaaccaccattctactttgagtctgagtttgactgctctaggtacctcatagaagcagaattgtataatatttgtcatgttctgactggcttatttcacttaatcataaggttttcagtttatatctacattgtagggtgtgacaggattgttcatttcaagggtgaataatcttccattgtatttctacaccttattatggttatccatttatttgtcaataaacatttgggttttccatgttttggctattgtaaacaatgctgctataagcatgggtatacaaatatctgctcgagtctctgcttttaatttttttgggcatatacgtagatgtggaactcctggataatatgctaattctgtgtttaatatttttagcaaccagcatgatgttttccacaaagactgcattattttacattttcaccagcaatgcaaagagttccaattttttcatatcctggtcaacactcgatatgctttgaatttttctttgtaatagccatcctaataggtacaaattggtatttcattatggtttttacttgtaattccccaaggattagtaatattaatatgtgaaaaacacaactttttctgtgcttactagcccactccacagctttacatttcctcaaagatgtattaaaagtatgcaactactttgcccatttttaatgaaattatttgttttgttgttgttattgacttgtaagagttctttatatattcctaatattaatccctcattatatagattattttcaatatttttgcccattctatggattatcttttcactcttgatagtatcctttgatgcacaacagtttgtaatcatgatggatcctaatttatctgtttttttcatttactgatggtgcttttggagtcatatcaaagaaatcattgccaaattccatgttattacaatttcctattatgtcttctgttttaagggtctataatattagttcttgcatttagattgttgatccattttgagttaattttggtatatggtatcaacaaaggccctacctcattctcttgcatgcaaatacccagatatctcaacatgatacattgaaaagactgaacttcctccagtaaatggtctaggcattcttgaaaatcattagaccatacatgcgaagatttatttctgggatccattttttattcctctggaaaatttcagctttcttatatttttgtccaatgtgatatatcaactgtcaagaaagtacaacaaagtcctggagacttctgtctttctgtcatagcttttgttgaacacatttgagaattcagcctttttttttaactgcttgtaataatatgaggaagactattgatgaaacaaaatattatacaattattaatctgacaaatgcaaagaaacataaagcaacagtttagcctgtaatgattatcttagtctgttcaggctgttgtaacaaaaatatcataaactgggtggcttacaaacaacagaaatgtatgtttcatcgttctggaggcaggcaattccaaaatagaggcactggcagatttattctccgggcctatttcctggttcataataatcttctcgttctaatcttacatagtggaagggatgaaggatctctcttggttttcttttattagaacactaatcccattcaagaaggctctgccttcataacctaattagataccaaaaactccacctccaggtgccatcacattatgaattaggttacatgacaaaaatgttgaggaatgcaaacatttagtctacaaaaatgttgcagttgaccatataaatgaaatatcagactacaaatctttagatgatgatatcctaatttttttcaagtgaagaatcagtgagtcaatgatatatttcaaaagacaaaatggatacatagaattctcatccagtaatcatataataggaaggacttcagcaagcaatatttttcataaatacctgggatttcttggactgtaaataagatctagaataaatagtattccagcttctatggaagatgttcatgaacatttattggatattgttcacaagtggacacagtgaagttaaatatttatgcagagttgattgaatggagtcagtgtaggagtttaaaaactgagtaattattttagatgtttattaaaatgaactgaaaatattttaattatagtacaaacaggataacatcaggaaaactgtgaccatcaaagttgtcttttgaagatgtaaatgcacacacaaaaaaagaatcacaaagtatagtcacctctaacctactagagatgtacttcaaatgttccttgcagtcatagaaaggatatgttctagatccatgtttgacagcaggaactgtattcaaaacacatagaacactttagttatatacccttcaaagactagagtaaatactgagctttctatatttaaaatttttattgaaatttttcataaagctgatttcactacttttatttctacttttatatatttcctgtaatatgttttttatataaaaaatagttttgggcctacaagttataggtaactaataagggttaatttcaggcaaaatagaattcaagagaaagataaacattacagaaataataaaagcaacaatgcaccagaaataaatctaaactacacatacaataatgaagaaacaaactaactgataaaatgaaaaaaagtacataattatgattagaatttttaaaaactcctctcttagtaattgatagaagtaaaaagaaatcagttggtcagttccatgaaaaagcataagctactttaactcatctaatatgaaatagataacattattgtttacatatttattaagaaaatatttatttaagaaaaatctttattttaaaagctccccacagaataaatctccagacccatatgaattcactggacattattactaaatattttttaatgctaattttaagcaatcacttctagaatacagaagaggagtaaacacttcccaattcattttatgatatcagttttagttgacaacaaaacaagacaaaaacaagtacaaggaagagagagagagagagacagagacagagacagagagagaggcaggcaatatctctcaccaacctagacacaaaaatcctcaacagaatattaacaaatcaaatttagtaaagtacaaaaattaataaataatgatgaagaatttattctatactttcaaaattggttcaaaattaaaaatcaatgtaattgatcatatcagtggactacaaggttcatacattcctatcaaccgatactaaaaagcatttgaaaaattaatactgttaataacaaaacatctcaatgaatacatattaaaggaagttcctcaaactaataaatactatctacaagagccctacagctaccatcatacttaatggtgaaatactaaattcttttctgctaaaataattattaaggagagttgtttacaactcttattcagcataggcctggaaagtctaggaagtgcaataaaataataaaagttatacatattggaaaggaagaaagaaagctgttatcttcaaagctatttgaagagggcataatcacttacgtagaaatcccaaagaacttgcaaaaacaaaaaaaaattctcagaaaaccgaattcaattatattgggaaatacaggattgatgtgcaaaaatcaatggtatatttgcatattaacaaggaacaaggggaaataaaaacataaaaaacacccaacatcacctaaaattgctctaaagataatgaaataaaaatgaaataataaatgcataggatatggtaaaaattacaatagcctgatgaaagaaatcaaagtagatttctttgatttctttcatcagactattgaagaatcaaagcagatttctttgatttctttcaaatggagagatatgctgtgttcatagactgaaagacccaataataatgaagatgcaaattcttcctaaattgatttgtaaaaatcacagcaagatttttaaataaagatagatgaactcatgctagtatgtatgcatatagagaaagaagagctctgagaatagttgtagcaattttgaaaaaaaaaaagaattaagtgacaggaattcctttttttcccccaatgttaaagaatgtggtacttgtgtatggaataagacaaatcaatggaaccgaacagagacctagtaaaataccaacaaaaatatgtttaattaatttttgacaaagttgcaaaaacaattcaatagatgagagataccttttctaaaaaattgtgctagaatttttgtagtttcaggtcttggatttaaggccttgatccattttgagttgatttttgtataaggtgagagatgaggacccagttttattctcctaccatgtggcttgccaattatcccagcaccatttgttgagcagggtgtcctctccccactttatgtttttgtttgctttgtcgaagaccagttggctgtaggtatttgggtttatttctgggttctctattctgtttcactggtctatgtgtctatttttatactagtaccatgttatttcagtgactatggccttatagtatagcttgaaatcaggtaatgtgatgcctccagatttgttctttttgcttagtcttgctttggctatgcaggctctcttttggttccatatgaactttaggattattttcggtgaagaatgatggtggtattttgagggaaattgcgttgaatttgtagattgcttttggcagtatggtcattttgacaatattgattctacccatccatgagcatgggatgtatttccatttgtttgtgtcctctatgatctctttcagcagtgttttgtagttttccttgaactccttggttaggtatattcctaagtattttattttattttttgcaggtttgtaaaggacttgagttcttgattttattctcatcttggttgctgttggtgtaaaggagagctactgatctgtgtacattaaaaagaactcattatatgaaaaagatacttgcacacacatgtttataacggcacaacttggaattgcaaaaatgtggaacaaatcccaatgcccatcaatcaatgagtggataaagaaactgtgagataaagaaactgtgagataaagaaactgtgtgatgacatatatatttatgatgaaacactgctcagccattaaaaggaatgaattaatggcatttgcagcaacctggatgggattggagactattattctaagtgaagtaactcaaggatggaaaaccaaacatcgtctgttctcactcataaatgggagctaaactacgaggatgcaaaggcataagaaaaatgcaatggactttggggactcaggggaaaaggatgggaagggggtgaggaataaaagactacaaattgggttcagtgtatactgctcaggtgatgggtgcaccaaaatcttacaaatcaccactgaaaaacttactcacgtaaccaaataccacgtttccccaaaaagctatggaaataaaaaattttaaaaaatatgctagagtaattgaacacccatttatcaaaaatttaactttgatatatatctctcatcctatataaaattactttaaagtgtattatgggcttaaatggaaaccataatgctatactttttaaatcttcaggttctaatactcataaagaggtcatatacttgacaccagaagcacaatccagtacctaaaaaagtgcaccttatcaagtaaaagtcatataaagagaaattttattctgagaaaaaacaaattatagacttggagaaaatgtgtacaaatcacacatccaacaaaatacatgtatttgtaaaacataacatctttcataaacatggcatttttttctttttcccttttcaatttctttcatcagtgtttaataatttttattgtagagatctttcacttcttttagtttattcctaggtagttcatcttatttgtagctattgtaaatggaattgctttcttcatttgtttttcagattgttcactgttggcattttgtattctgcatctttactgaatttatcagttctataatgttaaaatacctgtaccacacaaagcaatttacagcttcaatgcaattgttcacagaaatagaaaaaataatcctaaaacgcatatggaatgacgaaagacccagaatagtcaaagtaatcctgagcaaaaagaacaaaactggaggaatcatgttacctgaccttatactacacaaagctatagtaaccaaaatagcatgatgctggaataaaacggatacacagaaaaattgaacagaataaagaacccacaaatgaatccacgtaattaaagtcaatttattttcaataaaggtgtcaagaacatacactggggaaagaacagtcccttcaataaatagtgctgggaaaagtagatagccatatgcagaagaatgatgctagatccctatctcttgccatatacaaaaatcaaataaaaatggattaaagacttaaatctaagaccctaaactgtaaaacaactagaacaaaacactgggtaacctctccaggacattgatttgggcacagatttcttgagtaagacctcagaagctcaggcaatcacagcaaaaattgacaaataggatcacatcaagctaagaagcttctacatagaaaaggaaacaatcaaccaagtgaagggacaacctacagaaccaaagaaaatatttgcaaactacccatctgacaagggattaataaccagaatatgtaaggagctcaaacaactcaataaaaaattaattttaaaatgggcaaaagatcttttagacatttctcaaaagaagacatacgaacggcaaacagctatatgaaaagggactcaacatcactgatcatcagagaaatgcaactaaaaactacaatgaaatattatcttatccctgttaaaatggcttttatccaaaagataggcaataatgtgagaatgtcgagaaaggggagcacttggtacacactgttggtgggaatgtaaattagtacagccactatagagaacagtatggagattcctcaaaaaaactaaaatagaattaccacaagatccagcaatcccactgctgagtatatatctaaaagaaaggaaatcagtgtatcgaagagatatctgctctcctgtgtttatttaaagcagcattattcacagtagccaagatttggaatcaacctaagtgtccatcagtggatgaatggataaaaaaatgtggtacatatacacaaccgactgctattcagccataaaaaggataaaatcctgtcatttgcaacaacatgaatggaatggaggctattatgttaagtgaaataagccaggcacagaaagacagatggtgcctgtctgttttaattcatatgtgggagctaaaaacaacaaaaaaattgaactcatagagagtggaatcatggttgccagagcctgggaagggtagtggggatggggggataaaaagggaatggttaaggttacaaaaatacagtcagaagtaataaggtctggtgttcagtagcacaatagagagactatagttaacattgatttattgtgtattttaaaataacggaaagagtgtgattagaatgtttctaatacaaataaataataaaggcttgagatgatggataccccaattaccatgatctgatcattacacattgcatgtctaacaaaacagcacatgtaccccatgaacatatacaactattatgtacccataataatgaaaaataaaaattaaaaaacataatatctctcaaaactgaacatttaaaaaacacaaacaatccaatgagtaaatggtaaaatgtatgaacagacttttcactaaatagaatatacaaccgaataagcatattaaggatgttcaaaatcattatccgtgaggaggtgcaaatgagatattaataaacagctaatggaatgattaaaattcaagaaaaaacagtggtacaatcagatgttggtgagggtgcaaaaacgtggtaattcatatattgttggtgggactgtcaaacagtacagccattctgaaaaaatatttagcagttgcttttaaaattataagtagtttacaatatgtctcagctatttcagtcttgtgcatatatcccagacaattaaaatattattttcacatagaatcttccacatgaatgttcatctcagttattcataataactaaaactggaaaccacccaaatgtccttcagtggatcaaaggctaaaaaattatggcatatccatacaaatgaaaactagtcatcaataaaaaggaattaagtattggtacatgcaagaacttggatccagttcagggaaattatgctaaagaaaaaaatccagttgcacaaatataaaaaccatatgattttgtttatataacattcataaaaccatgtaattagagagacagagaaccatttaatggttggaaggagagttagagatgagggaaaagaaaaatatctatctacaaaggggtaatgttagacaaccatgtagtgatgatacagctatgcattgtcattgtgatagtagtacataaatctaaactgtgataaaattgcatagaacaaacacacacacaaacacacagacacacaaatgagtgtaaatatactagagaaatctgattaaggtctctgtattttaccaatgtccatttcccagttttgacattgtaggacagatttgcaacattttaacattggtgaaggatgagtgtaggttgatttattcttcttttaatttacttatgtatatatttatttcaactacttttttcatcctaaattaactgaaactactttcttcagtatcatctactaataaagtaccccaaattctaagttgtgggaagaaggaaactcattctaacaacctcttggcatatattttttcttgatcttcagtgtctttaactcctttgctctaagttgccatattaagatattcatacatctagttatatgccacttcagcatatttgacatatgaatccattcctcaagcatttattcaggtatacaattctaatagtaaaataaaggtttagtaaaaacaaatatatttattcaggacttttcatcaaatcaatttaaaaatgttcagtgccacagactactcatatgctgtaggcatgaaaaatttaatgatttttctctttcaatattacagttacctttaaagattgaatttgattgtgaattgggatatcacaataggtgacatccttggaattcacagactatataataaaactgcaacgttttctataatttaagtatacttacatagaaaactctgctgtataaatagaaatattctgggaaccctgcttaaagtgaaggggaggccttttaaaatgttttctaggtgagaactaaaactatacagaaaattttggttggcagaaagattcagagctgtctggctctagatccaatttagtagccactagtcacagtagtcatttaaatttaaattaaataaggtaaaatacagttgaaatttcagttccttagtttcactatccacatgttgggtgtttgatagttatacaggatggcaaagatgtagaccatttctatgagaacagaaagctgcattgaaacacagatctagagactaacctactgtaagccaaaatccatcattgatacttcctcctggtgatgacattgctggctcacaatctggaggagcataaccaggatcacattgacaatggaaatgttcattgcaaatctaaaaccaaaacaaacaaaaaaagcatttatgtacaaccaaaaattcactgccttatatgtgattgttagtcaatgtaaattttaaaaatattaccatttaatataaattttaaatttaatatgaaaaataattttaaaaataaaaggcagtataataaatgtccatgcaatatattttcaaacatcatagaggtatcttcttgtttgtctcttacatttctaaataaagtgaataccattcttgatacaatttaaatgctttttattagaagggcgtacagattatgatgctagaaactatagaatggtgggagtaaaaatttattataaattgtgttggatttaaaaaaatagttgtgatgagggccaaattttatttaaaaaaatagggggggaaagccaaaattttaagatgcttgctcaatcagatacagacacaaaaaatttatatagaaagctagaaaaaatgtataaatgtgatctggcagacgaatggaaaaagggccagtagagaattcagaaataaatgcatacaaaattgattacgaaagtaaattaaaattaagaaagaaaagaaactgtaaataatagatgtgtaagtaattttgaggaaaaattgatgtaagccacacaggcaggccactttttcctgaattactataaaaaatatgaatcatcaatatggcagaagacactgaccacaaagagacaaatgcatgcttagaatgacttataaagtttacaacatttctataagccagtagataagtttacaatagatgagcaaacagaaatgcaagtggcagatatgaccatatatacttaggaactgtattattaattagcaaataaatgcaaattaataatggacttagcatgttaaaagagactaaaaagattaatacaactaatctggccagaatatgaggaaatgcacattttcacacatgataggtgggagaaaaaactggtataatgtttcttgacgacagcataatacttaggaaaattcaaattgtgcatatattcagcccaaattttatttgctaataatttaaggaagcatatcaatgtgcaaaggtaaatttacaatcatatctgttgtaccactatttgtaataagctaaaatttaacattaattgaaaggccatcagtgaatggcattttgaatatagtatggatgatccatatagtgaaataagttgaagctgttgaggaatgaaacagatcttaatggattgaaaactctgatctcataaatcaatgtacataacagtgtgtgaatgttcatattgtataagtacacatacgctcaattataaacaatatgtatgtatatgcataaaagcataagtagagtccttaataaatccatttctaaaatttaataatcttaatctaatatcataataatggattctgtttcatggtgcattttttacaaagtgtaaaacttatttgctcatgaagcccataacaatctgattatatgcataaataatatgtatgtataaatagtggatctactttccttatttaatgacaattttcaaaaagaaattttcacatctactacttgtgaactttattattatcatagaacatgttattgacatagattaaaataattatactgagaaaaatagtaactgttacataccccattctgtccacaatttgtagtatattttgttatatttagttcactaaaatttctgcattctcgggagtgacatacctaaaatgttatgaagcaaacagcaacaaaaatactaaatgtaaagtcaagagataaggaatcatattcatacaaatattatatgcacaggagatatacagaacagatgaatctgaatttcatagcattttaataaaaacccataggaacaattctaaatggtatgttattaataagaaatattacaaatgagatattttcagaaagcagaaatatacatttttattacacactggtacaagaaaaaagtagccagcttgtactagcaatttttaatttataggacctcttttaacactttttatgcacctttcttttatttactcatatagacccttagaaggagatatttttgggctcattttgtatttgagtagtagggtggctgtgtcaaatggtgggtagtactttgagaaatctccatactgtttctcaaagaggttgtactaatttacattcccaacatcagtgtataaactttcctttttctccacattcttgacatctattgttttttgactttttaataatagacattctgacttgtgtaagacggtatctcgttaaggttttactctgatagttggtgatgttgggcatttttcctatgttttttggccgcttgtatgtcttattttgagaagtgtctgttcatgtcctttgctcacttgttagtggggttacttggttatttttgtcgctgttgtgttgtttgagttccttgcagattcggatattagtcctttgttggatttataatttgcaaatatttttcccattctgtagattatctgtttactctgttgtttcctttgctgtgcagaagctttttagtttaattaagtcccatttatctacttttgttttcatagtgtttgcttttgaggacttggtcacgtattctttgcctgggccaatgtccaaaagagttttttgtaggttttcttctagggttatagtttcatatcttatatttaggtctttaatccaccttgagttagtttttgtatatactgagaggtatgggtccagtgtcattcttctgcatatgctacccagttttcccagcaccttttcgaagatggtcctttctccaatgtatgttcttgctggctttattgaagatcagtttgatgtaaatatgtggatttctgggatctcttttctgttccattgatctatgtgtctatttttataattatatcttgctgttttggttaccattggattgtagtgtaacttaaagctaagtaatgtgatgcttccagcattgttctttttggttaggattactttgactaatcaagctgttttcgtgtcatataaatttcacattttcttatttctgtgaaaaatgacattggtattttgataaggattgcattgaatctgtagattgttttgagaagtatggtcattttgatgatattgattctcccaatccatgagcacaggatgttttcccatttgtttgcatcatctataatttattttatttatttaattcagtgttttgtagttcttgtagagatccttctcctccttggttaaatatattcctagctatttaattttattttttggtagctattgtaaatgagactgtcttcttgattttgtccttggctagatcattattggtatatagaaacactactagtatctgtctattaattttgtatcatgaaactttattaaacttatttatcaaatctaagagtttttttggtggagtcattagggttttctagacaaaaactcaatcatcaggaataatttgacttcctcttttccagtctggatgactttattattttctcttgccttattgttatggtgaggacttccagtactatgctaagtaagagtggtaaaagtgggcatccttgccttgctttagttcttacaggaaatgctttcaatttttccttgttaagtataatgttggctgtatgttggctgtatggttgttgtagattgcctttatgatgttgaagaatgttccttgtatgctgagtttattgcgaatttttatccgaagagatgctgaaatttatccaatgatttctctgcatcagttgagattatcatatggtttttatctttcattctgttgatgtgatggatcaaatttttgatttgcatgtgttgaaccatctttggatccctgggatgaatcccacataatcacgatgtattatgtttttgatgtgctgttggatttgatttgctaggattttcttgaggacttttgcgtctgtgtcttccagagatattggtctttacttttttttatgccgttgtttggctttggtatcagatgatactcgccttgtagaatgagttagagagaatttcctcctccttgatttttaacaattgtttcaaaaagattggtattattctaattattagttattctatttattagttagtctaattattagttattctattccggaggtagaattgggcagtgaatccacatggtcctagccttttttgttgttgttgggataatttttactactgattcaatctcactagtcattattggtctccttgggagttgtatttcttcctggttcaatcttggtaggttttatgttttcaggaatttatctatttcctctaggttttctagcttgtgagcataaagttgttcataatagtctctaataatcttttgtatttctgtggtgagttataatgcctgcttttttatttctcattttgtttgtttagatcttctatcttttcttcttgtttagtctagctggtagtgatagtgacaggggccagagaaatcctaggcagaagagggtgggtccctggcaaagccccaccatcaagccgaaaagcctgagaccgcagcccaaagtgagaactcataaccctgttttcccgctcgaatgctgcctttccctaaacatccatggcccaccccaccccctcaacctttgcctatgaagacccccagactcagccggcagagaggagaagcagctggatactggggactacagccggacattggagagaagtggcttgacttcagagggacagcttgacagtgtaacttggaggagagtccagctggagatggccggacttgaggggaagattatctgctcgtcccctttccagctcccctttccactgagagccactttccctggcaataaaatctctcgcatttaccatccttcaattcgtttgagcgacctcattcttttctggatgccagacaagagctcaggagccacgagtgtggatacaaaaggctgccacactggccctttgccctcgctggcagaggacagctgcgggcccactgagctgttaacacttaagccatctgcagactgcagagctaaaagagcactgaaacatgtcctctggagcttcaggggtcgcaggcaccccccttagatgctgctgtggggcccgcagggagtttgtttctgccagcacccaaaagcacttgctccggctcctttacccgctcacctgcacgctccctcctgcgaggggtggaatgcagcaggtcccagcgagtgaagctcactcctgccagcaccgcagtggctggctggtttctgtgctcgtatactccagttcccgccccgtttgctcctgtgctccctcccgcgaggagttgagcgcaacaagctaagtaaacagggcatccctgtcgtgagtccaacgaaagagttggggaaataccgtggttcagtagtgtatcaattttatctttttgaggaacaaaccttttgtcctgttgatccattgggtttgttttgtttgtttaatctctgtttagtaatgacggacctctcttctcactctgttagttctcatgagagctggtttttttgtttgtttgtttttttcaaggagtctagaactttcctcctctgtctcttgcttcttctctcaccgtgtgatctctgcacataccagttcctcttctctttccaccaagaggaagcagcgtgaagccctcaccagaagcagatcctggcactatgcttcttgttcagtctgcagaactgtgagccaaataaacctatttcctttataagtcacctagcgttagtattccttcatagcaacacaacaactgactaagacacattaaatctcacaagctaaggggcttcgtccctcaagactggccccatatcaggtgcaagtatcaggtaaaccatacttctgacagaccagatataaattaggggttctcatgacaccctccacagggtaacaatgttagaatggctcacagaactcaggaaaatactttacttgtatttaatggtttgttacataagatacaactcaagaacagctacatggatgatacatttatggcaaggtattggaggagaggagaagaatttccatgctttctccagctgcaccaccctcccagcaaattgatatgtttattaacccagaagatcattgaatctctttgtttgagggttttaatagagatcaatttccagccctgcctctcttcttccaaaagtccagtgagtcaggctgaaagttccaaccctctaatcacttggtcatcctgataaccagccctgttataaggccagcaaggggtcccaccctaaatcgcctgatggaaataagcacaatttcaggtgtgactgaaaggtgtttattcattctcaagaacaaaaaacactcccatcacttaggaaattccaagggttttattagaagctgtgtgccaagaatcagaggcagagaccaaatatgttctgtgttatgctatatatattatatatataaaaaagataaaattagtatatcttttatatataaaagataaaattagttaatatatttaagtatttatacttctgtatttatagtaaatattttttcagtttgttttaaatggtctttggaggaatgacgtattactttacaatatagtcagcatcagtatgttcctttgattaattcattacttttatgtgtgaatatcttttcccattctgagataagtatacttttcacttaaatttatctttttattttaaaaatatatttctatatgtaaattatttttataaaaatgtgtggtaattgtatactttttaattagtcaacttatttttcagtgttactagtttgaaaagcctttattaggtatctcaaaattcttaagaaagataaaaattaaaaaaacttaaacactatgttttattgtcatgttttatgtgaaggccacattttagacaaaatatgcttatggaagaagtagtaggagagcaggttaatgagaaaataattgctttacttcaattgtaaccaaaataattttttgtcaatcactacaagactaaatatttgtcttttttgggttttgttttctttaaagttcttgttattcaggttgttctgacattttttttttgcatcattttattcttttttgttcttggtttacacaaatcatcacagatcagatcctggcctaacagggagtcttagattctcaagcaagacgaaacaagtttaaatatcagtagtaaaagtttaataaaaataacagatagtaaaacaagaatttctttaaccagccgaaattctgatcagtgtatcttaagatcatgatattgtaaccaaaatttgtagcattcattataaatgaaaatttaatcatcctctcaatctctctctctctctctgatacacacacttcagacactcacagacaaatccaccatatatcgtatcaataaaaattttatttaccttgtgttggccacatgcagttatatcttctgtataggtctccgattgttttgaaccatttcttgcatgtgcggacaaacatacgtgacctctaaggtaagtatattgtatgtctaagtctgtcattggtactagttctgaatgtatccagtgacaaacaatctttccacaaaggatatcactagcaacataagacagaaaaaagttacccatttgtcacttaggtacacaattaggttaataacaattcaaaagtgaggataattcaaaatattactcagatcataacagcaaagcttttcacagcacacaatgccatattaaatgcaacaaataagtctatctgtatatactagatactgtctctcatttatttcaagtcactctttgcagtacatacacaaaacacaacgcacgcacttggaagatgtatacttttctaaatacgtacaaaaaatcacaacgggaaccacagtttccaaatttgtcattttgaaaattcacttcttctgtacacagaagattagcagacttagcaactgaaaacataagaagtcatagttacttatattaaaatattaaatggtaaaagtgtggtaagtcaatagaaagatatctagacaacaacaaggcccagtcagtgtaatctgctataaatttttgatgtcatctactggctttacaaggagaagcacttactgaaaactacacacatgagaagagaaaaattcatgttatagtgtagaaataattaagaaatcagtcacctgctctcttatctactattctaatagtctactccctttgcaacaaccaccttaagttggactaatgtcctactgttgcatcctgtagttattaggtctattataactcttgacatcattcaaagttgctttgatttgcaattttatttctaaatttgaatgtaaaacaacactttcagggatggctcttgggtgggttactgactttagaatagctacagtttaaatataaacctcaaaaaaaaaaggtaaaacaattacattttccaaataactgtgaacactgtctatccctttctctgcatactcctttaaagcaatagctagtcttattactgcagtattctaaatcagcagctttcacatcaggtacacaaaactcagatgttccattgcaatattctggaaaatcacacatatctacactttttctgcagacatggcctctttcgtggatctgtgagagaaagaaaaaaaaatacatttatttttcaggctcaatccagtttgcctccattaccaagaattgaaatggactaaatcaaacaaggagctccaatggcctatctatactgcatattgagaatgcttgtttgagaattgtcagcttaaaagcaaggatatccaagagatgcatagaataaaaatcctgtttgaaacaaacactcactagagcatgaagccagacctatcttcaattttaacctaagtttgtgtttatttttcttcgcttggacattcttcatccagttacaactgatcaatacataatcagtattaatgtttttatttaaaaattaccggtaggaatatctaagcactcattagaaataggtaataaaggccaggtgtggtggctcacgcctgtaatcccagcactttgggaggctgaggcaggcggatcacctgaggtcaggagttcaagatcagcctggccaacatggtgaaaccccatctatactaaaaatacaaaaattttctgggtgtggtagcatgctcctgtaatcccagctacttgggaggctgaggcaagagaatcacttgaacctgggaggtggaggttgcagtgagctgagactgcaccactgcactccagcctgggcaacaagagtgaaagtccttctcaggaaaaaaaaaaagaaagaaagaaaaagaaataggtaataaaacttaccgtacaagttttattgttacagcatgatccagtgccacattctgcagatctaactagagtacaatctgcaggattacagcattttttatgagtgcatgcctaaaagcaaatacattagatttaaatgttttacatcagattttagtcaaataaatagttttatttattttcgaaataaagtatctctccaacttgattctaatcacaccatgacttttggattctgtatttttacaccacttcatttaaacttaatgtactttccctataagaaaaaaaaagatgacaatgaaaatattcacaatttcattctaaagaaattgatctattaaaaatttagtgcaattttttaaaaaaattatttttgtttataaaaacatgcatgcaagtttttatatttttttacttactataccataagtacttttccatatcatcaagtcctctcaaggggagtggctggaagagtttggaggagcaagatagaaaaagcctacatttggccaggtgcagtggctcacctgtgatcccagcgctttgagaagcaaaggtgggcagattgcttaagctcaggagtttgaaaccagcctgggcaatgtggcgagaccctttctatacccaaaataccaaaaattagccgagcatggtggtgtgtgcctttggttccagctatttgggaggctgaggtgggaggatcgcttgagtcagtcggggtggaggttgcaatgaactgagatcaggctgctacactccagcttgggtgacagagcaagactgtatatcaataaataaatatgaataaaaagcacagattcttgttagggattaaaagacaagaagatgagggaaagttttaaacttcttagagattagataaatgctcatgaccagaatgttgatagaaatatagatagcaaaggtcattctcatgaggttaagatgaaactgaggaataaggttttagaagcaagggccatccttgctataaactggccaagaacttggctgaactgtgaccatgcctgaggggtttgtggaaggccaaacttaagaatgatgaactaggatatctggcagaagaaattttacatagcaaagttctcagaatgttgtgtggttgcttctaatttcttattgtaaactgctagagaaaagaggaatagagcagaacaacttgaaaaactcatagtttgcaatatagtaaggaaggaaagcgcattcacaggagagaaaaccaaggatgtagcacagggacacctttgcttaagagattaacaaagatagaagaaagcggatatggtcaggatcggtgttcctgcccaattctccctacaatgtcaattgtaatccccaatgttggaggtggggtctagtgggaggtggctgaatcataggggtagcttctcatggtttaacaccatcccactgtggagctgttctcatgataaagttctcacaagatttggttgtttaaaagtgtgtatcacctcttccttctctctcatcctcctgctctggccatgtgaaatacgcctacttccccttcaccttctgacatgattgtaagtttcctgaggcctcccccagccatgcttcttgtagagccagcagaacaataaaccaattaaaccttttttctttttttataagttacccagtaccaagtatttctttatagcattgagagaatggactaatacaaaagccaagtgctattcctcaagcaatgaaagaaaggccccaaaggcatttcagataccttcgaggcccagacgcctaggagggctgaatggcttcagaggacaagcccagggcactctccatgagctcactgaccaattccacctcaggatgctgctcctggccctgctgcacaatgccctgcagctaccacggcctcagctgcaacggccataggtacagcttctatcgcagctccagatggtacaagtcattaaccttggtggaatccacatggtgctaattttgcaggcttgcagaaagtaagaactgtggaagcatggcagctcccactcagatttcaaaggatgtccttgaaagcctggaggcctgtcagagacttgttgcaagggcaaagccaccacagagtccccccagagcagtgcctagtggaactgtgagagtggaactatcacagagaccccagaactatacagcagccagcatgcaatgccagcctggtggtgttgggttgattgagcccagccaaaccatagggatggggtgacccaatgccctggagcccactgtacctgtttatagaagatgcaggacatgtcatcaaaggaaattattcaggagtctgaatgtccatcattggctctcttgggtttcagacttgcttgaggcctgttacccatttcttcttgtctatttctccttttcaaaatggggttgtgtatgctgtgcttttaagtaaataacttgtgttgattttacaggttcttaaagtatcccctaacagacatattggcagtcttccccaagggactccttgtggctaaaatgagacacaccagaaaccagaatatcatggctagcaaaatgaaggggtagtcatgtattctggtataattaattctatgccagctgataaccctctcccgcaccttgtggtcctgccacaactccaactggacagaaaactggtcttataaacattctttattgataaacactcaggaacttcaagccagtttcaggcaacttatagagactgcgcacaaactgtctttgtgccctacggtccctttttgacataaagagccaaattccacctcattttagtgataattaaaagtgaagtgaatgtagaacatatgttacatgaatgtttactcactgtacacacgcctgactgccctcatgaatattcatagatttctcccagtcttgctcagtatgtgtgtaaagttgactctgaaagacatatataccacctccctcttcctttctgcagagaatgaacttttggctttcactggaagctatgttccccaatctacagattgcttccgcctctgaaaatgtcttttccttttcttccttcatggatatcaaagtcttttgttaacagttctggcaacatgggatgggatccaaagtggcccctgatttctttcttggcactgccttgaaaaattcctaagttcaattgcatcctggttacactgggcaagaactgggtaagtgctattgaatctgagagttcaggcttttagattgaaatctagggaaatgttttctttaagaaagttctgcccattcatctgtggcctagacctacctgcagtccagcagggatgcctgcactaacgttgcactgggaaggccaccttctttaggtgagtactgtgcgtaacttacccagtaaggaaatggttttggaccaactgctgtcagagactctggaggtttacatgtttaaaaactataggaaaaattcttgttaatatttggtatcctggataaaaataagtcggtatgacttaaagctttcttggtcacaatggggaacttttaacatgcctcaatcagtttatctacatgtgcaataaagaacagaagattccaaacctctcaaaagcagtgtgaggtctttttcagttgctaaaatgaaagctcaaagtgaaatcaaggatccctagttgcctctttaaaagagactaaatcaaaacttaatcaagatcttaaaaaatttgaaaattcttctaaatcggaccctaaatccaaaactaaaaaggacactgtgccttcttgcctttctccttgaactccaccaatgccacccccatatgcattagccccatgctgccagtcacttctctctgagctgcctttctttccttcaccttctattcatgagcaaccccctccagttgctaattctgcaacccctctgatcacaccttttaaagggattgctaactaggcttgcaaattaccttttactgtcctgggacaaagtctcagctttcttctagcgttagtcaaagagttttctaatcctaaaatagactcacttgagtttgaatgccgctttagtttgattataaatgtttaccagccaggacctcctgatgttcactagttgattcaagtcttagtggaaaatgtcttaacccaaggatggatgtgtttagctgactggactaagccccaagatgattttcagcatactaaggaaatagcctttgaagtggtgagaaaaacaattgttgaattgattaaagccatctcagcactctttccttgacaaactaattggaatgccattgactcagaaaaaagacaaatctgtcattgattcctttgactgattcaaaaggctttcttttttctttttctttttttttttttgtttttttttgagacggagtctcgctctgttgcccaggctggagtggagtggtacaatcttggctcactgcaacctccgcctcctgggttcaagtggttctccagtctcagcctcctgggtagctgggattacaggtgaataccaccacacctggctaacttttttggtattttttagtagagaaggggtttcaccatgttggccaggctgctctcaagctcctgacctcaggtgatccacccaccttggcctcccaaagtgctgggattataggtgtgagtgaccgctcccggccgattcaaaaggctttctacaaaattctggtatcaaagatctaactgatgatattataaatcttttttaactcactttccctcaagtaagttaaagcccttagcaccctgcttaagcaatatgatcccaattggccttctaagagaccctatgatatagcttctttggccaatcgcttctctaaaatcctagaaaagaaaaaagaggctaaagccaccaaggcactagaatggcaagaaagacagataaactcatggccttgcatattcaacaactcataaagtctctcccagatcagcaaactccatttaatagttagaaattagtttcgtcagttgcaagaggtataatttgctttttctggcatttgaaatgagactgtaaaaaatataaatgagggcttcagaaggacaccaataaggtaaagaaacccccttctgcagaaacaataagagaaatacttattgatcagaactaggggtacttcagggaaacatgggggatttttcctctcctttcagtcagttgattgggagaggtttatcttaaaaattaacaacagaatagtccaagccctaatagatactgcatctgtgcttaaccttgactccttttaaaatccaaccacccagagtgaccaagctattcaaatggctgagtcactaaccaatctaagactatcttcaagtctgaactagtttcttaccaactagggcctcttactggcattgcagcttttcacttctccattttgccacaatacacctaataggaagggactttcttgaaaaacaccaagcttgtttttcttttacattgttttaaaagtttccttgcctgaggcttcagcctctgacctcagccatgtattccccttattagtctccagtcatccagttgatcctggacatccaactctaaagtaactgtttgaaaccctttgggaataaatcaatacgaatgtcagcccgatccagtcagcaccacccatttctacacaaatagatcctaacaaacctctactgaacataaaataatatcccctccaccatgaggctttagctggtatacaacctattgtcagtaatttcattttcaagggacttattagtccatttataccagtccctgtaacataccccttctacctgtttctaagctaatagaaagggatggagacttgcccaggatcttagagctattcataacattttattcccttgcatcctgttgtgcctgttccacataccctcttatccaatatacattctaacatccaatatttttccgctgttgatcactatagtacttttttcaccaacccggttgacctcaagagtccatttctttttgccttcacatggaagggccatcagttcacctgaacagtgcaccctgaaggatgcactgaaagccctatctacttttcccagatcttgcaggctgacttaaaagacataaccttctcgatacgaacagacatttctcaaaagaagacatttatgcggccaccaaacatatgaaaaaaagctcatcatcactggtcattagagaaatgcaaatcaaaaccacattaagataccatctcacaccagttagaatggtgatcattagaaagtcaggaaacaacagatgctggagaggatgtggagaaataggaatgcttttacactgttggtgggagtgtaaattagttcaaccattgtggaagacagtgtggcgattcctcaaggatctagaactagaaataccatttgacccagagatcccattactaggtatatacccaaaggattataaattattctactataaagccacatgcatatgtatgtttattgcagcattgttcacaatagcaaagacttggaaccaacccaaatgcccaccagtagatagactggatagactggataaagaaaatgtggcatatataccccatggaatactaaacagccataaaaaaaggaggagttcatgtcctttgcagggaaatggatgaagctggaaaccatcattctcagcaaactaacacaggaacagaaaaccaaacactgcatgttctcactcataagtgggagttgaacaatgagaacacatggacacagggaggggaatattacacaccagggcctgttggggagatgggggactagggtagggatagcattaggagaaatacctaatgtagatgatgggttgatgggtgcagcaaaccaccatggcatatgtatacctatgtaacaaacctgcatgttctgtaaatgtatcccagaacttaaagtataatttttttaaaaaagacataaccttctcacatagctcaactctactgcaatacattggtgatttgcttttatgttctcccttatgaaatacctgtctcactgacactctccatttacttcaccagctatgtcttaagggccataaagattctaaagataaactacagtgttgctgacaattaaacctcttggacatctgctgaccccttgggactcaacatcaaccctttctgccttcaaggcatatttttcttccccattcccactatgaaaagacaaaacttagggcctttctaggactcatggactattgcagagcttagaacactaatttttctttactagcacaacctttatataccctgattaaggcctcttctcctgacctccttacctggactaccgatggtgaacaggactttaagtctctgaaagataagctgtcctttgcccaatacacccctcaatttgggacactatttatgacctccctttttcccctttttgttcatgagcaagagggagtttgaactgaaccacatgggggtaataatttacccaattggttactagattgccaaactggattgtgtctatccggggataccaccatgtttaaaggcagttgccacaatcactgtccttataaaagccaccgagaaaatagtaatgggatttcctctcactgtttatgctcctcactcagttaaagcccttctcacttctcgccaaatccagtatctttcagccagtcgattgactgcctatgaaatacttctctttcccaacctattttccattgtaatctccttaactctgcccctcttttgtcttcaccagaagattctctatgactgcattacctttacactcttctttcaccccatatgaatttaaaggaaatgcccttacccaatcctgattttgtctggtagattgatgggccttctttcagagaccctactggcttctattaagctaggtttgcagttgtttccctgacagaaactattgaatcaggccttctgcccaacaggcagaattccatgctcttacccgagtttgcctgttggccaaagataaaactgcaaacatttacacagatagcagatacgctttttgggttgctcatgactttggaattctccggaaacagaggatttctaacctcttctggactgctcatcagaaacagagaccacattttgtcatttcttgatgccattcaagttcctaggactctggccatgattaaaattcaaggcaattcctttagacataccgaaaatagcaaagacaaacatctagctgagagtgcagctaagtctgcagccttaaacaataccccccttctgttatgcctgtcttaatccaggctccatccttacatcctgtttcttctaaaaatctcttgaaacaacatctcaaaaaaggtgctcagaacttgaaaaggaaaattagacaaaacaaggctgtacctataatcccagatcccaactatgggctaaacctaacagacattcagtccttctagaaaatttaccaagggtcacttttacttttatatataaccccaccattagagttctgaccaaaggatccaatggtgtaaacagtgctgttggggattgcttcttaagctaatatattaggcaaaattcacccttatacaatgcagggaagtccttaagggctaccctaggcaaagtcccaatgcgaaaagggcctttctaaaactggactactgattttatccaattttccctttctcagtgatacaaatatgttcttgtcatgatagatatgtagttttactgggggaaagctttcccctgaagacaagccacagtgatgccagtagccaaagtacttcatgagaaaattatctctacctatggagtttccaccaagttccacagtgatcagggaactcattttactggacaagtattaaaatgagttgctaatgtttggcctattctaagacatttcagcggtgtttaccacaccgaatcttttgggcttgtggaatgaaccaagagaatattcaactcaattggctaaaattacaagcagcttcaatctgccctggcccaaagctcttcctctgggtttggtaattgtgaagtccatccccaccagaattgcttttccccttttgaggtggtcacaggtcaatccatatatttaaccgaagaaatattttcccctgcttagatacaaggcgatctcctgacctactgccaagtcctggaggacttgttaatgctctaaagactaacagctggttgtgaatccctttacagtcatcaatcaggagatgaaccccaatatcataatgtccagcctaaagactttatatattagaagagatattgctgaatgactccctccaatcccactagaaaggtccatttcaagtacgcttaattaacccatttgctgctaaggtacaggtcattactcctaggtacacatatcttacctaaaaacaacaccagactctgctgagaactggacttcagcatcaatatctgacactaagctcaggttgactaaagcctcaatgccaagacaagaaaaggatgacaactgaggtagactgccctctcacaaaactccaagcctatatggtctggatgaatcaatgtttatatttaccttataatagtcattgttcatatcacttcaggagttttcacgattgttactatccaatgtaaaatagaacacttatctttgccttacttattctaaactaacatgccgagcctttatgattcctttataactgtttccattattataacattagcaatcttgtctatcctggatatcttatgccatccatgctgggatagttctgtgtattccaatacttagacacccataagcctttgcaaaactataagactttttgtctggctaaactctttgttccagagctttgtgaatggttgtgttgattagtccagttcaaaataaattttactctattctttataactgtccctttgtctcactgcatagagtgacatgataacactttggctaagctgtcctgaagtgttgttacaaatagaaacctatcagatggttagattcaccaataacttcccacattcattcatggtaaacatgtgacattgacaatacttgtcactgacttctcatgtatccttaacatcaccacttatctggatcaactgctttccctgttgtctctgagtccaattgcctcaagactcaaatattaccacctcttggtttaatttgtcccatgttattgatgttagaaacccattctataccagtggacctcctcgatctttaaactaatggatagataaatatagtctaaactgagtaaagaaaggtatgtccctactattcaaatgattcatgattcaattcaatactgtcaacatgaataaattcattagtgaacacacccttaagggcatcgcttgtgccttcaccaggctttgtgtttatatgggacatagggtctgatctgcctggatagggatggtcacaccattgcctcaacagcttacacataaaaggttcaggcttgcttatgaaaagacccccgttctgtctttattataaaactaaaaggtctatgctaacaggatgtaaagataatataggtaaaaacatcctagaactattacttctaagtgcttgggtttatgttactggagatataattcaaaaacctatccactaccattggttagatagctgatgacactgcagaaagccttacagcgcaacaaaaagtttctggactcccttggtcaagtaatactaaataatagaattgccttaaattgtctcctagccaaacagagaagagtctatgcagtagcccatgtaactgcttacacttacatcaacacctcagataaggtagaggttcccataaaaagaatttccaaacaagctaaatcgttatgagatatgcaaactactgatcctctccatctatttagtaggcttcctgtcagactggaaaattctttttgagctgacattcaagtgcttgttgtaatcacagtcttcatcatagtttcttcctaatagttaaattacttgatatatatatatgtctgtgtgtgtgtgtatatatatatatatatatgtctgtgtgtgtatatatatatatatatgtctgtgtgtgtatatatatatatatatatgtctgtgtgtatatatatatatgcaactgctgtaagtctactgttaaaaccagaattatggcagcataaggtgttcaactgatagataaagtaaacctataaacctagctacagtctcatccctacagtgccgttctggtgcaggaatgtgtatatgtacgaagacagctgtgctagttaaaaacaagtgttacaatctcccataaatagagagttttaactgtaaccctaatgcctatgacttccctgtgtaactggagtctgttaagtatttcactgaaaggtaccagccacaagcttgtttacttagcctctgtaaaacattttaataatcttcctgccagattgcagttttctcccacctccaacaaaatatttttgacctgtctacccttttcccctgcctggcctaagttatacaattagctgtaagtctctctgccacatgggtcccttcaagggacttgatacactcaggacaggtagccatgccaccctggcactaatatgggacatggtgtaaattggtcatcaaggctgcctacagcaggtttcaactaacagggaaaacaatgaatatatattccaacagacaggcaaaatggactccctgtggctaaaatgagatttagcaaaaaacagaatctcatcactagcaggatggagtatcagtcacatatcccagtgttattaattgccataagttttctctccagtaactaagcagaaataaatccctgaaaagcatttctgaaacaactacagctggaaaatttcccaactgaccctgacaggctgctaatgctagtcaacacccccaacgcccccgacgcctgtgccttgcagtcctgccataactccaactggacagaggactggtcctttattgataaacagccacaaatctcaagccagttttaagcagtttacagagactatgcacagattatctttgtgtccgattggttctttttgatataaaaagccaaattctgccttattttaatgctaaaaccctaccctaaagtgaacactgaatgcatgttacatatattttcacccactgtgcaggcacttgactgcttaatatgcaggtaatttcccccaaccctgcttaatatgcaggtaaggctgactctgtaagatatgtgtcaattcccccttccttctgcagaacaagcacttttgattttcccagaaagggcatttcccaagctgtggatttcttctccctctaaagtaaagtatcctttctttcctctgtggacctcacagtcttttgttcatagatcatagatgagactttagcccacacatcagtggataggagatgttttaagatggcataaggtatacaagaaacaaactgccaaactacctagggatgagcccagctatttggtttggttttgtgtgatgagcaaggagaaagggtaaagtggttgctacagacactggttatctgatcatgtggccatgaaacaagagcagctatggcaggtggataatgaacaccttagaccctggggagtcaagagtagaaggagaaaaaattaaactctcagctctcatctgtgggacatttgggctggccctatcaactcacaatgctttggtgatcatcttgttccaggctatcacaactgctcttaacctaagtactgggtgcccctcttaaggaaacttttcttaagaaaaccttaacctgagacctttctctcttttttttaaaggatcttattttttatttctatagatttagggggtacaagtgcagttttggtcacgtctgggcttttagtgtacccatcacccaaatagagtacttgtacccaaaaggtgttttcttgtcccttacgctcctcccaccctcccacctttctaagtctccagtgcctactgttccactctccatgtccctctgtacatgatttgttgatgttacaggtaggcagccactacccaagataaagttctgcacactaatatagtttcctttagccacatcttgttatatatggatgtctccattactgtcaaggaaaagaaagactcttatgtattttgctcaagcctatagccacccctctgaattatatggcttgctggacctgtcaactcagtaatcctcctggcaaaaaccagtagctattactatgaacacttcagaaatagatttcctcccacaggaaataataacttgctcccactacaaaatgatgctgaggaaaaagaatcagacataaataaatggaggtgtatacctcaaatatatctaaagattcgatgcaatatctttcaggagatgagtctactttatttttggtaccaattgaaaaaaagtcagaaatttacaataaaattcaaagggcccaaaatacccaagataactatgaaccagaaaaacagtgtgaggaatatacaatacaatatctcagaagttaataagaaatgtgtatttatcctgtgtccaagtgttctcattgttcaattcccacctatgagtgagaacatgcggtgtttggttttctgtccttgcgatagtttgcttagaataatggtgaacatcacacaccagggcctgttgtggggttggcggagaggggagggatagcattaggagatatacctaatgtaaatgacgagttaatggatgcagcacaccaacatggcacatgtatacatatgtaacaaacctgcacgttgtgcacatgtaccctagaacttaaagtataataaaaaaaagaaatgtgtatttattaagatagtgtactattggtacaagaggagcaaaagcagaaacatgcacaaatgttcacttgattgatgatcaaggttatgattcagtgtaataaagaaaggacagtcttcaaataaattgtgaatgtttaattttatatctttatgtgtatatgtgtgtgtatacacacacacacataaactacaaactgattgcagatctaaatgaaaatgataaaaagtatgccaaatatcttgagaaaaacagagcaacacacattaagtcctatgtgttatctgtaagtatttgctgcatggcaaatacttagaggcttaaaacgatgggtcatttattattttatgttttctttgggtcaggaatgaaggtgtggcttagatggccaattatggcttaagatctcccacacagtattgttaagatgaagctctcctggttctgagtgctgtttaattcatgaatcatactgcacttcaataaacagctatatttctctaaagtttttcttttcacaaatggaagatatctttaaaaaaagaaccaaatggaaatttcaaagatgtcaaatattgcaatgaaaaattcactggatctcttaataaaaggaaatattagtggtcttgaaatacaatagtcaaatatatccatatgaaagcatggagtgaaaactgaaggaaaaaaaaagagcttccatgaaagaaagcaaaacttttaccactcaaacaaaaacatattatgaagctgaaataatgcagttttcaatggaaacacgttaatgtttcaagtagtgaaattgtttacataaaaattatattgaagaaaatgtaagaatatgaaagacatttaacatatattaatcagcataagaatatataaataaatagaaaggaaaagggtggggcatggtgactcacgtttgtaatcccagcaccttgagaggctgaggcaggtggataacctgaggtccgaagtttgagactagcctggccaacatggtgaaatcctgtctctattaaaaatacaaaaattagctgggtgtggtggcaggtacctgtaatcccagctactccagaggctgaggtaggagaatcgcttgaacccgggagaaggaggttgtagtgagctgagatcacgccactgcactcaagcctgggtgacaagagtgaaactccaactccaaaaaaaaaaaaaaaggaaaaaatacttaatagatgaaaatacaaatcaaataaacctttcaaaggaaagaacagccatttcacagcaaagaaaacttatagggttagtcaaactatgaagatacaatcaattttactagcaattaaggcaagtctaattgaaaccacaaagagataatattttatacaaatacactggcaaaaatgacggagtctggcaataccatgtgctaaatcgggtataaaataaacaacctgttatacagtaaacagtcattggatgtgttaattagcacatttatttttgaaataaatttcccattgctaaggcatgatccacccacttgataacccagaaattctacatctaagtatgtagccagaagactcttatgtacatcaagagttaagtacaagacataataaaactcttcagaatgggaggggggaaaaacctacaaacactccaactgctcataaatagaaaaaaatcagtaattgtatatttccatacataatggattattacacaaaaagtgaataaatgagctacgtcacacaaaattacatggatatttttagtaacgtaggggatgaagaaaacagtcccagaagattgtgcgatattttttaaatggtctaaaattcaaagctgataaaaactatggtcaaattataaaatgatactgttaaattaaaaatatggatagaatttgctttttggacagagaaaagggtgaaaaattaggaataattgggccatggatgtatcattattgcatcatgtatattatcataaatgacaatgaaccaaagactataattagtctaattctttggaagcaagttaacataaatgaagttgctacagatgcaaggactaaaattaggaggtaagaaaataaatgaaaacacacatttaataacttagccaaccaatgtagccactttggtggaatttaagggatgattagatgataatgatattattgatgctactgatgtgtatggtactaaaagtgatattgctactaatgtttctaaaatgataaaaatctgttttttaaattgatgtcacacttacccagggtttagactctaaacgtttcaaatttaggatgagtcagttattgcatgccccatatctccctatcttatatttgacaaaatagtaaatatattttttcaaatttcccccttatacatatcatatctatatctatagatgccataaaaaaaaaacacaaaacataatgaaagaacaaatctctggataacctgtaagctttgccactaacctctttatagccacaatcacactgctctgtaggttccaaaattccattgccacaagttgaagattttcggtaagtcatttttgaaactgttttatcctgaaaacatttaagttcaggctgcagaactatccgtttaaatccatccatgctgcaactgctaaaaaacttcataccatgggatcatctaaaattaaattgtacttcttagataaatggactaaaagaatcaaagtaatactcctcaacaaaatgctatgaattctgaactacttcacttagagaagagccaaaaggagaagagaatgcttttatttttaatacaggtgataagcaaaaaatgaattatttgctattgtaatttgatatgatagacactgagagagtaaagaaagttaaaatggtaacacactcaataatatttggtacacaataagctccatttgagtatatcctattattgtcaacattaagaaataaaatttggttgattgtgttaatgaaaaatcataattacttgttctttgttaaaattaatcaaaaaagttatcccaatactgaggtatataaattgtacaaattctagattccttttattttgttttattttttgtatttctatacatttaagtatactacttaatgtgtaattttgggtaattttgtaataatctcaaacttaaataatgcaaatatggcccaaaaaaataaattttgttttctgaaacagttaagaggccggcaatgtgttctgtgaacactacatacatctatgtagttcttacatagaaatgggttattctacatcagcaccctagacccttcaaaatcataaaataatgacttattattaatatctaatgctcggactccattcggattttcccaaacatcacaatcctagcattttatagcaaaataatccagttcagaatcaagcattgcaaaattctcatgtctccttagttctcatgtctccttagtttagttgcttttcaaacttcttactacctaagtactatttcacttcatgacactgaacagtttttcaaccaatgcaactagactgctgtaaggtaatcattagcatccacttttcctctaaataatatcactgaatgtagaactattaagcacatttcctacaacattctatactttctttaatgtcttaagcacatttgtatctaaaacaatttcttaaattatattgcaagaggttctacatcaaggaatactagaaatatttcttaagagaaaacatagagctgataaaaacaactccttacatcgcatcaggattcattatgcatgtagttcctggacagtaacaattgtagatatcatcatatgtcaatcccagattaattccaagcaactgtgccataacaactgaaaaggcctctgcagtgattttctttggatactaaatagaaacaaacaaacaaaaacccagatttattgcctaagatattttttcactcctttgatcttgtcaaacgtttctagccatactatataaatacaaatgcaaattttaaaaactgctatttatttacttagaaataaattatttctaactacttagaaataaaaataggtacaattttttattccttttgagtgacaatatttttaatcaaaatgacattgacctaaaataagaataattcaatcatatatttttatgacatactattgaatttaattccagcaaatttcagaaaacgttctgagaagtaggaggattattttagtaactacaatatttctcaagagaacacttggaaaagatacacagattttggagagttgaacaggcaatcagttttgacctcagaaataatttgagaagagtcaattttttaaagtagaataatataacatcttacaagtagcatttctacaaacttccagaaactttgtcattatctctatatttttcctatttctgaaaatcatatagtgaaaatattaccacatatagtcttctaataagggtttctctcaccacaaatttaagggttttccacatcttattgtggcttaatagcttattatttaaatcactgggtagtattccattgtatggatgttctaaagtttgctcatccattcacctgttaaaggctatctaagttacttccaatctgtggcaattatgaataaagctaaaaacacttatgtgaaattttttggtggataaaagtttttaactcatttaggtaaataaatggatggtttaccataaggaggatgattgctggaccatatggcaagggtaagttgagtattgtaagaaactgtaaaactgttatccacagtggctatatcattcgcatttctgtcaacaataaatgagagttcctgttggtctcacagaatttggtgctttccatgtatgatgttgaccgtgactggtaagctactttcttgtgtttttcctgatctaagtagtaatgtgttatttactcaaaatatgttgtttcctgttttttttttttgtagatgctctctttaagttaaataagttcccctgtatttttagtttgctgagagtgtttattataaatagtctaggatttggtttttctgaatctactactagaatcatataatttttcttttttagcctattaatataatggaggacattattttatattcatgataaaccagccatgcatatctgggataaattacatatatatgtacattattattatatatatgtatgttacatatatatatatacacacacacacaaggagatagaaactaaaaaataatttaaaaaatctgtaactggattgggggggatggagcaagatggcggaatagaaagtgccactgatcatctctcctcctgcccctgactcccaccaacgacaccaatttgagaactattgacacaaaaaaagtgcctttataagaacaaaaaaatcaggtgaacacattacagtacctggtttgtttatttatttacgtttttgagacagagtctcacttttgtcactcagggctggagtgcaatggcacgatcttggctcaccgcaacctctgccttctggatttaagcgattctcctgcctcagcctcctgagtagctgggattacaggcatgcaccactacgctggctaacttttttgtaattttagtagaaatgaggtttcatcatgttggccaggctggtcttgaactcctgacctcaggtgatccacccacctcggcctcccaaagtgctgggattacagacgtgagccaccatgcccagctctggttttaatttcacatagctgaaagaggtactgaagtagaaaaaccactgacaccaaccctcgtcaatcctgtggcaacagtggcatggtgcagagagcatttctttgtgctggggagaggagaacgcagcaattgtgaggcattgaactcagtgctgcacttttatagcagaaaacaaaactgggccaaactcagctgatgcccacctacggagggagtattcaaaccagccctagccagagaggaatcgctgatctcagtggttggaacttgagttcctaccagcctcaccaccatgggctaaagtgctctagggccctaaataaaacttgaaaggcagtctaggccacaagaactgcaattctaggtgaatcctagtgctgaactgggcccagagccagtagactgggggcacatggcctattgagataccagctggtgtgactaagggagtgctggcatcacctcatccctaaccccaggctgcagagctcatagctccaaaagagaccccttccctctgcttgagaaggggaaaggaaagactggggaaggctttgttttgcatgttggatgcccgctcagccacagcaggatagggcaccagtcagagtcctgaggccccctttttaggccttagctcctggatatcatttccagaaggaacccactgccttgaagggatggactcagtcctgaaaaacgtcatcacctgctaactgaagaggccttgagacctgaataaccaacagtgatacccagggagtgtgccatgggccttgagtgagcatgtgagatttgctagctttgggtgagacttcatacactctcagctgtggtggcaacagggcaaggctccttcgcttgagaaaagtggagggaaaagtaaaggggactttgtcttgcacgttaggtagcatctcagccacagggcagcagagcaccaagcaggctctctgggtccctgattccaggacttggctcttgggaagcatttctggacctgacctaggctagaggagagtccaatgccctgaagggtgagtcccaggtcaggcagcattcaccaccagctgactgaagagcccttgggcattaagggaacattagcagtagtctggcagtgctctccacgggcctgtgttggtgatggcaatgaggtgaggctcctcacccagtttgtccaaacatgacaaataatatgctcctgaataaccagtgagtcaatgaagaaattaaaatggatattgaaaaatttctttaaacaaataataatggaaaaatgacataccaaaacctgtgggatatagcaaaagctgtacgaagagggaaatgtataactataagtatgcacaccaaaaaagaagtaaaacttcaagtaaacaacctaatatgtgtcttaacgaaccagaaaagcaagagcaaaccaaacccataattagtagaagaaaagaaatactaaagattagagcagaaacaaatgaaattgaaatgaagaaaataatacaaaagatcaaagaaacaaaacgttggtcttttgaaaagttaaactaaattgacagacctttagccagactaagaaaaaaaaaaagagagatccaaataaataaaatcagagatgaaaaaggagacattaccactgatactacagaaattcaaatgatcattggtggctactgtgagcaactatatgccaataaaatgaaaatctagaagaaagggacaaattcctagaaacatacaacctaccaagattgaaccatgaagaaatccaaatcctgaacagaccagtagcaagtaacaggtcgaagctataattaaaatgtcttcctggagcgaaaaggccaggacttgatcgctgcactgctgaattctaccaaatatttaagaagaactaataccaatcttaaacaattctgaaaaacagagtagaaaggaatattaccaaactcattctatgaggctagtactaccttgataccaaaaccaaacaaagacacatcaaaaaaagaaaactacaggccaatatctctgatgaatattgacacaaaatttctcaacaaaatactagcaaaccagattcaacagtacattaaaaagatcattcttcatggccaagtgtggtttatccctgggatgcaaggatggttcaacacatgcaaatcaatcaatgtgatacatcatatcaatggaaatcaaggacaaaaaccatgtgattatttcaattgatgttgaaaaagcctttgatcaacttcaacatctctttgtgctaaaaatactcaaaagctggtatagaagatgcaggtctcaaaatgataaaagccatatatgacagacgcacagttagtatcatactcactgaggaaaaactgaaagcctttcctctatgatctggaatatgaaaaggacacccagtttctccacagttactcaacatagtactggaagtcctagctagagcaatcagacaagaaataaagggcatccaaattgaaaaatgaaaagtcaaattatccatgtttgaagatgatataatcttatatttgaaaaaacctaaagattccatgaaaaaactattagaattgataaacaaattcagtaaatttgtaggatacaaaatctacaaacaaaaatcagtagcatttctatgtaccaacagaaaatctggaaaagaaaattttaaatgtaatagcatttccaatagccaccaataaaattaaatacctagaaattaaccaaaaaagtgaaagatctcagtaatggaaactataaagtataaaacattgatgtaagaaattgaagaggaaacaaaaaaatgaaaaagtattccatgtttatggattggaagaatcaatattgctaaaatgcccatactgcccaaaacaatctacaaactcaatgcaaacccgatcaaaatccaatgacatgattcacagaaatagaaaaaaaaaatctgacaatatatatggaaccacaaaagtcccagaagagccaaaggcaaaataacaaaattgggggaattacattacctgactacaaattatgctacatagctacagtaaccaaaatagcatggtactggcataaaagcagatatttagaccaatggaacagaatagagaacccagaaacaaatccacacagctacagtaaactcatttttgacaaagtttccaagaacatacactgtggagaagacagtctcttcagtaaatggtgctgggaaaactggatatccataggcagaaaaatcaaactggactcctatctctcaccatatacaaaattcaaataaaaatgaattaaagtcttaaatctaaaacctcaaactatttaactactaaaaaagttagagaaattagagaaatacataaaaggatgagtccgtccatggattaaactattaacgggctatcataagaatgagactggtggctttataagaagaggaagagtgacctgagctggcatgctcagctcccttgccatgtgatgccctgtgtcaccttgcagcatcctcatcagccacaagcgctcaccagatgtggcccctttaccttagactttgcaacctccacaactgtaaggaataaatttctgtaaaattacacagtttaaggtattctgtaataggcaacagaaaatcgattaagacagtatttatccaaaagtaataaaatcagaatatcaaggagatgtatgcacttccatgttcattgcagcactatatacagtagccaagatatggaaataacctagacatcctttgtcaggtgacagggtaaagaaaatgtggtatatacttacaattaagtacatttcagccatcaaaacaatggaaattctgtcacatgctacaacatagattaacattgaagagattatgttcagtgaaattaaccaatcacagaaagaaaatactgtatgactacacttatatgaggaatctgaagttgtcgaattgatggaaacagaaagttaaatggtggtttccaggtggttaatgggtatagagtttcagttttttaagaaaaaatgttccagagatttgtttcacaacaatgggaatatacttaacactactaaagtgtacacttgaaaatggctagagttatacattttatgttacctgttttcactcccagtaagaaacctcttgtaaaattacatttgatttccaaaatctaaaaatacaattttcaaagatttatcaaaacagtgtgagagattaccagagcaattcctgttgcaaactttggatcgcatgccattccgtgatatgttgctcccacataagtagaatggttcctataactgaataatgaaatttttcttgtggatatgtgtatttaaaaatagcaataacttactcatattttatgagttggatttctatataaaggtatgctttctccaaaacacagaaattacatataatgtcttatgctttcagtcattaagatttgggtatcccctatagttcatataaagttaagtcctaaaagttgtttaacattatctaatacacagctcaaaacctagcagtgcatgattctttcaaaaaattaatcatcactggaaggatataattaattccatgatataaaagtcaaaagtgtttattgctgtaatttgtatgtagtaaaccaaccccaaaagtgtgaagaaaggtaggactgaaagagatagagaaagataaaatatgcatcagatttacgaagagaaagagaggtagggtgtagaaaccatccttacatatttatatcttaatattgctctgtaatcctagacactctttattccaatacattgataaatatgttccacatattgcttaaggtctttaaaattgtgtttttgatttttgcacatgaaataatcaagttggtaaaataaaagtatataaagacttttgaaagatacaaaacaagtaggtaaatagctacatcttaggtcagtacagaaataccagaaggaaaccacatggagaataaagtggtctattttagttatttattaatatttcatactgtaacaagcattttatgcaattattgcattcaataaattaacttatatttatgtaatgttaaagtgatggtttcaattatttactagtgagaaggtctttacaaacagagaggtatcatgtttttatcacaagactttccatttttcagctcgttacatttctataagtaaacagtctactatgggctaccatgatttaattagtgtcttacatggttattagaatcttaatattttgcagtttgccaacacagtcttcagatagctttttaataattattgttatataaaatttatatataattatgatagctaagataatttgataaaacctttctaaatatgaataaagtacttacattaataagtatgtcatatcatgagacctttgaaacaaaaatttttgtttccaaggcaaaaatcgctgtagtatttcatcagcatgaccacttgttgaaatcttattttgatctgaccagatctccaaggaagacagcataactgtcatattaagctgggaaaacatctgagaacagaaattacgtgttttacaattttgggtaaccataaatatgacactacttctcaatatctaatgataatatatttaatttactatttttgaagataaagtcgttggtggataaaattagtggttgggctacatttacatttttactttttgttaaaatgtaaatgctatatatatgtacataagcacaaataattttacgtcattaattgctatattgcttactaaaatataaaatataaatactcacagtgttgataagaccaaagatttggaaaactttctcaactgcaactgccaccgtggagcccatataagcatactgaaagacaaattttgtttcttaatcgctagtaaaaacaactaactaccacattttaagtggatttaaatataaatgtaaaaataattcagtggtcaattgaagaggcactaaatagaattaagatatatcacagtttaccaagttttacacatcggcctagtattttataaattaatcaatgatattaaaatgaggtaattgtgattatcttcctctttacagataaagaaattcaaagtcaaagtgttaaggtatgaagagtgaataacctactggttagcccggtgtggtggcaggtgcctgtaatccaagtagctagctttaaaaaaaaattaattaattaattaatttaaaattttaatttgcatatagttgttttttattgtctttgtcatttagttactgtttaatctgttgatattttgtgattatatatcaattgtttatcaaaatatcaattttgtgactatatatcaattacatatcagtatatcagttttgtgtttatatatcaataatcacaagatgtcaacagaccaaacactagatggcaaagacaatgaaaaaaacaactatatgcaaattaaaaatgtaaaggacccataaaatataagtacatagaaatattaataatcaaaggatgaaaacacatcatctagcatcaggaaaatactagaaaagaaaaaatatgttatgtgataattatattaactaacataatacattgataagaataaaacttaaaggcaaaaaatggacatgcttatcacaacatattaataaaataattcatcagagagatggagacttttaaatttgcttataactaaaaacatggctgcaaaatatataaaacaagatttaacacaattaaaaatagaaattgactatcatactgagatattttaaataggtctcttaataacacataaattaagaagacaaattaataggaaagatactcaagactttaaaaacccaaagcaatgttggataaaatatacatacatagaagcttatatacaacaatgagaatatgtattttttttcaaatacaaatgaaagttttatgcacattgattcatattaaccaatattaggccatagaacacagctttgaataagaaacagagtgtcacttaaatcacattatctgaacacaatgcaactaagttacagtggacttgataaaaatattttaacaatgttatttttagtgaaatggatacctctgttgtggttatatgagataatagtcttattctaggtaaatacacactaaagaatgtaagagaaaagcttcatgatgagcttcacaacttactttcaaatttaaatgaagagtgcacaagtgataatgggatacaatattaataaatgtgagaaaagagaataagggccctctttgtattattttattcttgtaacttttctaaaagtttcaaattatttccaaaagaaatgtttaaaaagtgcagatgaaataaagacaatttcagatgaaaagaaactgaagagaatccagcaggctaaagagaaatatcatacattaagtaacctactacaaggtatgaaaagctctgcaagtgaaaaatgtatgtgtgtgtgtgtgtgtgtgtgtgtgtgtgtgtgtatatatatatattcatatatatgaatatttatgtatattcatatatatgaaatacacatctatgaatatatgaatatatatgaatatttatgaccatatatgaatatatgaatatttatgaacatatatacatatattcatatatatgaatatttatgaacatatatacatatattcatatatatgaatatatgaacatatattcatatattcatatatatgaacatatattcatatatgaatatatatgaatatttatgaatatatattcatatatatgaacatatattcatatatgaatatatatgaatatttatgaatatatattcatatatatgaaacacttcatttccttaatttctttttaaaataattgaatattgaatttttaaaaatctatttttcagtttataacacatggagaggtaaaatctttaaaaacagattcataatgacttaccagggttaaatgaaattttactgctctgaggctcttacattattaatgaagtggtataacattaattctagatcatgataagtaaagaatactaatcagaatccctagggaaaccgctaaggttggagactggaaagagaggcatagcaaaaaaaaaaaaaaaaaaaaaaaatagagggaaaaataaaggttaaatataaccccttgatccaagggtaggaaagaagaaacaaataagcaaataattgatggtatgtaagaacactaatagtaaagtattatttaaccaacatccatagttatcaattcttttgagaaaaaactaaacattctataattcttcctatttttaagatacagaacttctaccggagatggtaagcaactataaaacataaagtaatcttctgagggataatatttaataacaaagatttccaactgagtaataaaacaactcacttaaaaatagaaatacattgaagaatttcaatcaacaattggagtagatctaaaagtatctgcagctagatatgctacaatagattagagtgtagtggaacccttccatatgaagttatacattattgggaaaattgatatcgatttagaaatcaatatataaatattgatcccccatgtcactgtaaaggcaagtgaaaacatttctttatctcctgctagactgagacacacagtctagaaatcaatataaaaatattgatcccccatgtcactgtaaaggcaagtgaaatcatttatctcctgctagactgagacacaatgcagatatattaaaatatatctgcattgaaaacgttgttttttattcatattctctctgaatttcaacaaaagcaaagatataataaacatactgatattgcataccatggctttatccataatgatttgtattttcagagttcttttcgatagcatggcacctgaatttatctgtgaaatagaggacatgaattaaataacacattttcaaaatttttacattgcagttgtcatgtgcaatacacatgcacacacactcacaggtgagatatggaatatccatccatttagctacccatctatctatatgcagatggatgatagatattcagacacagatacacgaatatagatataagtaataacacaagaggatgatgggtacacccttagcaggtaggattccaaatacaaattttacaagaaaatcagaagcattttattttatgttattgatcattagaattggcaaaaagtcactgaaatgaaaaatcccatatttccttccccttttaacattcctatatactctgtagcacaccactacctcaccaatttttttttttttttttttttttttttttttgagacagagtgtcgttctctcgcccagtctggagtgcagtggcgcgatttcggctcactgcaagctccgcctcccgggttcaagccattctcctgcctcagcctcctgagtagctgggactacaggggcccgccaccacgcccagctaattttttgtatttttagtagagaagggatttcaccgtgttagccaggatggtctcgatccctcaccaatcttcaaggtaaactaacatccgtaaacatttcccctaatgttgccttcattttcttattatttttgtacttttacttctttatgttaactttattggggtttacattcaataaaatgtgtccattttaagtataaacttattagcgagtaatgtatacaccatcacaatttataaattggtatttagaacaattggaagaattacatcaaaatattaagagcactatctttaaacaatgaggtttcacacaatttatacaatttctagtgtattatcttgcccccttttcacttttacattttctatcaaaataacacttttaaataaaaaaacgcatgtgcaaaaaaacttataaagcaatttgattaaattggtaataattttattagtaagatgcaaaatcaatataaaaataactatatgtctataaaaatccctgcaattaaggaaacatgttatgatgctttagaattatgtgtgtttataacgattacattttctaaatatctgaataaacaaatatatgttttaaacgtcctacaactgaactttttaatataaatatcagtttaaatttattctccaaatgtgtcaaatttcaaaatttcactgtgaataactttatcaacagtaagaccaatgaagaactcataaatgagaatactcacgtctgatttgacaagaatcctgtaggactgatctatatattgagccacaggataattttcttgaaaggaggaatgaccaatagcatcatttttaattcgataaactacatgcttatatgtaggtgaagattccaatggttcaataccataactgatattatctaactgcagtaatcctctggatattcaaatacaaaaaaggaataaaaatgttactgataaatttgaatacattttatgctagtgagagtttttttctgaatacattttatgcttgcccacctgggatagagaaaaagagaatagaaaaatagatcaacaaaacaggtaaaaaagaaaagtatttaagaaaataaagtttatattcctctatatttattctacccttcaagaagtttctggaaattaaaggctcacataaaatctcaatgtacatatctggaatacgccattacctgagtccagaacaggtgcgtagtgccacaactgattttggaatgtctgcagcatatccttggtaaaagcaatgaccctaaaaaggaatatagaaagatatattcataaatgatttggaaacaaagtcctagcttttatctttacttcctatatattgtcaagcattcatatttaaccattatcataatagtatttatcaggtattgaatctccatatcaatctacaatctctttctctaagttcttttctgctatgttattagctcgtaaacattttcatcagtaacatacactttttctcaaaatgaggcataatctctattcccacttgctgacactggcaggccaaatctacccctagtagcagttatcagagcccaggtggaccaatcaatcctacccaaacacacatttacagcaatgtgcctgttacactcacaccatcaagactaacaaactcaggcagggaaatccatatcctgctccatgtcaagcaacagcagcagtcacctgcacttgcagtggtgccagcaggacctgaatctataagcccctcacaaagaggtagaaggcaatccaggtcccaacctctctccagcagtagagagtaatccagactcaatagcttctggctgtgcacccagcaggagaaaatgatcttcatgagttacttcccatttctccctactataagtagaaaaagatcattcagataggagctatcttcaaccagggtcactggcagagatagaatcaagcacactgaaatctagtagcagagaaaagacaggagaaatgttctccatcctatggatctttccttacccacctcaaccggaaacactacctggcccagggaagtacgatttacacctctagcttaaacgcttaagaggcagcagaaggtccaatgcagccagaacaatgaaacacaacacaataatattgtaaagaaaaaaatgttattggaacagtggactccaataaaacaaagctcaaactgaatgactgtcttctaaaatagaatattaaaataagatcaagagtcttgactaaatgtcaaggatataatcaaaataattcattataacaaggaccaggaatatcccaacaagaatgagaaaagaaaatcaactgatgacatgataagtcataggatatcaaaaaatatttgaaagaagtaataaaaattgcattaatgaataatgacaaattctcttgaaataaatgaaataacagaaaatcttaggaaataaatagaagccaaaaagggaacaaatgaaaatattataactgaaatatataataaacaaacaagtgaaacactgaataagctctatagtctggagtacagatgacagtggataggatcaccaggtttaaggagaatggatcacatatacccaacctgcaaaatagaggacaagtggctgaaaaatatatgatgtttcaaaaacttgtaaaacaatagcagaagacctataatttatactttaaaaagaaaaaaatggggtttaaataatatttaaaatattagtactgaaattttggtcagccagattgtgaaacaggaatcccgggacgcttcttctcccacaagcataccaattcagcaacattatatggaaaaattacctttgtgagtaatcagaaactaatatagagacatatacgctgggaggatgcaaaactagactcactaaagctcgtagagagacttggatcactctcttgccaggaaacccaaagatatctacacctagacctattttaatcaaacattaaaagatcaaaaacaaagagaattttgtaaactacaaaagaatagcaacttgtcgcatacaaaggaaactccataggactatgagcagactttttttttttttttaaggagaaaccttgctggccacaagagagtgggatgaaatatttttttaaagtgctgaaagaaaaaaaaaagccaaaaagaatgctatacaaatcattatggatttcttataaaatctataagaaactcacttgagacttaagcacacatataggatgaaggtaaagagatggaaaaataaattccatgcaaatggtaagcaaaaggggcagagatttgtatacttatatcaaagaaaatagattttgacacataaatcatcataagagaaaaaatgacattttataataataaaagggtcaatatctgaagaagatagattacttataaatatgtgcacactcaatattagaacatataaataaataaatctgaaggaagaaatagacaccaatactataataataggagactttaataccttattttaaataatgaatagaacatccaaagagaagattaataagaaaacagaagatttgaatattactataaaccaaatagttctaacaaacatataaaggatttcattgaacagcggaagaatatactttcttctaaagtacacttggatcttttccagacagatcacatattaggttaaaaaacaaatctaaaaattttaaaaagattgaaatcataacaagcgtcttttctgaacgcaatagaatgaagctaaaaataaatagtataaggcaaactaaaatattaacaaatattgaaattaacacactattgaataactattggctgaaagaattggctgaagaaattagaaactattggctgaagaaattagaaaataccttgaaataagtgaaagcataaaaataaaagtaaacaaaaaatattaaaacaaacggatgcaggaaaagcaatactacgagaaaagttcgtagcaatgtatgcctacattaaaaaaaaggcatatctcacatatgtttacctgaagaaactagaaaaacaacgataaaactaagtcccaaattagcagagaaaatttaaaaaacaaagattagaacagaaataaaccaaataaaaatagaaaaaccaatatagaaacaaagaagttcattttttgaaacaaaattgacaaacttagctatgctaagaaaatagaaaggatgcgaataaataaaatcagaaataaaacagagacattacaactaatgccacagaaacagaaaaagatcatgtaagagactagtatgaacaattttctgtcagcaaactggataatccaaaagaaattgataaatttctagaaacatacaaacagccaagattgaatcataacgaagtagaaaatttaaaaggactcacaactagaatgaatattagatcagtaatcaaaacctaccaacaaagaaaagagcaggatcagagaactttactgttgaactctatcaaatatttaaagaataattaatgccagaacaaccattcttaaactcttgcaaaaaactgaaagaggaaacacttccaaacttattctatgaggccagacaccacagccacataaatcattacaggaaaagaaaacgacaagccaatatcactgatgcacatagatggaaaaaaatctcaaaaacatctgaactcaacagcgtattaaaagtgtcctacactatgacaaggtgggatttatctccggaatataacagtggttcaacataagaaaatcaattaatgtggtacaccatattatataataaataatacaacttacaggatgaaattaatagatgcagaaaaagcaaatctcagcttcctttataggaccttatacatacattattatgagcctaatacaaaaatcaaacaaagccagtacaaaacaaaacttgcagatcagtatctctcatgaatactgaggagagaaacctcaagataataagtcatgtgtaaaaggaattataattatacatgtcaggacttggttgtaattttttaggtatgcaaaactatttcaagatttaaaaataaatcaattcgatccaacatgccaaaaggccaaaaaagaaaagaaaaacttgtaatcctatcaactgatgcagaaaaagcattttctgtaactaaatagccattaatgaacaaaaagaacaacataaacttttagcaggctagaaatagagaattttctcaacttaatacagagactataaaaaaacctaaagccaaaattattttttcacaatgaaagactgaatatgttttccatgaaattgggaataatcgaagaatgccctcactacggttattcaacatggtcctggacattttagcaaattacagtgaggcaaagcaaagaaatgaaaagcagacttacatactggttgaaaatgaagaaggaaaattgtctatatttgttaaagacgtgtctatgtaggaagtctcaaggcatctattaaaaagcccttctagaactaatatgtgaatttagcaagattgtagaatagtagatgaaacctgaaaaatggattgcatcactagaaaagaacaatatacaggtggaaactaaaattaaaacacaatatcatttacaattgttccaataaaatgaaatacttaggtataaacctaaaaaatgtataggatctgaaagctgaaataacaaaaacactagtgaaagatatacgtaaaagaccaaataaatagagagacttactgtgtttgtggattggaaaagttaacatagtaaagacatcagttctccccaaattgatctacagatttaacacaatttctatcacaatcctagcaagttttttttttttatttgcacatggagtagctttatctaaatcttacatgaaaaagcaaaatatctagaacagaatagcttaaaaagtttaaaaaagaataataaagtgggaaaaaccactgtagttaacaatccagaaatatatccacactagatccatggatttttttttgacaaagtagttaaaagagcgattcaaagcagaaatatagccttttaaaaatatagtgttgtaactaatatacatctagtcaaaagactgaactttgatccaaattccacaccttatacaaaattacctcaaaatagataaagaattaaatgtaaagtataaacttaaaaaaaacccagaaagtcttcagaaactactgctatgtagcgtccgtaggtttgacatgaaaacaaccaatcacaacaagaaattgttgataaattagtcttcatcaaaaataaaactttttgaccagtggcagaccatttgaaaagtaagacaaatcggccgggcttggtggcttacgcctgtaatcccagcactttgggaggctgaggtgggtggaacatgaggtcaggagatcgagaccatcctggctaacacggtgaaaccccatctctactaaaaatacaaaaaattagctgggcgtggtggcgggcgcctgtagtcccaagctactcaggaggctgaggcaggagaatggcggaatggcgtgaacctgggaggtggagcttgcagtgagccgagatcgccccgctgccctccagcctgggcgacagagcaagactccgtatcaaaaaaaaaaaaaaaaagaaaagtaagacaaatcacagacagggccaaaatatttgcaatgcacatgtttgacaaaggtcatattcaaaatatagaaaacttaaaaatcaacagtaatcagcaaccttaaactccaaactctcagatttctgcttggttccacgtctggatgctatggtccagactatctacagtagggggcaaacttaaacatgaaattcacctcctgtgcttacattctctcaggtacaaaattcctaatgggcctattgtcacatatctcaaaacgggtgcctcacgtatttttctttttctgacttctaattgtaatttggtagggagggaaaatcctttaccagttaccataccgtagatttcatcatctctcagttccaatatagcaatagagtgtgaccagtcattgcctttcacttcctcccagtcacgtgaataaatgtcttacagagtaataaataccttacagggtgtaataaatatcttacagggtaaagtgaattttctcacataatttcaaacctttcttgactctttaatgtctttcagcctgtaatcccagcactttaggaggctaaggcaggcagattacttgaacccaggagctcgagaccagcctagggaacatggtgaaacccccactccactaaaaatacaaaaattatctgggtgtggtgttggtacctacagtcccagctacttgggaggctgaggtgggaggatcacccgagtctgggaggcagaggctgcagtgagccaagattgcactggggtgacagaatgagccctcatctcaaaaaaaaaaaaaaaaaaaaaaaaaaaaaaaaaaaaaaagaaaagaaaagaaaaagaaaaagaaaaagcttttctgatataactcaaattctgcggtttcacatgtggacctattaaggtttggtacactgtctactttctcgcattctcactctcaccagttccctggagtctttctgtacggtaatgtctacgattttctccactgcccaggccctctcatatatcaattgaaacttctcagtgtgtcttagctccttcagacaccttttttcccctaaaactcctactaatactttcagacatacaaagtttaaatgtcctttttggagaaatgattcctaagttcccaattttcaaaaaagtagttgttctattcaatatgctttcatagtaattgccacattatatttaattttgtaatctgttttctcaataattatgtgggccataaagcattcatttcctcctcaacaatggcaccttaaccacataaaaaatgtaaatttacttggcagaaaccaaaacttacctttgaaaatgaagaatctgcatacaatgttcctgatttgttgtataaatacaccaggaaatgtgggtgtaaaaatgacctaattcaatcaaaataatgacacttcattgtaattatgtcattaattaaaaaataacttccagaataataaaattaaacaaaatttactttcaatacaaacatctaaaaatgaaatggacttatctctatattaacttgctgctttttgatagcatattgtgaatataagaaagaataataaccagtataatcagaaaaatgtgtggatgctttaatgaatttaaaataatcatctagggccaggtgcagtggctcacacctgttatcccagcactttggaaggccaaacctggaggattgctcgagctcagtagttcaagtccagctggggcaacatatggagacccctcatctctactaaaaataaaaataaaaataaattggtgggtcatggtggcatgtgcctgtagttttagctatttgggaagccaaggtgagaggatggcttgagctcaagaaatctaggctgcagtgagttatgattgcaccactgcactccagcctaggtgactgagtaagaccctgtctcaaaaataaaataaaataaaataaaatataaaataaaataaaataaaataaaataaatgaaatgaaatgaaataaaaaaataaaaaaataaaataaaataaataaataaaataaaatcaaataaaataaaatggccgggtgcagtggctcatgcctgtaatcctagcattttaggagaccgaggcaggcagatcacaaggtctagagattgaggccatcctggccaacatggtgaaaccccgactctactaaaaatacaaaaattatctgggagtggtggtgcgtgcctgtaatcccagctacttgggaggctgaggcaggagaatcacttaaacccaggaggtggatgttgcagtaagccaagatcatgccactgcactccagcttggtgacagagcgagactctgtctcaaaaaaaaataaataaataaaaataaataaataaaatcactgacagacacagatttatgtacagtaataagtaggtctgccagatttcaaaaggggttttcttttagattcaactgtaattttatggctcatataccttagttagtatttgttaacaagtaacaatagattttatatatttacattagttttcatggtgttatactttggtaaaaacaaccccaaaattcttagtgtcataaaacagcaatgagtgtccttcgcaagtttactaaagattcggctccatcctgccttccttctggaacctaggaaaaggcatagcccctccctgaaacagtctcaaaatgacaacctgaaattaatcactaaaatgaatcacagagaagatatacaatgttaaataaatctaatattcagtctcttatttaagctcaatttagggtagtgattgtaaaaatttaagacactaaaaataatgaatgaaaaaaatggtaacttactgtttttcaagcaggaagtgtatggtttcccctcaattttgatggaataagtggcctgtagcaaaatattcagagagaaagtaattggtagagattctaacttcttaaatgttgcagttccttgaaacatatattcattcatatgaatgtaggttatatcctgcatgtatcaaaattggaatgtataacagaattaattgtaatttaaataaacacaaggagtctaaatttcaaaactcagatcattaatcattagcatgtattattatgagatttgaagtcaaaatggggattatgtttagaaatgctgagaaacagttgaaaaaacttgaattttgttatctttgttctattttgcagctctcagcacaaataaattgaaaataaaataatgcagcacaggttcccagttaagaataaaataattattgcccagctgccagaggtactacccacaggcaatcctcatctccttacccactttggctattgccttagctcaaaagagtcatcttatacaaagtcacaactttctgggacagcccacatttaattagaagcccctccatttaatggaggtttcttgtttcagatagatttagtatggtcttccaaaaagattaaatgtggtgatatcttcatgataaattgatatttgtatcaataataaaagtccctttcatttccagaatggtttaaggcaattttatttttttcaactttattgagctacgactgaaaaacaagttttattatttatttaaagtgtatataagatgtgtatgatgttttaacatacatatacattgtgaaatgattaaaacaatcaaattactgtatccatcacctcacatagttaccattttatcatttgtggtgagacatttgagatctattcttagcaaatgttaagtaaacaaaacattattattaactatagtgaccatgatgtgcattagatcttctgaatttattaatcttataactcaaagttataactcaaagttataagattatataagaaattaataaattttaaacatatttgaccaatatcttctcttttcattcacacttccaacccctggtgactaccatctaatttctgttactatatgtttgactttttttaagatactacatataagtgagataatgcagtatttgtctttgtgtgtctggcttatttcacttagcataatgtcctccaggtacaaccaggttgttacaaatgatggatggcaggatttccttctttttacaaactgaatactttctgttgtttgtctatttatcgatcaactgatcgatcatctatcaatctacattttctttatccatatacccagagattaatgccatactcttttgattatgatagatatataatttacttttaatatattgtatatatttaaagtatacaacataagtttttgatagtcttatcttgatatagaaatagataagtgatttttgcaatcaagcaaattaaaatatacatcattctaatatagttactttcttttatattttccttgttgttgttttggtggtaagagtacctaaaatctacttattggcaaattaccagtataaaacatcatattgttaactgcagttcttctcttgcacattagatttcttagatgttttcatcctatataactacaactctgtacctttttacctatattttcacatttgcccctgcactctcctcctcacattgagtccctggtaaccattgtttactccaagcttctatatatgaaaatttttgaaattccacatataggtaagatcaggcagaatttttcattctgtgtctagcttatgtcacatagcataatgtcctttaccttatttcatgttatcacaatggtagagtctacttcttttttaagacagaataacattctatttcatatataaatatatacataccacaatttatccattcagctgtatatggacattttggttattttcatatcttgactgttgtgaataatgttccaatgaacatgagagtgcaaatatctttatgaggtagtgatttcattgtaatataattggaaatgaagaagtgtgatggtgcatcagggttttttactcagaattgttttaactattttgagtcttttgtggtttcatgagaattttagtttagttttttttttgtttctgtgaaaaatgccatcggaatgtcaatgggcattgcatcattgcattgaatctggaggctgctttgggtaatatgcacattttaacaatattaattcttccaatccatgagtaagggatatctttccatttgtttctgtctttttcaatttttcttatcaatttacagcttgcagttttcagcgtacaaatctctcactaccatagttaaatttattgctaaatattttattctttttaatggtattataaatttttttaaaaatttattcctcagctagtttactgttagtatgtggaaatacagctgatctgttttatgttggtttttggatactgcaactttactgaattcatatctttgttctaaccttttcttcatgtagaatgtttaggattttctatgtataagatcatgtcatctgataatagacaatttcacttggaggcattttattttatcttcctgaataacccttctggtgcaacttccacctatggtgaagtccaaagataatgttagtcttatctcgcaaagaggcaagtttctctcatctaattgtaggggaagggctatccaagaaaagtaaggtcagaaggacttcctaagctaggggctttacgtcagggcctgcacgggcacttcctctctcttggcaaagactgtggtatctcacaggacacttaaggtgacttaggtcttccctgcttaagaccagtggctgccatccaagtcccatctgtgtttggagaaggcaatactccatttggctgtagttggcagctcaggcctggcttgggattttccaagtgtccccatcccttggcctcttcactggaagcaccacatctcctgtcacttgcacactccgccattgacagcatgcaacgatttagttttcctgtgcttgtttcctgagagcaaggcattggcagttctcagatttctttgaataaatgtggggtgttatgtaagaaatgaagccacagatacacttattttattttatttatttcttttattgagacaaagtctcactctgttgcccaggctggagtgcaagggtgctaccttgcctcactgcaaccccgcctctggggttcaagcgattttcctacctcaatctcccgagtagctgagattacagatgcatgccaccacacccagctatttttttttttaagcagagatggggtttcatcatgttggccaggctggtctcaaactcctgagctcaagtgatctgcccacattggtctcccaaattgctgggattagaggcatggccactgtgcccggcctgatctctttacctttttcaagctgttctccccacaccttccctttcttgcttcagaacatgctcacaaaggccccctaagcagtgggtactggagatagcagagtgagcaaggcacagccctgctaggtgcagtgtgggtggcagacaaggatattggagattacaataacccagtctcctggtggaaatgcacaggggatggaccgtgggaatgcacaaaaatgtggcctagcccagccttgagagggttttgcagggggggcttcgtgggcccctgggtgaggatgtgaattccggcttccactgggcctacactgagtggccccggccaggaggggtcaaaagacctacaggaagaaaccgaggcacaaaatacaattttaaagactgagttgaagtgaggactgctgtcggggacgcacttccaagttgtctttgggagtggtccacttggccttcgttacaagcagatgaagttcaatgtttaacagtagtggtgagactgggcaccagtgtagttttcatgatattagaggaaaagctttcagcttttccatattgagtatgatgttagatgtaggcctgtcatttatggcctgtattattttgaagtaaattctttctgtacccaattagttgagaatttttatcataaaagaatgctggattttgtctaaagcattttctttatctattgagatgattatatgatttttatcctttattctgttaatgtggcatatttgtactcatttgcatatgtttaacaatccttgaatcccaggaataaatcccagttgatcatgacatacagtccttttattgtgctgttgaatttggtagtattctattgaggatatttgcatctttgaccagggatattggctcacgtttttattttggagtatctcaatccaactttgatattagagtaatattgtaatactggcttcatgaaataagtttggaagtgctccttcctcttccattttttggaaaactctgagaataattgttatttactctttctaaaaaaaagtatttggtagaaatcaccagtgaagtcatctggtcctggacttttctttgtaggagatttttgattattgattcagtcttacttgttactgatctcctcagattttctgtttttcattattcactcttcgtagattgtttctaggatgctgtccattttttccaggttatgcagtttgttggcataaaattgttcatagcatgatgcttttacttggtgatgtcaattgttatgtctcctcctttatttctggtattgcatatttgagccctctgcttttcctaatattgttaaaggtttattaattttatttatatttttaaaaatataactcttagttttgttactctattctatggttattctactcttttcttttttaccctttgttttcttagaccaattggttgtttaagaaggtgttgtttaatttccacttatttcggagtttcctatttttccctgtttctatttgatggaatgttttatagaggtcttttaggtccatttggtctaaagtgcagtttaagtctaaatgttccttattcattttctgctgtatacatctatccatggttgaaactggggtattgaagtcctctgttaatattatttctcatttcaattctgtttaaatttgctttatacatttagggggctctgtgctgggtgcatatacactttaaattgttgtatcttcttgattaactggcccctttatgattacattatgacttttttgccttttgctacggtttttgacttaaattctatttttgtctcataaaagcatagaaactcctttcctctttggattttgatttccatgcaatatccttttctatcccttcactttcggcccctgcgtgttcttaaagcagaagtgtgtctctctcaagcagcatatctttggatacttttaacccattcagccactctatgtcttttgaatggagagtttatagtccatttacatttagagtaattattgacatgaagacttactattgccattttgattattgttctctggctgttttatatgttgttttgtgcattcttcctctcttgctgtgttcctctgtgatttgatgttatcctgcagtggtatctcttgattattttctctttaatttttgtttatttactatagatttttgcttcatggtttaccatgaggcttacataaacatatagttatatcaggttattttaagatactagaaatttaacttcaatcacatacaaaaactatgcaatattacttctacacatacacataattttatgttatctatgtcaaatttttcatctttttatattttgtattcattaacaaactatggtagtgatagttattttaacacttttgacttttaacctttatgttagagttataagtgattcatacaccactaatacagtattatagtattttgaaattgacttatatttacctttaccagtgggtattacactttcatatgtgctccttttataatttatcctcctttcattttagcttaaataactccttttagcatttcttattaggcaagcctagtggtaataaacttcctcaggctttgtttgtacaggatattttttatccctcatttctgaatgagaggtttgtcaggtaaaatattggttaattatatatattttagttatattcctatgcacttttcaagtgcatgtcaaatttctgtatgtaatttatttatcttgtccatcatgtattgtgtaatatccattatcacttatttcttcttcaccctgtgaaatatatagaagtacatctacaaatttctaaatgcatttttgagttccttgttaagttttattctaattgattgttaccatataactagttttatactaccagtatttgatttttaattttctttctttactatcatcaattttgttgactgttctatatattcttcagaagaatatacattacttacagtggcatagagctaaattacagctggattggcaaagctctatctttagatctggggatccctacacatctggatatttcagattcttgtccaaaacaaaggcagtgagtgatatttataatgggctttcagaactcaaaacgtccctggccaaggaagcctcctcagtgtttgcctaattattttgacaagccctgcttgactatttaaagagtcactgaaagatttcagctgacttctccaaaagccaaaatttctcctgtagttcttgttggtagactcagtatgctttaggaacacagagattgtgtttctaaacagggagctcacagtgaatgtttcttggattcatgtgtaataaactgtagagtctagtgagtcctaaaacatatcagaactggagaaaacaatatattcactcactgggttcatgttctatatatatccactggataaaaatatttttgttgttcaaattttctttatctttatgaatttttttatgatttgtcaaccaacatttgaggaaaacattttaagatctcgctatggaaatggatttgaccatttcttcctctagagctatgaattttcactttctaggtgctgaatgcattttattaaatttatacaacttcagaactgttaaatgttcctagtgagctgaatatttcatcattaaaaaacaatgcttatctctcacagtggtgtgtgtgtgtgtgtgtttgtgtgtgttagtggaaatgagaaaattgaacaaagcctagtgacagttcaaaaagatatatatcactattgtttgttaatgagagtcaaatgtaatgcaacttttctggaagatattctgcaatgtttacaaaaagttgtaatggcttgcccattgatctacataaacaactatcaaagaaattttatgaaactatctacgagttgaaaatttgataaatgttacatccatatgacatatcatgaagtcataaaaatgacagagccatattaattaccataaaagtaaatccaatatttataaataaatgaaaaagtcaatcgcagtcatatataatcgttaaaaatatatgtgtgcatgtgcatgtgtgtttaaatattcatttagtataaatttattatttttagagactggtgtggacattcactgtattcagcattctctgtattacctcaatttaattttacaacatacctactttcctgttctaatcagatgaaagatgacattactttcatttacaaaggatttatatatacatgtataggcatgaagatagtctttatatattatcatgttaaaaacatgttgcttggtaaatattagtatgacctcaactatataataacacagatttaaatgtacatattttctaaaagaacccagtagactgaatatggttcctttgtgttataggaatttggggattcttttcctgaatctctgttttaaaacagttatctaacattcatatattgagaaatgaaaaaaatatcaaagtcttgctgtcattcagaccaaatgactccttagcacggtaaattagaacacaaactaaatttcacaaagggatatgtatgaattgattggggccatgtagtccagaaaaaacaaaacaccataattttaaaaggtgatctcttaattacatgcgtttctgaaacatcaccatcattggtgtttgtctggatcttctgtggtactgtaatttgcagaactggtgtttcagaatctgcatgaggaaaagcatatgtgagcattcccagtgtattcatgtcacagtgtcctttcttatcactctttaagcttccatcacacacacacacacacacacacacacacacacacacacacacacacacacacgagtccagttccaggaagacgctcctccaggcgtgggaggtttaccctagctctgcccaaggacacttcagggtttggtgacttcagccctgcgtgggagaagtgtgggctgctgctcccagaccccatccggcatccccacttcccactgcagcctggggtccgacacttgtaagcagttctggggcccccttcccagcctggcctgcgcttctaggccttgccaaaggcgaaagcggaaaggcggcctcctctcctgcagggctctttacttacgtgggcccgcggaggtcagccggcccaggcctgagaggatcagcaagagagacagcattgcgtagccggcggcccagccacagggatggccgttgtccttggaacggctgcagctcgaggccagggtggtggaggccgagcggagcggaagggccgtggggtccgcggggcgcggcggggacccagctccgtggatcccgaggcgggtggatcctacagccccgcgcgcccacccacagtgggctgcaccggaggaggcacgtgggagcctgcatttctgggtacgtgggctcttttttctaaagagttgacatttacaacgcattcaggggtaacatagggttataaagcacatttctactctagaccttttgctgatgaagccttggcaatatgattgttcaacatcatagccttctgggaagacagttgaattactgtagtgaaggaaaacagaaaaaaaaaaaataagaatcatagtatgtttagcagcagccaattgccaattttagtaatatctacttctagttttctgctcttaagactcaggtgaaaacacaaacagatactaaaaactaaaaaatcaatttcttagaaaactgtctaaggagtttaagtaaaatgcgaaatatggatatatggatgtattttattattttagtacgatttataagtatcaggcaaaaaaatcacacctataaaattacttcataaaaacaatcaaaatccatttatttattgacttttccacacttttgtttcttagaaaagctttatggcttagggagacttaatgaaaagccagacatattttcccccatcaatatggagttcacacaaggaatgataatatagttagttggaaataattttattttatctcttactgtataagtaggtggtttgcctaatttcaattttttttcaatttattatttattgtaacatttgtattgtagtaaaatacacaatataaaaattatgatcttaatgctttttaagcctacttttcagtggaattaaatacatccatattgctgggcaaccatcactatcattcacctccaaaactttggatttcaccaatttttacataaactgacttgtttgtgatttcgtgtattgatttgtgtacccaatacaaaaattgacatacatattgacatacagaactatttcatgaccacaaggaacctatatactacggctatagagtatactgacctaccttactcgtaattcctagtcactggcaaacactaatccagtctccacaatccatctccataatattatttttgatactatatataagaagcattatatagtatctcttgaaatttgttttttcactcatatcattcccttgagatacatcaaatttttttcttgtattaataattcattttgttacttctgagtagtatacataatacaaatgttccacaggttatttaaccattcatccatcaaacaatatttgggtagtttccagtttttaaatttgcaaaaaacattgctatgaatgttcatgtacaagtttttatatataaatcaaattatacattagttagactaagtgagaaaacagtagactgaaataaatgaaaattcgaaataaatgaagagacatcccaactgataccacaaaaatagaaacgatcatgagggaatactatgaacatttatatgccaagaggttggataaagaaggagagatagatactttttcacatgcatacaatctattaagattgaatcatgaaaaatagaaaatctgagcaggccaataatgaataagaagattgaattaataataagaagactcccaccaaataaaagtgcaagactttatagctgaatctaccaaacatctggagaattgataccaatccttcaaaactctcctgagaaattgaagaagaggcaattcttccaaactcactttaatagacaaacattattctgaaaccaaacccagacaagggaatcacaaagaatgaaaacaacaggtagaccgtggtggcacacacctggaatcccagcaattagggaggttgagacgggtggatcacctgaggtcaggagttcgagaccagcctggccaacatggtgaaaccctgtctctacgaaaaatacaaaaattagccgggcatggtggtgggcacctgtagtcccagctacttgggaggctggggcaggagaatcacttgaacccaggaggcggaggttgcagtgagccgagatcgtgccactgaactccagcctagatgacagaccaagactccctcttaaaaaagaaaaaaaaaaaaaaaactacaggccactagtcctataaacatggatgcagaaatcctcaacaaaatactagcaaatcaaatttaacagtatattaaaggggtcgtccactgtgatcaagtgggatttattcctaggatacaaggatggttcacaatacacaaatgaatttatataatataccacactaacagaatgaagtacagaaaccctatgattatttcaaaagttgcatacaaagcatttgaggaaatttattcatccttttgtaaaatactctgatcaaattaagtatagaaggaatgtttctttattcaataaaggctatgtatgacaaacacagggctaacatcataatcaatagtgaaaggttgaaagatattttttctctgagattagaaacaagacaaggatatccacactcttcactttgttccaacataatatcatttctggtcacaactaggcaagaaaaatttaaaaatgcattctaatgggaaaggaagaagtgaaatggactctttgtaaatgacatgatatcatatctaaaattatatgttttatggatataatttatatatattaaaacatataaatatgtatatatttaatatataagtatatataaaattatatataatttataattttaaattaatttaaaattaaagactccaccaaaaaactgatagaactaataaaccaattcagtaaagatgcagaatataaaatcagagtataaatatcagtagtgtttgtatgcattaacaaaaaactgtgcaaaaaaaagggatttaaaaattagcctctttattaaaatacttgggaataaatttaaccaaggatgtgagagatctgtgtgctggaaataataaaacattagtgaaagaaattgaagaagatacaaataattggaaagatattccttgtttatggattggaagaattaatatgttaaaatctcaacgataccctaagcagtctacagatcagtgcaacccctatcaaatttacaagaacattttccacagaatggaaaaaacaatgctaaaatttttatatacaacaaaagacctcaaatcatcaaagaaatcttgagccaaaaggacaaagctgaagatatcacactgcttgtttcaaaatatattacagagctatggtaatcaaaccttcatggttctgtcataaaaacagactgattaaaaaatggaacagaatagatcccagaaataatccccacaaaattttggtcaattgatttttgagaaaggtgccaaaaacatatactggggaaattacagtttcctcaataaattcttttgggaaaacttcatatccacatgcagaaaaatgaaattggatccatatctcataacatatacaaaaataaacaaaaattgcattaacgacataatggtaatatctaaaattgtaaactattaggaaaacacaggggaggagctccacaacattggttggggaatagttttttgagaactgcatcaaactaaaaagctttttcacagcaaagagaaacaacacagtgatgacatattttctgattggcagaaaatattagtaagctataaatctgataagcgacgattatccaaaatatgttggaaacaactcaacagcaagaaaacaacctgatttgggcaaagtatctgagtatagacatttctcagaagaagacacacaagtggccaaaaagtatataaaaatatgcacaaaatcaccaatcatccaagaaatgcaaattaaaatcacaatgagctatcacctcagacatgttaaaataggtattatcaaaaagacaaaagataactagtgacaacaaggatgtggataaaataaaacccttgttcattgttggtggaaatgtaatttagtgcagccattatggaaaacattatggaatttctcaaaaatattaaaacatagctaccatataatccagcaattatacttctgggcatatatccaaagaatttaaaatcagtatattaaagagatatctacaccaattttcatttcagcattacttacaatagccaagattcatcaacagatgaatggataaagaaaatgcccagtatttatttctcctattccattgtccacaatggaatacttttcagccttaacaaaatgagaaaattatgtcatttgcaacaacatggaggaagcttgaggacattatgcttagtgaaataggccaggcacagaaagacaaatattgcattatatcacttatatatgaaatctagaaaagtcaaacttagaattagggaacagaatgatggttaccagagtttggaggtaaagaagtggagagattttagtcagagggtacaaagtttcagttagacagatggaatgaggttttgaggtctatcatacagtatgctgaatatagttaataataatgtaattcatatttcaaaaatgctattagagtagattgcaatttttcacaccacaaaaataattatgtgaggtgatgaatatgtaatttatcttaagtattccataatgtatgcatatataaaaacatcatattgtacccataaataaatatatttattttatttaaaaattaattacaaacacccaatctgtaatgtgaaagtcacttttaaggaagtagagaaaaaagtaaattaagaaagcaatgatacaaaaccaatgggaaagaaaatctaatgacatgtgatggttaatttcatgtgtcaattttggtaggccatgttgctcagatatttggtcaaacattattcttggtgtttctatgagagtgctttaaatgtggttcacgctggcggactttgagtaaagtggattgtcctccataatgtgggttggcctcatcccatctgttgaatactggagagaatgaaaagactgaccttcctccaacaggaacttcagcatcaggtccttttgcgttttcagcctgatagcctctggacctcaattgtagcatcaactcttcctctctccatcctgctggccaactctgctgattttgaacacgtcagcctctgtaatcatataagccaattccttatgatagacagctttctatttatataaacctcctattgattctgtttctctggagaaccctgactaatatagtaagaaaaactaacaatggcagttcaagataagtgaaattatcatgaataaagtagcatgaaaactattccaagttattaaagaatagaagtttattgaaataaaggtgccctgaatgagaaaaaaaatttcaagaaactctgataaaaacttatatcactgaggtataatgaaattaatatattggactttgtaattaaataatgaaaaatcctatgggcatcttggccacaaagaaagtcaataatgaggttaggaaaactgactcgtgttgggctttgacaaaatggagtgcttacaagtgagtcaaataatttctatgaacttagtagaggacatacagtatctcaacaatgttttacacagtcaaattcacattgtagtataaa

SEQ ID NO: 330 - DNA, 154459 bp, Homo sapiens
agcccatgaggtgcacttcttgagcaacacaattcaatttatttaattttacctcaatgattgtgaaaatatagtttttcaatattctaaagtcacgactctcatatacctacaaagtaaaaatatttttaaaagaattttctctgcctctcaatgaaggagccagtaggatgataaagcttgattcaaagagtacttgaggaagtgagtgttcacaggtatttttaaaaatgttagagtaggctgggggcagtggctcatgcctgtaatcccagtactttgggaggccgaggcgcgcggatcatgaggtcaggagatcgagaccatcctggctaacacggtgaaaccctgtctctactaaaaaatacaacaaaaattagccaggcgtggtggtgtgcgcctgtagtcccagctactcgggaggctgaggcaggagaatggcatgaacccgggaggcggagcttgcagtgagccgagatctcgccactgcactccagcctgggtgacagagcaagactccgtctcaaaaaaaaaaaaaaaaaaaagttagaatcaaagtacgattgccttttataccagttcgtaaaaggaaacaaattctgaagaaacaagtgttgatactttctcattatacatatgcaaattttcctctataaatactttgaacaattagttttgaattaaatgttgactctgtaagcttgagtgacagtagatattgtatttgtcttctcatgcatcacctggaaaatttgtgtgagactttttacagatagcaaatacttgaaaacttaagaaaaagttggcgaaaaacaattttgagaagataaatgttatataagctgggccttcaggacctttgaaagctaggaaaatttttatttactttgcataggataatgacaatagccataagagactggggcatgtgttgaagaaagaagagttttcagagatgatgattagatgcttcttagcaaaagtaaatttgtagaaagggaagcccagaagcagatcagaaatatgtaattatggaagttatttttaagttttttgcaacatgaaatttgaaataaatatgaaataaactttctcctgcgtgttcttagaatatcttcatcatttgtgtgattaaatttcttgtgcataaaaaaatgggtaatgcttataagagaagctagaaactcaaagataagcagacatccataaaggaaagaaaggcaaagtggagctagggatataaaaattacttgtaatccattttggctctgctcagttgggcagtttctggtttctccatattaatcttaaagaagaaatcagcagccatttataaaatgataaatcctcatcataaacattttaaaaatgttgcaggctttaaaaggagatattttaagaatcctgtgtgatgcttaaatagttaacaagaagatttaattttctaattgctattagaaacttagggaaaaaaatggaccagcatatagagcctacacagaaataaaacttaaatagcattgatatttaaagttttatgtttctctttcctcctagttcaaaccggctaatatgatttgtaggaaatcagttggtaaagaatgcgatttcactgaatattgcaatggggaccttccatactgtttgcctgacacttatgtacgtgatggagaatattgtgattcaggtggagccttctgttttcaaggaaagtgtcggacttttgacaaacaatgtgatgatttaattggaagaggtaataatcataattttcttcttagtccctaaattctgattattccaaactctgttattgaattttatggaacaaaaatgtaaatgtatgtgttaatgactgaattcttgcataatgtatattagtgttaaagaaaaaacaaaattatcttttctttttcttttttgagacggagtttctctctgtcgcccaggctggagtgcagtggcctgatctcagctcactgtaacctccgcctctttggtccaagcgatcctcctgggttcaagcgatcctcctgccgcagcctacggagtagctgggataacaggagcacactgtcatgggtggttaagtttgtgtttttagtagagacagtgtttcaccatgttggccaggcttgtctcaaactcctagcttcaagtgatctgcccacatcgtgctcccaaagtgctgggattacaggcacgagccactgcgcctggcgcaaaaacaaaattttcatgattgtgaaatacaacaacaaaaaacctctctgaatttatatggaatttctgtaggaacagaaaataaacctcaagtgaaaatgcagtttttcaaaatattatatagaatttgtggtgggggtttagtttaaaggaaacaaggtttcttaatcagaggaaagcagggctaatcactgattagttgggtttctaagcgcttgctgaaaagtgagggcttcagttcattagcaatctagtccattttgataatttcctataaatgtcatttgcttgattggaagatacaaattcctgaacgtatgcagtgcatgttctccgagagagtgaaatttttcattcttagccctcccttgaggtcttctctaaccaggtcatagatctctaaatattgtctacagcaatgtgactgccaggaatttaaggagaaggtgagatgggggttttgatgattttcataattttgtcctgcttttctaacagaatcattatttgtaccatatggcaagacaatagctatagactttaaaacattgttaacatacaaacaaagagctggggccagtagctcatgcctgtaatcccagcactttgggaggccaaggcgggcggatcacaaggtcaggagttcaagaccagcctggccaacatggtgaagccctgtctctactaaaaatacaaaaattagccgggtgtgcttgggatgaggcgggataatcgcttgaatccaggaggccgaggttgcagtgagctgagatcacgccactgcactccagcctgggcgacagagcaagacaccgtcttggaaaacaaaaacaataacaaaatcattcaaacgaatgaccagtaaaattaggaggaatgggacagtacttcagatctatgatctaatgtttctttaagtaaagccaggactcaatgctaggcagataaaattagagccacatagtggattgccaatcaggtgtcttccgggttatgccattcactgtgtatttagtattatcagtgattttaagagattttaaagtcctttgtgagaactgtgggagtacacgggtatttgccccaaagagtacagttttttttttttggaaggcaagcatgacttctaaagcaccttgatttcaaaataatgtatgtccacttctagtgaccatgtgttcatgcatctaggacgtgataattctggacttgactaccagtttttgtacttatttttgaaaaacaatctcactttgctagccccctgagggcaatagaagcctgatgaaaatttaccctcaatggtagctgtatttcaacgcatattaaatccagttctttgtacaataacatgctatacgggtttgcagcctaggagcaataggctacaccatatagcctaggtgtgtagcaggctataccatctaggtttgtttaactacactgtatgatgttcacacaacaatggatacattgctcagaacatatcctcatcattaagcaactgatgactgtactcagtaaatataaggtattattattattattagattatgatgtgtgttccctacaaatatccaattatttgagtaggtcatctatgacctgtcatggttggctcaaatgatccttgagcagggtttgatataattctgaagtaggcattagttttgcttggtaaaacctatatgctatttgtaggaaacagacaataagaattcttataccacaggcctaatacaaatcatcatgcccccccaaattgttgatttctggacaaaatatactaatgaagttgtcacattgaaagacatagcttatttatcaagcaatggcatttaaaatagggaaatctgtagatctatggtaaaagaacgaggttaagtattaagctttttttttttcaaaaaaatcaaaccagtgaaggaaaaacacctcaaatggttaccacctttttctaagctctttactaaattttgtttttggaaatgtctggcccctacagcatgctcctcttcagtgttatctctgcaaatgcagaaacttcctattgtaggtataatataaaatgatgttattacctttggtgttatttggtttgtggttatgtttgccctaataaggctgaaagtctcatgagttgtaaagttccatatattattagagggctttatgaccaagttgagttgtatatcatctagacaaatgttaagtgctaatccaaccgttatacaagggtttctcaacctcagcactagtgataatgtaggccagctcatactttattgtgagaagtgggggcagggaatgcttctcctgtgcattgtaggatatttggcagcgtccttggcctctgcccactagacaggatgcctggagagacttttggttgtcccagcttggatggggtgaatcttggcttctagtgagtacaggtcaggggtgctgctaaatgctttgtaatacacaggatagcctctacaacaaagaattatatctgctgtgctgtgttgagacctccttctctagagagggccagaagtttgactacttaagctgattaagactctgaaaaaggattatattccacactaaagtatgaacagtctttgcaaaactaacctggtaatgtttctttttcaatttttaagatatgatttatcaaaaaccatattggatcaatattcttatgaaagtggcacaaaggttggctctgggcgtagatattttccaaaccatagaagcatacttaccagggacgtgtaaaagatttgctggattattgaatagttgtgtgagaaggagaaataaacaatatttcatgattatttaatcaactaataaaatatgttcagggttttcagcatctatattcaggcttatttagtatatagcactataaaatttaaatgtaatccttatacaaggtctgaggatgcttcaactaatttatctaaagctacaattgctctggatttaagaaacagactacaaacaggtgatggagctttgatgagcactgggcagttaggtaaatattcctataatgtgacttgacctttaatgaacacatagacactaacatttatgataatctggaaaacacagtaaagatgtgaaggctgctttggggtcctgaaggcatcttttacctctcagttcactgaaagatattctgaaatgtttgaaaaagtaaaatcatgtatggaacttagtattccataaaattaggaaccaattgtatatttagccatttaatcctggacatccttaaatttataaatgtctttcagaagtttcttttggataattatgaatagtcaacaatcttttgactatttcagacaaagttcttcctttggctgacaaattatggctaggtgataaaataggatagggaagcttttccttaaaaattttatacttccttttagccaatggaatagataaatatatagagatagcttgaaaactccaaataagtacagataggagatcgcctactttgggcaaaggtagatctggaaggaaactttatattttgagatgctgatttaaaccatgagaaaagtaaggtggatactcagaaaagccttaatgtattattgtcgaagtattattgttctgtagcaccttgtacatgtatggattgtgctccttaactgagtgaaatttacagatcatgttctccaagtatgaaagtctgtgaaattattgaagatagctctcttgtcaattaatagtggtaacaacaaatgatctctattttgattacatatgactaacatgatcaacgtaaactacgtctaaactactaagtcaaagtaataggacagttattatagatgtttgaatttttcagaattttaaaattagacataactaaatatataaaggactgaagtagatgaacattgatattctaattttaaaattcaacaatttttatttagtgattattaggatctaataattattaagatctaataatctaataatagattatgactctagtgtggagcaaggagagttaaatgaagtgttctttgtgtttgtcatcattattgcactaaagatactatttttctactgtttcatttagaataagagtaaacagcattttcacaacgggtagggaagtaaggcaggaagtaaataatttataggaaatagagagggcgacagttgcttatttgtctaacaatacagaagcattctaataatgttgttgtttgttttctgtttctgcagaagaaagtcttctaggcttataaaaaggagtttgttttttaatcctagctctgcccccagaaactttttagtcctgggtaattataaactttcttatggatcacattgtaatttccagattgagtctttcatttctttaatataacttaaattctgtattgtaatttacttaagtttttgttgttgttcataggttcaagaggtgctccggttttctgttatgatgaaattaataccagaggagacaattttggaaactgtggcactgcacactgtctttttcagtatgtatttagaaaattataaaactgtttggaatgtaggttagagattgttaaaatcctaggaaatatattatatgcagtaaaatcgaatgttgggggtcaggttttctttattacatcatctgagctggacaatattatccactgcctacaagaacatttgttcagcgcctataatgttaaaacaacaatgaccataaaaatgtcctctgtttattgttgtgatgagctagacattgttatgcagcttatatatattatatatttataatataggttatattattcaatttatgtacatcaaatgtgtataagaattacttatcccatttactattgaaaaaactgaagaccagagatcattttctcaaatttcagcagctattgtggaacagatcacagctgtcatagtgtaaaaaccattagtttttcacttgccagattgcctcatgaaacaaaaaagaatcataacataagtcattgtgcaaaaaaatatgtactgagagaaaatagttgaaatttggatttaaattagtaaatcactttttaaaaatttcactgtatcagcaacctatgttatctcaataaacaataaggtaatttttttcttccttgtgcttctagacatattctatgtggaaaattagtctgtacatgggaacacagagacttaatatcacgtccaaatttatctgtgatttatgcacatgtacgagaccaaacatgtgtgtctacatacctacccaggaggacgccacctccagtaaattcacctatttcaatcacatcatattattcagctgaagacagagatgaaacatttgtacaagatggttccatgtgtggtcctgatatggtaattagaactacacaaattaaagtgttttaaaatgatttttctggttatactcattttgacaatgtactaaccaatgcattttcttccattttttcttgtggtaaaatgcacgtaatataaaaattgccattttaacctttttaagtgtacaattcagtggtattatatacattcataatgctgtaaaaccatcaccaccctctatcttcataaatcttttcattttgtaaaactgaaactcatttcattaaacaataactccccattcctacctcctctgatcccctgaaaaaccaccattctactttctgactctataaatttgactattataggtatctcacataagaggaataatatagtatttttctttctgactggcttatttcacttagcataaggccctcaagtttcagctatactgtagtatgtcagaatttccttcatttttaaagctgactactattctgttgtatgtacgttctgcattttgtttatctattcatctgttgatgaacatttggaatcattccatgttttagctattataaacaatgccactataatcatggcagtataaatatgtcttcaaaactgtgctttcaatttctgggggtatatacctggaagtagaattgctggatcacatggtagttctatttttaaatttttgaggaactgctccactgtcttccatggtggctataccattttacatttctactagccatgcataatgattccagtttctccacatcctcaccaacacttactttccgtttttttttttttcgatagtagccatcctaatgggtgtgaagtggtatctcactgtaattttgatttgcatttccctaatgatctgtgattttgagcatcttttcatgtgcttattgaccatttgtatatgttctttagggaaatgtctatttaaatgctattcccgtttttaaatcatcttttttgttgttgagttttaggaattctctatatattttggatattactctcttatgatatgattttaaaatattttctttcattctttgagttgcctttttactctgttgatagtgtcttttaatgcacaatttaaaaacaactacgaaatccaattagtctattttttcttttgttgcatgtacttttggtgtcatatccaataaatgactggccaaatcaatattatgaagcttttgccctatattttattctaagagtattatagttttaagctcttatgtttacctatagaatccatttcaagttcatcttggtatgtggtgttaggtaaaggttcagttttattcttttgtgtgtggacatctagtttctccagcaccatttgttgaaaagactgtcctctctccattgaatggtctcagcacccttgtaaaaattcagtagtatctcttaaccatatatgcaagcatttgtttatgggctatttatgctattccattggtaatatattagtctttatgccagtaccacactgttttctttcctgtagcttcctagtaagttttgaaattgggaaatgtgactcttttagctttgttctttttcaagattgtttttggggttctttgagattctatatgaattttagtataaatttttccatttctgcaaaaaaatcattgggatttttatagtaattgtattgaatctgtagatcactttgaatagtatggacatcctaaactgctttgttaaattaattcttaagtactttaagtactttttgatgctatcataaatggaaatgtgttcataatatccctttcagagtgttcattgttactgtatagaaatgaaaccagtttttatatgttgattttgtattttgccactttgctgaatacattgttaattctaactgtttggggtaatccttagagttttctacttataaaattatgtcctctggaagcagaaaagttttaattgttcctttccaatttggatgccttttatttctttttcttggctaacatctctggctagaacttccagtacaatgttgaagagaagtggtgaaaggaagtatccttgccctgttcctgatcttagcggagaagctttgaagtcttatcattaagtataatgtcagttgtgggatttttatatatggatttttatcatgttgaggtagtttccttctacctcatgactgagtgtactttgaatgtttgtgtcatgaaaggtgttgaattttgttaaatgccttttctttatcaattaagatgatcattttgtttttctccttcattctattaatgtggtcattacatcgatcagctatcatacattgaaccatccttgcattccagaaatctcaattggtcatagtgtatactcctaatatagtgcagtttgccagcattttactgaggattctgcatctatgttcataatggttattggtctgtattttttctttgtagtatatttgtctggctttgatatcaggataatgttggccttataaaatgagttagaagatatttcctcttcttcatgtttttggaaaaatttgagaagaactggtgttaattcttctttacatatttgaaggcattatgtccagaaattttcttcataggaaggcttatgattattaattaattaattaaattattaattaaatctccttatgagttaggagtctgttcaggtttttaagttcttcatagtgttgataggttttgtttctaggaatttgtcagttttatcaagctaatccagttcattggtaaacaattgatcttggtattcttataatcctttctatttctgtagaattggtagtaatgttctcacttttattcctgactttagtaatttgagttttctgtctttattagtacatctagataaaggtttgtcaattttgttcatcttttcaaagaaccaatttttggtttccttaagtttattgttttactctgtattttatctccactttaatctttatttccttccttctgctagaatttagtttatttatttatttatttttctatttccttaagttgtaaagttaggttgttgattttaaatttctcttcttttttattgtaagcatttatactaataaatcttccccctagtacttctttcactgcattccataagttttgggatattgtgtttatatttctatttgtttgtaagtattttctaatttccttagtgattccttctttgatccactggttccttaagagtgttttgtttaatttctatagctttgtggagtttacagttttatttagattatttttccaaatttttaatttacttttttattagaaattattattctaaattttttgatacattaaacaatttatttttaaatttttatatattcatggaggtacatgtgcagttattggtgaagttttgacatccagtgtgcctgtcacctgaataatgaacattgtctccagttatttttcaactctaaccctctgattcttcctcacttttggggttgctggtgcctattatttccatctttatgtccatatgtacctattttttagcttccacttacaggtgagaacacatggtatttgattttcagtttctgagttagttcatatatgataatgatgtctacctttatccatgttgctgtactgcatgggacatgatttaattatttttattgctatgtcataattcatgtattatatatccttatatgtctagatatataattcatttattatatatcataatatataataaatgtatatatcatatattaatatcatatatttatatatatatttatatattatatatttatttatataatatattatataacatattatatatttatataatatatattaatatataaatatatatttatatattaaattaatttatatatatttattatattataataatatataatatattatataatatattaaataatatataatatattatctaatatattagataatatataatatattatctaatatattataatatattagataatatattatctaatatataatataatatatattatataatatattatatagtatacaatatattatataatatattgtatactatatattatattatattaatatatataaattatatattaatataatataatatatagtatacaatataatatataatacattatattaattcatacataataaatgaattatataattcatatataataaattcatatataaataatatataataaattaattatatacctagatatgtagatatataatacatgaattactacacagtaatgtatataatataaatacataaataatgtataacataaattcatttaattattgtatatgataaatgcatatattatatattgtataattaatgtaatttattatatataatgaattcttatatataataaatgaattatatatctagatatataaagatatttataaaagatatttatatataaaagataaagatatatatctagatatataaatatctttatatatctagataaataattcatttattatgtattatatatttatataattaattatatattatatataataaatgaattatatatctgttacctttatacctgaattatatatatgtgttaccttttctccacatgaattatgtatatgtgttaccttttcttcacatatatataattatctataagtgttaccttttatccacatcctcaccaacatctgttgtttttagactttttaagaatagccattctgaggcatggcgcggtggctcacgcctgtaatcccagcactttgggaggctgaggagggtggatcacgaggtcaggagatcgagaccatcctggtaaacactgtgaaaccccgtctctactaaaaatacaaaaataatagccgggcctggtggcaggcacctgtagtcccagctactcgggaggctgaggcaggggaatggtgtgaacccgggaggtggagcttgcagtgagcagagattgtgctactgagctccagcctgggcaacagagtgagactctctctaaaaaaataaaaaataaaaaatagccattctgactggtgtgagatggggcatcatcataattttaaattacatttctctgatctttggtgatgctcagcattttatcgtatgtttgctagccactcgtatatcttcttttgagagatgtctgttcatgttctttgcccactcgttactgggattatttgtttttcagttgagttgttgcattcctggtggattctggatatcagttctttgttggatgcatagtttgcaaatattttctcccattctgtaggttgtctgtttactctgttgttatttttttgctatgtagacacttttttagtttaattaaatcctatctatctattttttttgttgttgcatttgcttttggagttttagtcctaagttctatttggggttttaatcctaagtttttgtccagaagagttgtttcctagactttcttcaggaattgttatagtttcaggttttaggtttaagttttgaatgcatcttcggttaatttttgtgtattgtgaaaggtaggggtccagttttattcttctgcatttggctaaccagctatcccagaaccatttattagatagagagtcctttccccatttcttattgaattttgggtgtggctcttttatcctgcaactgtcctgtgttaaattagttgtaggagtttgattgtggacttcttgggatttttttatgtagaaaataatttggaaatagagaccattttattttttccttttcaatctgtatatgttttatttctttttcttgctttactgcagtggttagaacttacagtatgatgttgaataagagtgttgagagaggatgtctctgactttttcctaatctaagaggaatgtattaagtctttcatcattaagtatgttagatgtagggttttttcttttttgcagatgccccttaagttgagctaaccgtcttctactgctaatttattgcaggtttttattatacttgtgtcttgaattttgtcaaatgctttttgtgtgtcgattgatgtggtcacatgagttttcttctttagttcattgaatgttggattacattaatcaatttttaaatgtagaaacagcattacatacttggtattaatatcacttggtcattgtgtataaattttttatacattgttgcatttagtttgctaatattttgttgaataatctttgtaaccaaattcatgaggggtattggtctgtagttttttttttgttgcaatgtatctatctgattttggtcattttatatggcattataaaattaattgaaaactgtttttcactcttctatttttggaaagagattatgtaaaatgtatgttaatttttttctttaaatgttgatagaattctctagtgaaatcatttgggcctggaaatttcattttttaggaggttttaaactatgaattcaatttcttcaattgttgtattggtcttcagattataagctgtttcttggtgatttttggttgctcatagtttcccagaaattggtcaatttcctcaaagtttctgaatttataaatataaagttgttcatagtatttctttataattctgtgtaatggctgcaggatctgcaatgatatcctctatctcatttctgatattggtgatttctgtcttctttttttaacttctcagtcttgctaaagttattaatttcataaaaaattttcaaagcatctgctttttgtttcgttggttttctcagtctagctaaaaatttattaatttcataaaaaatttattaatttcataaaaaatttttaaagactccactctttgttataatggttttctttattattttccagcttttaatttcatatagaactagcaatcaatttcattgatttctgcttttattatcgtttactttcttttgctttgagtttaatttcttcttcctttcctccagtttcttgaagtggtaacttcaatgattgctttgaggctttttctcatttatagcatttggtcttataaatctccctctcagaactgttttagctgcatcctacatattttaatgtatatttttgttttcctttgattctatgtatttttttttagtttctttgagggctatttgatacatgaattgtttataaatgtattgtttaatttcaacatatttagaaattttcctgttgtatttcttttattgatttcaggtttgattttattattatcagagaacatgttctcataattttaatttttaaaaacttgttgaggttttctttatggtaaggagtatgatatatcttgctgcatattccataggcacttgtagaaatgtatattctgttgatacgggttgtagtgacctgtatatgcatcagttaaatcctgttttgtccagattcctgtatatctgctgactttctgtataatttctgtaaattgctgagacaaaggtgtcaaaatatccaactgcaattgtggctttgtctattttcctttcagtgctattactttttgccttatgtttggaggctttgtggtttgggatgtagacatttaggagaactgtgtattattgttggaatgattatcatatcatgacataatgtcttcatttgtctctagtaattttctttgctctgaagtctactgtatcagatataaatatagctactcctgcttttatggataaatgtttgaatgatatattttttctgtcctttttatttaaatctatctctgccattgaattcgaggtgagtttttaaaagcatcacagagttgagtcatgccttcaatacagtgtggcatgtcttttggttggtataatgttattgcctaagtatgttatttcattatttgtttcctctggttcccattcttatttttctcttttcttgcctttcaatgggtgatttaaacattgttttaggatgctatcttgatccagttatagtgtttctaagttagccatgtctttctgtagttttcatagtggctgctcaaggttttatgatatatgtatgtggcctaaagaggctactgctataaacattttgccactttgagtgaaatgagaaaacaacctcattcccattttagttgtgtttaccttccctacatttaagtatcattggtggtgttataatttttgtttcaatcattaactataattttaaaaacctataaagaaatggatagtccattttatttactcatcttcctttccctgtttttttcttcctttgtggtgttccaagatttttgataaacatttctttgctatttcaagtttactgatttaagctcagtcacttggctttttttaaaatttaggttattgtattttttcattctataattcccatttggtttatttttatatcacctgttcctttgctaagatttttgtatttttttatttgtttcaagaagatttgtaattgattattgatttttttataatagctgctttacaatccttgtcatgtaatcccatcatctgaatcatcttggttctgatatcagctggttgtcttttatcattcaagttgtgattttcttagctcttggaatgacttagttgcatccagaaattgtatttattatgttaggagactctgtgtcaaatataaagcactgttttagcaggaagtgatcttgtttaggtcttggccttcttttgtgggctgttccaaaggcagttcaatgttcagagcctttacaatattatttggttggcttggtttacctattgccactggggctctccatggtctttgctggtgcctcctggaaggataggagattcatcaggccagccaactgcatgtctctctgtaggggagaggtgtggtggagttctccatcaggtcccgtttctcactcccacagttttccttatgtctctggatagagaatggggtctcagacctgcacattcaaacaagcctcctgtgctaatatatttgttatgtttccatctctcctttttgttctacccattcacctggtaatgtctttacatggtatgaattttcactcaaatgattaaataatctttaggtggaccttaggtgggcctcttaaagaatgtttaaatagaatattgaaaagttaggtaattctccattttccctatttatttaaaagttcagcagtatatgttattaatcatcttcacacctcttttaagagtaatataacattttagtaatttttatacacacattttttgatgttctgacatataatctaataattttgcatacattattagtgagtaaatctttagacaagagctgaagatctcaaatgaataatagttttggttgagtaagatattatgtgagcaagaatttttctttattagcatggtttttgcgataacatttcttgaattgtatttattgtttcaatagaaaagccaaatgtatgttggtttttactttttataatggactctgattttttcctgattggtagatgaatactttacttaaactgactattattatactattatgttctactataatataatgcacattattgttattatttatttaacataccaaaatatgaaaacaacattaacaattaatatagcacaaaataattatgcaatattattggagacatgtaatattctataaattaagtatatatttaatacaattttaatattctaattgatttaagtcaaaaagatactatgtgaagttaaattaacatactgtttttgagagaaagcttctgagtagacttgctaaatacaaatttatttctatttagtaacattttgataataaatagcacataaaaaggaaacagagtccctgttacttcttgctcattttgaaacatatggaatacaaatatgatctgaagcctcccttacccttgaaatctaaatgatattagctcaaacctccattacagagtcctgactctcctgtttctgcatatagtcattattatgacccaaagacaaaactcactccaggtataaaactctttcacaacgtggtgaatttagtgacagttttttgataattaaagaagatcacataaatgtatgtcataaattagaaaaatttaatttcatccatgaaacttttctttcttagaaggccttttatccagctcaccaagggagtttcccattgtcctgttacctcatataattacctgttgtcctttcttccctctttctttttattttatcatatggaatagtaaactatcttcccttgctgctcatactcatgattttaagatctcacttctctgctcaatagttctcaaacctggctgctcctgagaaacaactggatcctctccccagagtttttgatataatgctctcaaggggagcccacacatgggtatattttaaaatgttcttcagataattcttgaactcaaaggactaatcaagttatttttcccagtagtttatctaagttgacttctggtactaaatggaaagaaaataacacctctggcttcttacatatgattacatctttacaaactgaaagtacatagtttatttcatgtttacttcagtgtagtcacaatttttttttccactggacactcacagctttttaatgcaagtttttgataatatgaattctaatattttcttgaatttttgaatgtgttagccaggcacaaaatctgattttttgactgattttattttgtactttttggctttgtttttagtattgtttcgaaatgcattgtaaacatgttagattcctgatgaatttaaaattgtgtgatgcttctaatcattgtgatcgtcatggagtaagtaactgcaatgtttattttaaacaacttgcttttaacaatcaaacaatttgaggattttaaaaaaataaatgactttttttgtttgccatttttatgtcatttggtgtcatttaatagtctataatttataacctcaattttgtcttcttaagaaacttatcaaactatttattaaagaagacaaagagaaaacatttaagatgattctggatatattaaatgtttgatggatatgtgaggaggatgtgctataagcaatagaagatagaaactggtaaataaagaccattagaattttcttgctagtgctgcaagttaatttagagtctgggctgtcagctagcaagtaggttataattagtgacaggttactggtaatttgaggtatttgggcctggctatggggggagttaaaagaattttttagaaaaaaatttgatttgacaacacaagatagatgtactttgtgtagtatgaacattagcaagggaaaatttgacaaatttatctatttagataaattctctagaatgagatactctgtggaataagtatagattattcattagtctccatcgaaattattcttttttttattatttaaggtttgcaacaattttaaccattgccattgtgaaaagggatataatcctccttactgccaaccaaagcaaggagcatttggaagtattgatgatggacacttagtaccaccaactggttagtgttcttaaaattgtattaattatgcacagtatgtaagatagtaaattataggtttcaagccagattacaaagcaactaatgtcaacatgcttttttttatttataagatttaaaaaatgttgacagtgcaagtttatactgttctttctatatcagcattgacattctttactgagaaaaagtatggccaatgttaggcagttttaaaagtagaaattttggtgtgtaaaatttgaccagttaatttaaactgttcactttggattatctcctatatttatatttactattatatttatatttactatatttattataaactcctataaactagagtttataatagtgtcagtatagtcattattatattaatgcccctagaatctttcaggctgtcttttcttcctattcacttataattggttatttttctcctgcattgtaagggctccatgctaatctttggagatttgctctttctaatcctgtcctgatgttcctgagtagtattttgagattaatcaggcctagatgaattgggctcaactggtggtgaagggcataccctggttctagaaggtatgagcctacccaaaataactgggagcatagatgggctgcgaactctacccccatctctctcttttttgtgtgtgtgagacggagtttcgctcttgtcccccaggctggagtgcaatggcacgatctctgctcactgcaacctccgcctcctgggttcaagtgattctccagcctcagcctcccaaatagctgggattacaggtgcccaccaccacgcccagcttatttttgtattttcagtagagacgggtttcaccatgttggccaggcctctacccccatctcttttaggaccttgcaagaaagtcctgaaactttggggcagacttatctgtagcttgggtgctatataaacacatacctaggttgatcaactttttaaagagacaatacaaagccacatcaaactatgtatcagacaaaaaaaccccataataatttagcctataacctgtaactatacgcatatattattattttcacatgataacatgaaaaatacatgtttatttgaattatgtattttcagtaaacagtagtttacaatgagaaacagaaagtcctataatatagcaatttaactctttaaaaatcctttactagttcatatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagaccaatggaacaaaacagagccctcaaaaataatgccgcatatctacaaccatctgatctttgacaaacctgacaaaaacaagaaatggggaaacgattccctgtttaataaatggtgctgggaaaactggctagccatatgtagaaagctgaaactggatcccttccttacaccttatacaaaaattaattcaagatggattaaagacttaaatgttagacctaaaaccataaaaatgctagaggaaaacctaggcaataccattcaggacataggcatgggcaaggacttcatgtctaaaacaccaaaagcaatggcaacaaaagccaaaattgacaaatggatctaattaaattaaagagcttctgcacagcaaaagaaactaccatcagagtgaacaggcaacctacagaatgggagaaaatttttgcaatctcctcatctgacaaagggctaatattcaaaatctacaatgaactccaacgaatttacaagaagaaaacaaacaaccccatcaaaaagtgggcgaaggatatgaacggacacttcttaaaagaagacatttatgcagccaaaagacacatgaaaaactgctcatcatcactggccatcagagaaatgcaaatcaaaaccactatgagatatcatctcacaccagttagaatggcaatcattaaaaagtcaggaaataacaggtgctggagaggatgtggagaaataggaacacttttacactgttggtaggactgtaaactagttcaaccattgtggaagtcagtgtggcgattcctcagggatctagaactagaaataccatttgacccagcaatcccattactgggtatatacccaaaggattataaatcatgctgctataaagaaacatgcacatatatgtttattgtggcactattcacagtagcaaagacttggaaccaagccaaatgtccaacaatgatagactggattaagaaaatgtggcacatatacaccatggactactatgcagccataaaaaatgatgagttcatgtcctttgcagggacatggatgaagctggaaaccatcattctcagcaaactatcgcaaggacaaaaaaccaaacaccacatattctcactcataggtgggaattgaacaatgagaacacatggacacaggaaggggaacatcacacaccggggcctgttgtggggtggagggagaggggagggagagcatttggagatatacctaatgttaaatgacgagttaatgtgtgcagcacaccaacatggcacatgtatacatatgtaactaacttgcatgttgtgcacatgtaccctaaaacttaaagtataatttaaaaaaataataaataaaaaaataaaaatcctttactgggcatttaaatttttatttttatttttatttaaatttctatttttatttaaaattttcagcctatattatataccctgaaggtacataaatgtaagactttcaaagaaagaacataaatcagctaattgcttcaacttgggaggtggaggttgcagtgagctgagggcatgacactgcactccagactaggtgacagagtgagactctgactcaataataataataataataataataataataataataaatacagtcatttagcctccttatctgtgatatcttggtcatgctggtgttcgtattataattgttctattttcgttatccaagttcttagaaaacacaattacaatattctcaatttgaaaaattatatgtgtgctatcttgatgcaaagcacaacagtgattttgtagtgtacgtcaaagatggactgttaacactgatgcttttgatacctttaaattgcacatttaagttacattaatcagagtgaacacacaaattgtggttgccaacgtcagcagtaatggaaagaaaaagaaaaaaaagcagcaatagcaactatagaagatggataatcggtgatttagtcatttgacactaaaacagtgttgcttttagtccctatttttttcaccttttatatttcgttttatattaatattttatatttggttcttttccctgcaaccttccacactagttgccaaccagaaatttttctgtcccagtgacagattcactagcatgtaagactttcagtactacaactaggataagttctaggcaaacctatgtgattggtatcctaggcctaccgctctaagtccagatggaagtccagatcgcagcacatgagcctgcagtcagagaaaaccttctaacccaactagtttcctttagccagctgccatgggctcttctttcatctcttccattctggggcttacaggtctaccctgaaagacctaggctgatatgctagttggctgtatgttttgtccccatgtagtccctttggaggccctctacccagtcaaggaggccttgagctttccccaataaagcctggactcaatgtgggagaaacacttgtgatcctgaatgcattttaggacataaagagtttgggctgcaatggtcatctaaatgagtccaggtttatttcatcatccccattctgcttacttttaatgtcactgctttgtgttaacataatatgacccagaaaaaatgtcaaattatggattttatgattgccttaattgtaagccaaaaacattgttgacttttgttactatttcatgaatattttcaaggaacttacaatctgttctacagctctatgtatatagatataatcatataaaatatgtacataattgaatatatatgtgcttgtatgtatgactatcagctttttgcatatgctggagtctaaattcacatatatttttgcctaattgactacttagtatataaaattataaagagtatattttaatctcactttatgatttttctttccatagtttttcattttatcctaaacctcagagatgaccattaataatactatatacattcctgattttcagaggttattattaacccttttaatatttgacaagttcatagaccagaaaaaattatattctacttacatttctttaatgttatggggcttcccagttgcttgatggtgataggaaatttataatttttctatgaattactatttcatcaccgttgtctctctattcttatgggtttgtttgaccttttataacatacgcatgcaaacacacacacacacacacttaagtgttgcacaatactcataaaatttaccatctgaatgctttttaagtgtataattccatgacattaagtacattgttgtgcaacatcatctctctgcagagctctttccatgttgcaaagccaaaactgtaaatcaattaaacaataagccctcattcctcctcttcccaggccctgcaaactattattctattttctgtctctgaatctgacaacttcagtaactcaaaaatggaatgaatcatgctgtatttgtcttttttgaaaaagcctggcttttttcactaagcccgatgtccttaaggttcatacatattgtagtgtgtgtcagaatttcatttcttttaaaggttgaataacattttattgtatgtatataccacattttgtttagctgttcatctgtcaatggatacttgggtttcttccacatttgggctattgtgaataatgtttctgtgactatgggcttacaaatatctcgagactctgttttcagttattttgtgtatatgtccagaagtgaacttgctgtgtcatatgatgattatatttctaaatattttgaggaatcaccatactattttccagcagcgactttgttttacattcccactagcagtgtacaagttattttctgtttcaatttctccacatccttgtcaatacttgttattttctgttttttttttttttttttttttctgattatagccatcctgatgggtatgaagtggtatctttttgtctctttcatccctgtataggtataatagggtcttatagatcagaaatttatcatttttaaaaagggcatggttttgttaaaaattggttattgggagatattttctgtcattgtatttcaacattacttgttacatgtagaaaatctactgatatttgtgcataaattttatcaatggattatcactatattgagaagtctatttgtttatttttggggatgaacatttttgaaatgatgtaaactgcaattaacagtaattttgccacatcttttcaacaataattctgtgaatggagagagagagagatagagagagacagaaagagagagagggagggagggagcacatgcattctggtctctcctctttttatgaagacaacaatcccatcagattaggaccccacacttattacctcatttaaccctaattatttctcaaagtcctcatctccaaatatcatcacattgggggttgaggcttaaacatatgtatttagggggacacaattcagtctataaaattccactctgtgttccccaaattcatgttcttcttacatgcaaaaaaattcatcccatgccaagagtcccaaaagccttaagccattccagcatcaattttaagtagaaagtctcatctgaatagcatctaaatcaggaatgggtaacatttgagatatgatttatcttgagacaaaatttctccccaactgtgaaagtgtaaaaccagacaaattatgtgtttccaaaatatattttatttatttatttatttattttgagacagagtctcgctctgtcgcccaggctggagtgcagtggcgcgatctctgctcactgcaagctctgcctcccgggttcacgccattctcctgcctcagcctcccgagtagctgggactacaggcgcccgccaccacacccggctaattttttgtattttagtagagacggggtttcactgtattagtcaggatggtcttgatctcctgacctcctgatctgcctacttcggcctcccaaagtgctgggattacaggtatgagccaccacgcccagccctgtttcaaaaatatagtggtgaaataagcataggacagacattcccattccgaaagggagaaattagaaggcaggaagaggtgatgggtttcaagaaattccaaaacctagcagtgcaagttccgttgtgtcttaggcttgagagttggccatacactacacaccagacacctcaattgctttgtctttagtctcccatatgaactgagatgtaaattaaatcctatccaaatcctatttggctgaatgttcttccttccaggctcactgaggtggtgcattacttccacaatcctaggtggcagtcccactcccttggcttgggagcctaccctgttcatactatctttacaatgtcccacccataaggcactgggctagggcaacttggtccgctgaaattaaaaaggaggccccgccctgtataaccaaagagaatgcagccttgatcctttggtctgtggcaccccgataatctttgagtcaaaggcgcaattattctttacttttcttgaaagataaagcatgctcatagcaaaatagcccttttgtcccattctttttccttcatttccaactggcaatgtctctgccagtataattccatctatgctggtattgtcttatgtttctgatttctgctgagatggctgattaaatccattattcacatccgtaatctctttatcaaatgattttctagccacacccttggtattctctccagaacacgttttctgattttgggaaatatggataggctgagaatttctggctaacaattatttcaattacttctttaatccatctctcctctctttcattttaccataagcagtcaggaggactcaggccataacttgaacattttgcctaggggtcacctcagctgttatctaacgtcagcttgcaaactctatctttcacaaaactttagaacacaagttagccaagtctttgccactttttaacaggaatgacctttccttcattgtccaataacatgttgctttatttctgtctaagacctcactagaagcacctttaatattcatatttctcccaacattctgttcatgattatgtacatattctctaagaagaggtaggcgttcccttttctctcagtgccctcaccagaatcacctttaatatctatatttctatcaacagtcctttattgcaatctaggctttttttagtttacaccttaaaatgattccaacctctacccattacccagtcccacagccactgctgtatttttaggtatttgttagagcagcacctcatatcttggtaccaaaatctgtattaatcagggttctccagagaaactgatcgaataagatattagttcatcatatggtggaaggttgagaactcaaaaatcatcaataaaacactagtaacatcccatttggtacattagtgtttttgtttttattatattcactttatatatataaaagaaatgtttgatgtttggaaatgatgttggtaatgatatcttctccttttcattgggataataaaatctctgacgtaacttaaaattgctgtttttcattccagagagaagttacatggaggagggaagataggccacttttcaaaaacaacggtttcaactcattttctacatttctctacctgtgcttcttattactactgccattttaataaaacagaaaaaattgagagagctatgctatagaggggaaaatgaaagtgagaggtatgtatatacatatatatgtaaaaaaatatatatacatatatttactcttattacattaagaaagacaagaaaaatgtatttatgtttcatcaggaataatctccaactgtagctaaggcaatataaagagaggctcagggagacattttaaaaatggtttgatgctgtttgttatttgttttgatattttttctcatcttacaaattactaaaactacagagtttaccactagtatcatggtaagagcagatatggctgccaggagaattttggaggtttatttagcctcttagttcaccgaccctgtccatacagtcatatcacctatgagctctattagaattatatgacactgcatttcaagggaacttccaaaaactaaatttattagatacagattttcaggccagtgataaacatctttattagaacacctctctcaattagagataatatctataaacctattttgacaatatttatttttctaaatatagatattgctgatttgtaaaatcatttcttaattagaaactacatgtgtagttaataatgtcaggttaaagagacaggaggcaccaccatgtaggaagagaattacgcttagcttcaggaaacctcgttttaagttataaatcttgcatgtaatactgtgataccgtgagtaagtgatttaatctttatttccttaagattattctctataactctacagaatgggaggtaataatagcttttcaatttatctaaacttttgagtacatccatttaatgagtgaaatcatcatgttatctgtaatcagttgcacaaatttttaaacatcatattgagccccttattcataatttacaatatttcatcacagatatatttacatctaggtttaccctccgagaactgatgcaaagataaaacgtgtttatattttctgagagagagaaagaaatatattgatctgtaaagaaaaagtatttaaaatttttgagtgctactttatggtttgccttattggaacggaggaattagggatatcataaaataaggggagctgcctatataaatgtgggtttacaaacataaattcttgattaaatgtagaatgagaatgagaagactcagttaccagactgaggtaactgatggcatttgttctaatattgaaacagtacctgtttaagttgttaaaaggagacctttcatttatttgaatcgctgtttctttgaagaacagttttcattcagttgtttaattattcaagaattacaattttcatcactttaaaacaaagtttatcaattttatagctctgtgtcagaagaaagcagcagtaacagcaagtcatccctcagtgaaaggtgagtatgggactatgtgttgaatcattttgcattgtaagttttgatcattgcttaggagcacttaaaaatggttagtttgaaaccaagcattctttatgtatttgtttaattctctccataggtcattttataataataaataataaaaccttggttttgtgaaatctcagcctctccttgacctataaaaggagagatttttgtgcactcacactggcaactaccatctatgagcatgtaaattgtgagttgtttttttttttttagcatcggggttttttttttttaagcatttttttttttagcatgtgttttagtgatatcttactggcatataaaaagataactgatgctctaatcagcggtaccatcctttttggcatcatggaccggtttagtggaataaaatttttccacagggtggggtagagggggatagtttcagctcacatcatcaatcattagttagattcccataaggagtgtgcaacctagacctctcatacgtgcagttcacaatagagttcatgctgctatgagaatctaatgccactgctgagctgacaggaggtggagctgaggcagtaatgcttgctggcctgtgctcaccttgtgctttgtggcctggttccttttatttatatgtgtgtgtgtgtgtgtgtgtgtgtgtgtgtgtatatatatgtatgtgtatatatatatgtgtatatatatgtatatatgtatatatatgtgtatatatataaattatactttaagttctagggtacatgtgcacaatgtgcaggtttgttacatatgtatgcatgtgccatgttggtgtgctgcacccattaactcgtcatttacattaggtatatctcctaatgctatccctccccctccccccaccccacgacaggccccggtatgtgatgttccccctcctgtgtccaagtgttctcattgttcaattcccacctatgagtgagaacatacagtgtttggttttttgtccttgcaatagtttgctgagaatgatggtttccagcttcacccatgtccctacaaagacatgaactcatcattttttatggccgcatagtattctgtggtgtgtatgtgccacattttcttaatccagtctatcattgttggacatttggcttggttccaagtctttgctattgtgaatagtgccacaataaacatacgtgtgcatgtgtctttgtagcagcatgatttataatcctctgggtatatacccagtaatgggatggctgggtcaaatagtatttctagttctagatccctgaggaatcaccacactgacttccacagtggttgaactagtttacagtcccacgaacggtgtaaaagtgttcctatttcttcacatcctctccagcacctgttatttcctgactttttaatgatcgccattctaactggtgtgagatggtatctcattgtggttttcatttgcatttctctgatgaccagtgatgatgaacattttttcatgtgtctgttggctgcataaatgtcttcttttgagaagtgtctgttcatatccttcacccactttttgatggggttgtttgttttttttcttgtaaatttgtttgtgttctttgtagattctggatattagccgtttgtcagatgaggagatagcaaaaattttctcccattctgtaggttgcctagtggtctgctttctaagaagccatggctgtggggttggggacccctgctctaaatgatgtcataggtgcttatagttctgctattatttcagaaaaaaaattactgagagtaagtttgagcattgaaattatcattcatttccctgtctcaattcatctgagatagtaaatttagggatcagattatgaagaatcaaacacaacattttataaaattagatatccttcttttactatcagtatatacagattttccctaccaaatgttggatagactataaaatgggagagtatttcaagtagcatccaatattatttctcatgttctctcttcatccttggagtacaaagttaaacactgactgtgatgattcatttagtaaatattgagatacatatctgcagtgagggaattcctgcttttaagagaagcactgttaaatatgggccatcaccgtcctaattctattgttaatgttggctgctttaggttctacaaaaattaagcatatctctgctttctaggcaagattatctttgatccttactttgatcactttgtgatgcatattatagaagagaaaataatcaaaagtgtttttattataattcctaccaagaagatagaaaaaagagctacttacactcaaaaattgtggatggaaggaagtactaaagagcagaaataatgtagaggaaaataaacagataaaaacataagcaaagacaaaagctgattctttgaaaagattaatataattgataaacattagctaatagttcaaaataaaacgagaaatgatacaaattactatcatgtaataaaatgatatcatgtctaattttctggacattagaagaagtcaaagttgataagtttaaatatttagttaaaatacaacacatttttaaaaaaacacttctttccatcttcccaaaatggaatagagagaagaaaaagaaagtataaagaagtctatatttattcaagacctggaagctgtaatttagaactttctcacaaagtggatacttgagcatgatcttttcatggcatgcatcagaacacaaagccaagccaaattcagtgaacatttcctcaattccatcagcttatgttttattatataaacaagtaacaatgtcaaactcagtgtcaatgaaggtggtgtgtgtaatatactccatccactataatgggagatactacaaagtcacatggcaaagaacatgtataaataatcgtatcttaagatataagtgaaaaattgaggacaataattcaaactattacatccagatgtttaaggaggaaatacagaaatacagcagtcctcccttatctgtgtgtgtgggagacattccaagacccgtaatggatgtctaaaatcacaaatagtaacaattctacatttacttgttttttcctatatatatgtacctatgattaagtttaatttgtaaattagacacatcaagagattaagaataaataataatataattgaacaattataatagtgtaatgtaataaaagttatgtgaatatgatctctctgtctcaaaatactggagttttttttgaagtgtggttgactgaagataatttaaagcataaaaaacaaaactgcagataagaggggactactgtaataccactcttacatatacttatgccgagaatacaacaaagggagcatttctcatcatgttttatgaggtcagcctagctttatggcccccaaatttaagggaactatcagaaaagaaaattatagatctatttctaattagagatgtagaaatgctaaataaaagatttctaaataaatccacttagtattatagaggatcatatattatggccatggagatagcctaggtatctaagaatgaaaaactagtttaaaatatgttttaccatattaaggaaaaggagaaaaaattatatgataatttctatatataaagaaaaataccctttaaagaaaaaaaaacacttttatgataaaaattcctagttaactagtgaaaaaaacttttaaaaactgataaggaacatcttcaaaaaagcatacaactattttagttaatagtgaaatcgtgaatgtttccttcctgaggtcaggaggatgtccgttattgttttcaacactgacattttcaacatcatatgggaaatcctagctggtaaaataaggtaagaaagaagtaagcaaatgtagtaagatcagaaatgaagaaagaatactgttattgtttgcagatgatatggcttcaaatttcaatgcacaaaaatttgaagaaataacaaaacaaaattaataaagaaaatataaggtttttggatacaaggctacatataaaaatcaattttatttttgtgtaagcaacagttataaaatgaaatttaaaaaatgcaactatatatagtatagggaaatatgtatatatgatacatagggatatatatccagtgaaaaagtgcaatacagttacacttgtaatataaaatactgctgagaattttaatatctaaaccagttgaagaacatactgttcaatatttttaagatataatttttccctaattgatatgtagatttaatgcaatcccaaaataaatatcttgacattttttggtggaaaattaaaattagattgtaaaatttatataaagataaatggagtcatatagtcaacaaaatcttgaaaacacaggaaaaagaaaacttatactacctgatattgacaacttttgttaagtaatcaaaacaatataggagcatcataggacagacaaataaaccaataaaaaagaaggaagtgttcagaaacagttgtataatatactcacatcttatttatacttctggtgccactattatttagtggataaaaaagtgatcttttcaatatatagtaggttttaaattgcatttccttgatgacatatgaattagtgatgtggagcacctttccatatacctgttcttcgtttttatgttttccttggagaactgtctgtctagcttatttgcccattttttgatcaatttatttgtttttctgcaattgaattgtaaaagtattttatacattttggatattaatcttttgccagagatgtggtttgcaaatatttttcctagtctataggttctcctttcattatattgcttctttagctgtacagaagcttgctagattaacatagttccatttattcatttttgttttgcggcctgagctttggtgtgatgtctaaaaattaattgctaaggccagtatcaaagagctttccttctatgttctctgttaagagttttattatttcaggtcaagaatttaggcattttcttcctttttgatttcattgttgtgtatggtgtaagaaagaatctgattttattcttttgtatatgaaaatctagtttttccagaaccacttattgaagagactactgtttccccattctgtcctctaggtgcccttgttgaaaattagttgatcatatatgtttggatttatttctgggctccctattttgttccattggtcaatgtttctgttttgatgtcagtgccattaatgtcttgattactatagctttgtaatataacttcagatctggaaggcaaagtctccaactttgtttttctttctcagtattggtttaactatttggaattttttgtggttccatattaattttaggtttgtttttctatttctgtgaggaatgccactggcatttctagagagattttgttaaatctgcatattgatttgaatatcatgaacatttcaatattattttgatccatgaacatggtatgtctttacatttatttgtgtcttcttcatctcctttaatcaatgttttattgtgttcagtgtacaaatgttccaccttcgtgattaatttgaattctaagtatattatgtttttgatgttatcagaaatggaaccgttttattaatttctttttcagctaggtggttcttcgtatataaaaatacttgtgattttttatattgattttgtatcctacaactatactgaattcatttattggttttttctaagctttggggttttctacatataggattatgtcaattgcaaatagagataatttacttcctcctttctgatttagaggccttttatttattttccttgtctgattgtatgtactagtacttccagtactatgttgaatagaaatgatgagaatgggcatttttgctttataccagatcttagtgcaaaagctttatgatgttagctatgggtttttaacaaatgtcctttattatgttgagaaaactgtcttatatatctaaactgttgaaaatattagaaaaggatgctgaagtttgtcaaaagcttttttgatgagtctgtcccacagactctggccaggcaaccaatgaaagaaatacacagacacaggtattttgcctgagaatgcagctagggaactgcacagcttagcaccgctgacaagagtgcagctccaataagctggagatgctcgtatttattcagtgcagatttaatgacaaaggcttggagcaaacacaatttgtgggtaattaacattgtccactcccctgagtatagagcagtcctacagtaaacaaatttatctagataagttcctttacattcccttgttatctaccctttgccctcagcctctggataagagaatttggctgccttcagccataattctcttctgaagcttttgcaaaactacccagccttccaagaaggtttgcgtctttcctatttttcccaccaccctgactgatcctcctacacttctttgtgtgtaaatttacatgatcatgaggtttttattttcttattctgttaatgtgatatggcatattgatttgcatgtgttaaagcagacttgcatgccaggaataaatccaacctggttatgatgtgtaaacttttgatgtgttgttgagttcagtttgctactgtattattgatgattattgcatcaatgttcatcagagatactggcctgtagtttcatttatttatttttttgggcagtgtctctgacttaggcatcaaggtgatgctggtcttgtaaaatgttttagaaagtgttcctttcagctctaatttttggaaaaatttaagaaatactgataataattcttccctgaatttttggtagaattcagctatgaaaccatctggtcctgggatttttatttgctgaaatgtttttaattcttcaagctatctatttcctcctgattcaatcttcagatgatatttttctaggaatctatctatttcctcaaagttatcaattttgttgacgtataattcctcataatcaccctttttaaaacttttttatttctgaggcatctggtagtgatgtctccacttttatttctaatttatttatttaagtattatctctctctctttttaaaaattactctatctaggagtttgccaattttattttttaaataatcaactcttggttttattgatttttttttcttgtttctcggtcatctatttgatttatttcagttctaatctttattatttcctttcattcaataactttggatttcatttgttctttttacagctccttgaggcacaatgtttggctatttacttgggatctttcatcttttctaatgtaggcatttattgctacaaacttctcttttagaactacttttgctgcatcctgtgctatgtgaactccaggaagctccctaggttggtgtcagtggctgtaaggactacaggattctccagtagcaaagagtgtggtgtctgtggtgataatgggaactgttggggtctactgcttacctttttccctgcagaaaaacttcccttcaggttttgatctgattctgactgtggggatggggtagcacagggaaagtgttttcttctcttctctatgcagccatcctgagtgtctatgcttcacaaaatttctgccactcccttgatgtacacctgagctctccttagtctttttggtcaaaactagcttatttgttgttttggtctttttgtgggaggagatgagcattaggcacctctagcttaacatctagctgatattcctcagaatatgtaatggtggtgggtaaatcacttttaattctactataatatcaaaagacaaaagcattaaaataattataagtaagaatatgttaatgggcacataatgtaagttgtaatataaagtgtgacatcagtaacaaagtattattgggaggacaataaaagtgtattattgggaggacaataaaagtgtattattgggaggacaataaaactgtagtgtttaaatgtgattaatagtatcagttcaaaacaaactgttacaagatttttaaatataagctgcatagtaataaaaatacttacagaagttacacaaaagtgaaagagaaaggaattatacaataaaaaagtaaatgaaacatgaaggaatacagcaagagaataaaagagggacaaaataaccataagattaaacagaaaaagataattaacaaaaggcattagtaaggcatgatggctgaatagaatccttcagcaattgtacgcactaccaagaacatcaagtcaaacaattatcaatttaagaaagcatcttcataggagcccaaaaccagataagcaatcacattacatggtgttagcataataacgtggaaggatgcactgaaggaggtcaaaaggacagagttccatttcctgcatcacccctcccccagtgccaggcagtatatcacagaagagaggctgtgctcttgggggagggaaagcaaagttggtgtggaactttgcactgaaactcagtgctgcactgtcacagcggaacacagcactaggcagaattccaccagtgctgacagcgagcatttagatcagtcgtgggccaaggggactccactgcttcagcacgaggaacccaagtctcagcctacttcactgcaggctgatgaacatggcctggggccccaaataaccttgagtggcagctaggccatagtgactacagtccttgggtaagccctggtgctgtcctggtctcagatgctgtaggcttgatgtacagcccagcgcaacactagctgtggcagccatgagagtgcctacatcacccctttcccaattccataccatgtagtatggagagagactttttctgcttgggagaaggaggggaaagagtacaatagactttattttgcaaccaggtaccagcccaggcacaggaaaataaagcatacggcagaatcccaaagtcctaatttcaggtcattgctcctaaatggtgtttctaggtcttctaaactttggttagaagagatctggctgcccttgtgggatggaccgttgtccaacctgtgtgatgaaccaccagttaactaaagtagccttgaataaacatcaatggcagtcaggcaatggtagcttcggtcctcagatgagccccaggtgagccccagtactatgctgatctgggaggctgtaggcttcaggtgtgacacagcagggtaccagctgtgatggccacaggagtgctcgtgtcttccctttcccaattccaggcagcccactacacagacagattccttctgcctggggaaaagagagagaagagagcaagggactttgcctgtgaacagaggaatttctccctattttcctccaagtccatcagagttgtgtatttaggagtctgcaagagatacagcatatctgggcttagagatccctctagcactgaaacgcctgtagaggcaacagacttgagtaacttaatactcaatcttctttaaattcttggaaagtcatttgaagaagggcaagtaaaaacaaagccagactctgaagactagaataaatacctagagacatcaatagactgcaatgcaatagtagtaggggccttttaacaccacactttcagcaatggtcagatcaccagacagaaaatcatcaatgaactattggaattaaacaacactagatcaaatggccctaactgacatttacagaatattttatgtaactggtgcagaacatatgttaatttcatcagcacatagaacatcctccaggacagatcatatgtaaagccacaaaacaagtcataacacattcaaagatggaataatatcaagtatcattttgaaaaacaatggaatgaaactagaaatcaatgaaaagaggaactttggaaacgatacaaatacatgaaactttaacaatgtgctcctgaaagaccagtgtgtcaatagagaaattaagaaagaaatatttttaaaaattgaaggaaacaaaaatggaaacagaacataccaaagtctgtggaatgcagcaaaaccagtactaaaaggaaagtttatacctatacatactgacatcaaaaaagtagaaagacttcagttatgcaacctcatggtgcactgcaagaaaaaaagcaaggacaaaccaaaccacacattagtagaagaaaataaataataaaaactagagcagaaataaatgaaattgagaattagaaaggtccatgaaacaagaagtttgtttttgaaaagataaacacatcttttgctacattgactaagaaaaagaaaaaaatggattgaatacttaaatgtaagatacgatttatatgaacccaaatcagagaaaaatcattacaattgacacttcagtaatttaaaggcagcattcaagtagagatattatgagcaaaagtgtgtcaataatttggaaaacctagaagaaatggacaaatttctagacacattcagcctatcaagattgaaccatgaataacagaaaatctgaacagatcaataatgaataatgacatagtagctgcaataaaaagttttccatccaagaaaagttcaggactagatagctttaatattgtatcctaccaaatatttaacgaagaactagtaccaattttactcaaactattccaaaaccttgagaaggagggaatattcccaatatcattctacaaggccaacatttccttcaaaaaccttacaaagacacagcaataacaacaaaaaactacaggccaacatcctgatgaaaatgcaaaaatcctcatctctactaaaataccaaaaaaaaaaaaatttagccaggcatggtgatgcaagcctgtaatcccagctacttgggaggccaaggcaggagaataacttgagcatgggaggcagaggttgcagtgggccgagatcatgccaccaacctccagcttgggtgacagagtgagactccatcttaaaaataaataaaaatgaaaataaaaataaaaataaaacacttataaaagaaattaaagaggacacaaaaaagtggaaatatatcccaagctcatggattggaagaattaatactgtttaaatgtccgtataacccaaagcaatctacagattcaatgcaatcgctatcaaaataccaatgacgttcttcacagaaatagaacaataatccaaaaattcgtatggaaccacaaaagatagtctctttaacaaatagtgttgggaatactttatatcctcatgctaaagaatgaaattgggccattatacacaaaggccaactcaaaatggattgaagacttaaatgtaagatatgaattataaaactcttagaagaaaacatagagaaaaatcttcatgacattggtcttggcaatgatttcatggatatgacatgaaaagcacagacaacaaataaaaaaaagacatatggggcaacattaaactcaaaagcttcttcatagcaaaggaaatgctgaaaatccaatggaatgggagaaaatatttgcaaaccatttatcagttaaggggctaattcccaaaatatattaagaactctttcaactcaatagcaaaaaactaataacctgattaaaagttagctgaagacttgaatagacattttgccaaagaaaatatataagactcttacaactctgtagcaaaatacctaataatttaaaaaatgggctaaagacttcaatagacatttctccaaagaggacatacaagtggccaataggcatatgaaaagatgctcaatttcattaactatcaaatgtatgctaatcaaaaccgcaatgagattcacctcacacctgttaggatagatcttaaaaacaacaacaacaacagagaaatgttgaggaggatgtggagaaattagaatctttgtgtatactgttggtgggaatgcaaaatgttgaaaccattatggaaaatgacatggagggttatcaaaaattaaaaatacaattacaatataacccagcaattctacttcttgaaatttatggaaaagaattgaaatcaggaaaccgaagagatattagcattctaatgttcactgaagcactattcacaactgccaagtgtggctacaacctaaatgtccatcgataaataagtggataaaaataaatgtggcatctctctcctcctttctctctctctctctctcgctctctctttctctctctctctctcactctctctctctttctctctctctctctctctctctctgtgtgtgtgtgtgtgtgtgtgtatgtgtatgtatctaatggaatattattcagccttaaaaagaagatcctgtaatgtgtaaaacatggatgaaccttgaggacaaacactgaataattccacttatgtgaggtatctaaaaagtcaaactcacaaaattagagcagaatggtggtttccaggaaccagggggtggagcaaatgggtagttgcgtcagtgggcataaagtctcaaatatgcatgatgaaaatgttctagagatctggtgaaaaacattgtccctaaaattaacaaaaccatattgtacacttaaaaatgtggtaagatggtcgatctcatgctgtgttcttaccatatatagtacaaattttttaaaataaatacttttgccatttataagatacccttaagaagggaaaaaggaaccgcagggatgcggttacactggcgagaaaacagttttggcggcggggagagttggggagggtggagggggtgttgtgatgggaggggtgatttacagagtgagtagcagatgtggaaggtgggctctacagataaagacttcgaggaaggttgtttcccagggcaagggaacacagagagtgagggagtcttgtcttgaaagcaggaaacaaaggactaggaaacttaaacaagttaaccctttgaagaagaatgtcttactgtatttaacattttgaaagtctattattgtgaatatttatgccacttccagtttttagttattacaaatacaccgtaataagcattctggtatgtatatatatctgtgagcaattgtcaagttatcgcctgagataaatccctagaagatatcaagaataaatatagtgtaatatgaagacttttgttgttttaaaatatctattactaaattatcagtccatttgtatcaagttgtaactttcataatttattaatttattagctagtttggatatgtgagtggtatactttctgagccctagcatatcttaaattctacttcttttattttactaccttactgaattttctttgtaattttccactatgtcactttgtaatgagctatttctataaagaatatagaaatagaagtagaaaatacgaaatatgaacatctggaattagaggcattttgagactccctttagtatgaaggaagcttagcatattttacctttaaaaaatctctcccttcactaatctttctgttatgtaaattgagattttagacctagcctactgttaataaatttctgcttttaaatattatttattttggttctaaaatattttgtctttttcagttttataaagtttacagcaaacattttgaattcatttatatttaactggttttattttttaaagttctaaagaatgattttaacttttaatggtgttaagatccttttctagccagagaacttggaatgcatgaatcttaactttaccatcactttcttctcttattcaataaataatgtgtgcatgtgagtgtgtgaatcattcttattattatagtagtaacacataataaacattgattaaaatatatatgtgagtaaaagaatgaaatggtaatcatcattagtcccagcaccaggggtgatcattctttaaaaatttcattatatagatatacacaccaatgtgcatgcatgcatgtgtgtgtatatgtacatgttggtgttatctaataaaaagatacttagaattaccacctttcaattttaaaataaaattgttgcatatatttagaatggagttttcaagtcactttatttattgatgtaaatagttaccaaacatggataaaaaaccagtgtactttaaccagtcacttctattttaaaactaagagtatcttcagtcgtggtaacaagtaatatttttctggaatttttattttcttaattttttgcttttaatcacccatagttttaaaattacttgagttagaaatgtgttagctacaagaaagaaaaatgagcaacattggcgtttgttttgttttctcctacagcaccagtctctaacaaccttgaatgctactgcttggagagaggagagtaacaaatacattatcagaaactggcccaaaccaaggaggaacaagacacaatttctctctcattgctcttgtcactgctgagggttttaaactatgaaataaatcatctggcctgaatctcatgacttacgtccattgaattctctgtatttgcagtccaaattctaccctatcaaatttggatccataagatgctctgaatcaggtgaaaggagcctaagaccctcatctcataaaggcaagagggactgccagtcagcctcacagcagagagtatctgttttcccttctgcttcttaggttgaccagaatctccctcaagtctgacctatcccctttccttcagagttcctagcgtctaggtattctgtgactggttacagtgacatttatgcagatggtatctgagtccaatccctgtcttcttactcctgctcatttatgaaagctgtaaagccactttagtgtgttaaaatacctgtttgccaaaagtagatttaccataaagctaaggaagcaaaaacttaagagcaacttagttgcacagattctcttcaaagtcatgaagctaactttgtattcttagagtttatcaaattttatatggtcaggccccattgagcctgaatcatctcgctgttcacaagttcccttggcagtggtgtgctagagccatttcatactatctcaccagagctcaccagttaaaatttcagaatatttgcaagtcagttgttaaacagccactattaaaaacattacttaaatctaaataaattaaaaatcaatacttgaaagacaccatttattcattattttgttgtatttttatctttgctttttaggttataattattgcatctttatggtggaattagtatattatggtaatgtatgacttgcatgtattaccaactcttctagaaatatcaaatggtagcttgaaattagcctttgctgagactgataaacctatcaatgtggacttcctctccctcacatcacagaaatagctgtataataattgctagcaaaccactgttcttgggggtagttcaccttttttctatttttgttttcaatagcttgttgaagctacttttctatcatggctcaaatctatctccaactctttctgaatatgattacccaattggtatcaaaaaattgggtatagaaagaatataactaaacacaataaaggccatgtgttaaaaattaaaccccacagttaacatcatactgaatgaggaaaagctgaaagcttttcttgtacgatctggaacaaggcaagcttctcacttctaccacttttattcaacatactattggaagtactagccagagcaattaggcaagagaaagaaaataaaaggcatataaataggaaaggaagaagtcaaagtatccctgtttgccgatgacataatcatatatatagaaaatcctgaagacttcaccaaaaaaattgttagaaaaaataaatcaagatagtaaagttgcagaatgcaaaattaacatacaaaaatcagtagcatttctatataccaatagtaaactagatgaaaaagaaatcaagaagcaaattaatttacaatagctataaaattttaaatatctaggaataaaccaagaaggtgaaagagctctacaatgaaaaatataaaagattgtaaaagaagttgaagaggacacaagtaaaaaattccatgttcatggatcagaagaattaatattgtcaaaatgtccatgtttatccaaagcaatcttcagattcaatgaaatctctatcaaaataccagtgaaattcttcccagaaatagaaaaaacaatcttaaaatccatacggaaatggaaaagactctagtagccaaagccatcttgagcaaaaagaacgaagctggaggcatcacagtacccacttcaaaatatgctacaaaagtataataatgaaaacagcatggcactggcataaaaacagtcacatagaacaatggaatcaaatagagaaataaatccatgtatttagggccagctaattttcatcaaaggtagcaaaacacacattgggagaagaactgtctttgtctcctcagtaagtggtgctggcaaaactggctatccacatgcagaacagtaaaaccagggcactatctctcaccatatacccaaacttaactcaaaataaattaaagacttaaatttaagaccccaaactatgaaactactagaagactataggggaaatactttataaaattggactaggcaaggatttttttcaataagacctcagaagaacaggcaataaaagtaaaaatagacaaatgggattacatcaaagtaaaatacttctgcacaacaaaggaaatcaatagtgtgaaaagacaatctataggttaagaaaaagtatttgcaaaatatacttctgacaagggattaatacccagaatatataaggaactcaaacaattcagtagcaaaacaaaccaagtaatccaatttaaaaatgggcaaacgacctgaatagacatttctcaaaagaagaagtaatggccaagagacatacaggcatatgaaaatgtgctcaacataattgattgtcagaaaaatgcaaatagaaactaccatgagatatcatctcaccccagttaaaatagcttatataaaaaagataaggaataacatatgctggtgagaaagtggagaaaaaggaacccttgtacactattagtgggaacataaattagtacaaccagtatgaataacagtttgcaggttcctcaaaatctaaaacttggggtaccatatgatctagcagtaccactgctgggcatatacccaaaagaaacaaaatcaggccaggtgcagtggctcatgcctctaatcccagcactttgggaggctgagacagttggatcacctgaggtcaggaattcgagaccagcctggccaacatggtgaaaccccatctctactaaaaatacaaatattagtctggcatggtagtgggcacctgtaatcccagctacttgggaagttggggcagaagaatcgcttgaacctaggaggcggaggttgcactgagccgagattgcaccattgcacttcagcctgggcaacaagagtgaaactctgtctcaaaaaaaaaaaggaaagaaaagaaaaagaaaaagaaaaagatcagtatattgaagagatatatgcactcccatgtttgttgcagcactgttcacaatagccaaaaaattggaaacaacctaagcatccatcaacaaaagaatggatacagaaaatgtggtacactgccgatcattatgttaagtgaaataagccaggcacagaaagacagacatcaaatattgtcacttgttagtggtatctaaaaatcaaaacaattgaactcatggagatagagagtagaaggatggttaccagaggctcggaatggtagtggcaatgagggtgagggttctggaggggagatattcttgttcattcatggaattttactcattcataggaagaatgaataagacctactatttgctagcacaacaaggtgactataataatatacttgtacatttttaaataactaaaaatacagttggattctttgtaacacaaaggaaaaattgagggaatagataccattctgcatgatgtgattattactcattgcacacctgtatcaaaatatctcatgtacctcataaatatctacacctactatgtatccaaaaaaatttaaaaataaaatggccaagatgtacatgaaaaaatggtcaacatcactaatcatcagtaaaattcaaagtaatagtgagatactatttcacctcagttagaatggctcttatcaaaacaccaggggtttggtcttggttctgctgctcactgcacagaaagccaataagtattgccagggaagatggctttaattgggtgctgcagccaagtccaaattcatctccctgatcaaattagagatttacatagtagggaagaaatatgtaactatgtgtgggaaaacaggaactcaggaggggtaaagaagcaatcatgggctgggtgtggtggctcacgcttgtaatcccagcactttgggaggcagaggtgggtgaatcatccaaaggtcaggagttgaagaccagcctggccatcatggagaaaccctgtctctactagaaatacaaaaattagccaggcttggtggtggatgcctgtagtcccagctactcaagagattggggcaggagaatcacttgaacccaggaaggggaggttgcagtgagctgagatcgcaccattgcactccagcatggatgatagagattctgtctgaaaaataaaacaaaacaaagcaaacaaacaaaaaaacaaataaattaaagaagcaatcgtgatgaatgagagaatgaattattgtctgaatgtgatgatctggtgagtttcagttttttgataccttctgagaggcctgggaatcctttcctgaggaaggaactcagataaaatgaatgtaagtgtcaagctttaacaccagaagggtcaatttctatgtttatcaaaaacaaacaaatgaaaacaaaactgtccatgggactcttggattggcttcatggctatgaatacaaaaaaaaaaaaagtgaatgctgatgagaatgtaaagaaaggggaactcttttgcactgttaatgggaatgtaaattagtacaaccattatggaaaacagtaaggggatgtctcaaaaaactaaaaatagaactaccatgtgagcctgcaatcccattactgggtgtatatccaaaggaaatgaaactttatgttgaagagatttataccatcgcttgtttattgtagcattattaacaatagccaatatatgaaatcaacgtaaaagcctatctactgattaatggatttaaaaatgtgatatatatacaaaacaaaatattcttcagccatatgaaacaatgaaattctgtcatttgcagcgacgtggatgaagctggagggcattgttaagtgaaataagccaggcagtgagacacaaatgatctcaactcacgtgggatcaacaaagttgatttcatagaagttaagtagaatagtgattactagagttttgaggtgagggtactgtattagtccattttcatgttgctgttaaagacatacccaagactgggaagagaaagagttttaattggacttacagttccacatggctggggaggcctcagaatcatggcaggaggcaaaaggcacttcttacatggcagcagagagagaaaatgaggaagaaacaaaagtggaagcccctgataaacccatcagatctcaggagacttattcactatcacgagaatagcatgggaaagaccagcctccatgattcaattacctttccctgggtccctcccacaacatgtgggaattctgggagatacaattcaagttgagatctgagtagggacacagccaaaccacatcattccacccctggtccctcccaaatctcatgtcttcacatttcaaaaccaatcatgccttcccaacagtcccccaaagtcttaactcatttcagcattaactcagaagtccacagcccaaagtttcatttgagacaaggcaagtcacttctgcctatgagcctgtaaaatcaaaagcaagctagttacttcctagatacaatggaggtacaggcattgggtaaatacagccattccaaatgggagaaattggccaaaacaaaggggttacagggcccatgtaagtttgaaatccagcagggcagtcacattttaaagctccaaaatgatctctttgaccccaggtctcacatccaggtcacactgttgcaagaggtgggctcccatggtcttgggcagctccacccttatggctttgcagggtatagcctccctcctggctactttcatgggctggcattgagtgcctgtggcttttccaggtgcatggtacaagctgttggtggatctaccattctggggtctggaggacggtggacctcttctcatagctccactaggcagtgccccagtagggactctgtgtacgggctctgaccccacatttcccttccacactgtcctagcagaggttccctaaccctgcagcaaactttttcctgagcatccagtgtttccatacatcttttgaaatctaagtggagggtcccaaacctcaattattgacttctgtgcacctgcatgctcagcaccacatggaagctgccaagacttggtgcttccaccctctgaagccacagcccgagctctatgttggcccctttcagccatggctagagcagctggggcacagggcaccatgtccctaggctgcacacagcacagtgaccctgggcgcagtccatgaaaccactttttcttcccggggctccagacctgtgatgggaggggctgccgtgaaggtctctgacatggcctggagacattctgtcatggcttggggattaacattaggcttcttactaatgcaaatttctgcagtcagcttcaatttctcttcaaaaaatgggtttttcttttctactgcatcatcaggctgcaaattttctgaacttttatgatctgtttcccttttaaaacagaatgcttttaacagcagtcaagtcacctttggaatggtttgctgcttagaaatttcttccactagatacccccaaatcatctctctcaagttcaaaattccacaaatctctagggcagggacaaaatgccaccagtctctttgctaaaacataacaaaagtcatctttgctccagttcccaacacatttctcatctccatccaagatcacctcaacctggaccttattgttcatatcactatcagcatttttgtcaaagccattcaacaagtctctaggaggttccaaactttcccacattttcctgtcttcttctgagctttccaaactgttccaatctctgctggttctaaagttgcttccacattttcaggtatctttcagcaataccccactcctggtaccaatttactgtattagtccgtttacacactgctgatgaagacatacctgagactgggaagaaaaagaggtttaattggacttacagttccacatggctggggaggcctcagaatcatggcagaaggcgaaaggcaattcttacatggcggtggcaagagaaaatgaggaagaagcaaaagtagaaacccctgataaacccattagacctcatgagacttattcactatcatgagaatagcacaggaaagaccagcccccattattcaattacctccccactgggtccctcccacaacacatgagaattctgagagatacaattcaagttgagatttgggtgggacacagccaaaccatatcaggtaccaagatacattggtaaacgagtacaatgttacaattagataggaagttatagtgttctactacactgtagggtgactatagaaaataaaaatgtatatttcaagatagctggaagagaagactatgaattttaccaccacaaagaagtgataaacatttaaagtgataggtacagtaattaccctgatttaatcattttattcaacgtttacatgcaatggagaatcacactgtaccccataaacatgtacaattattgtgtatagattataaataataaaaatgaataatacaaaaaaagaatacttaattttctgggtccctaggacatttgacatagtttggagtgagcctaagagcaacatctgtcagagttccaaaaggtaaatttcagacctgctctctgttatggagggtggaaaagctgctaagagataactagagttgcaccaccaaaaatgacaaggctaccaagtctgtggtccaaggaccttacccttagagctattcaaataccgatgagctggtaggtctgagaagaggaacagtacgtaaggcaaacatttaccaattgctatgattaaatataccaagtttatgaaaacctaaggtaagtgaaatattctcatggctctgggccagtgtgagtttgggacattctataaaatagcatttctacttttcctgacatctaccctgaaattgtagaaagaagtggaggggtgaagaaatatttgaagatggagtagaaatttcttgaaaaaagtgacttttgcttttagatctgaagagagagataggtgctacaagtatgaaggtgctgcaaaaagaaaatattttgctccctggaaaaaaactttcctgttactcagaactccatacaaactgtgtcaaaagccagtgacgattttggtcccttaatttttttctgaaattactctggaaaactcatcacttacctctacagtgttaaatttatgaattcctattcctcttttttttttgctttttaaattgatatttgattttctttttttaacttactcctttcatttctaaaatgtttttatctgttttgatttttagccctatgtctaatctctccaagagttttttctcactttgctttattaccatccacttatttgtttattaatgtttactcactcttgacttctatctcttttcacttcataccagtagttcataactaagtgtgtagattattctacttggagagattttccaaatactcattgcatagcaccaattctaaagattcttattcagtaggacatttctctgataacatcagttattctttgggtacaaatatttgtattgactaatgattcaaatatacaaatataaagctcaatattttaaccgaattcttatgcctaatgaacttgagagtaggttcatgatgaactgaacacagatgaccaattctccatgagtattttatgcaactttatatttttttccttttagattcagtgtgcggatgtgcaggttcattacatgcatacattgtgtaatggtgaggtttgggcttctagtgaacctaccacctaaatagtgaacattgtacccaacaaatagtttttcaaccctcattcacctccactgtccttgcttttggagtctccagtgtctattatttctgtttttgtgttcacatgtacccatggtttaggacccacttataggtaagaacatgcagtatttgattttctatttctgagttatttcactaaggataatggcttcaagctccatccatgttgctgcaaaggacgtgatttcattttttgactgtaaagtattccatggtgtgtgcgtatgtattcagtccaccattgatggacacttaggttgattccatgagcaaattcattttttgaattccagggcaaaggaagaagcctacttaaacagatatagcacacatcatgcaggacatctgtgtggaccaccaaagggaaacctataaacttgcctgcttcaccagaattatagttaagaacaaagacaagtttcggaggatgctcttacccaggataattgagatgagccatcctaacattttagaatttccaacaatttaaaatccatctgatgttggttatcatatatcatcttaggtgggtccaacaattttcctgggcagtagagtctgtcctctatgtgataactagatatccaggcttctttagtcttgtggctccatattctcaccacaagatcccacagttgccaacaaaatggaaggaagtgtgaaaaactcataatctgctcactaactgcctctaaccagcagtgatacaacaagtagtttattctcatggtccattgacccaatctagtcacatagtcctaactgcaaaggaggctggaaaacatcaagataacctatagaatatttggtgagtgctacttccctctcacactgtgaaatagaaactatgaaggttgtaccatctgtgactaggtataggcatgtcgtagttcccatattggaatgaacatcttctaaatcactctgtgacaggactgtgatcatttatttggcaaatgcatcccaactcctttcctccttattgaagtacccttgttatctaggatggatgaaacaagttcctgtagactcagtttgctagttttcaggttggatgtcaaataaatctctgagttacatcaatgttggaacagcgttgtcactgcgctgacaaagactagagccatttttaaagcctggaaattctggaagcaggtatgcatatcaattgattcggaaaagcattcacaaacactaaactaactgggaataaaagaaaaatgccttcatatgataaaagccatagacgaaaaacccgtagttaacataatcgtcaatggtgaaagtttgtaagatttttctctaagatcagaagcaagataaagatgcctgcttttgcataatctgagtggtatgggtggcaccatgggagtgccacttggagatctcccactacaaggagcataaacaataaacggtctgagcagctgcaggctgaaatgcatcagtgcatttttgtgaagtccacacttcccatggtgtgctcccaaccactgatggaaaatgatggagatcctaaggaaggcattcctaggagacctgagattcccctgacagtggatctagcttgaggactctccaacagctttgtgaaaacttcctggcagtgcatgggccttctttaagctgcataaagccaagacagcttccatccagctttctctccttctcttttttacttcagtgtctggcagctttctcaggcttttcatctttctttcctttttttctttttttgcaagggctgtttctcctgataaaattctggaacatttaatactgtcttggtgtctatttctcggaagatccaaactaaaacaagtgataatgagactattataagtatacagggggtaagatgtgaatttgtcttggcttaactaaccctgcaactgacagaggacatgatcctggttgggaggtggggcacagatagtccctgccatgaggtgacagtagaattctaaaaattttttggcaactgagaaaaatgttccaatagagacaaatttgacagatgcaataaagcagacatttaaagtcagtgaagtttggccaggtgcggtgactcactcctgtaatcccagcactttgggaggccgaggtgggcagatcacctgaggccaggagttcgagaacagcctggccaatgtagtgaaacactgtctctactaaaaatacaaaaattagctgggcgtgattgcggccgcctgtattcccagctactcgggaggctgagtcatgagaattgcttgaaaccgggaagtgaaggttgcagtgagccgatatcacaccactgcactccagcctgggtgacagagggaaactctgtttcaaaaataaataaatagataaataaataaaaaagtcagtggctttagctggttgccgctaagtttcattgattattgatgccatgcacaaggataatgagagattgaaggctgttaacaagcaattactggctatgattgagacccagagaatctcagtggtagcttacaaagaggccttaatcagtcatagttagacagcagataggagaatggcaggtgggagttctgtttgctgcagtagcaagctctagagaatctaaacactcagccaaaagagctttgttgtgctaaggtttcaacattgtagggaaaatttggaatcctgagaactggaaagaggacttctggatgtatgcctctgaggatattgactttacaaaacccacttctactgggctcattgggtttgcagaatggcccagttttgcatttccacagggattgtagatgctgcagagcatgttagaatcctgtgtccagggatcaaataacaaacaaatgaacaaacaaacaaaacaaagaacaatcactgtactgttaaggaaaattgactctaatcagcaggatgaggtaagggtgttttacccaatggaggcagcagagagtataggtggaacccaaatgatctatttgggattattgcactgtaactatgaatggacatgtgcaaccctggcatgagaaaagtatgacgattcatggtgcaagcacttcacgataaaggcttgattacacattcgttaaggcatggagccaggccatgtgagacctgagcaggagggttgttcagaatgtgcagtaggtattaggggctaatttataacaaatagtaagatactattttcccgtaaagtttagatacatctttttttaaaaaccctttatgttacctaaaatcaggaatgtactaaaatgtagatttgttgtataaatccatttttcaatataagattcattaggtctagagttctagatccatgaaacccttgcattttagttttctagtttgttattttgaagctaacaaataagctacaccattataaatttcgagttgagcataagcaattgaatccaagaacttcaagttctgtattaagtacatttgatgtgaaatctaacttgctgcaaaacaaggggttggtggtggaaaatgcaacttctggcatgtgtttttatagatgtaatacatctatgggtctttaaataactttattgagatatgttttacatatcctaaaatttacctacttcaactgtacaattcaatatttttaacaacttgtgctgtggccatcatcataaatcactttaggccattttcatcatcaccccataaaatctctcttgtcaatttacagataatccctgtttccaaccatagccccaggcaacaattaatttatgttctgtctctataaacttgcattttcactacatttcatacaagtggaatcaaaatcccttatttctgcctgagtttttagagttgaacaaggctggagaaaattattctcacataattcattaacatctccacttaattcaggctcactacacttgcattggccttaatgcctctacaattccattagatatgctctttgttaaatttttggtaactttcatgtttctaaatgcaatggttatttctttttatctattattttaggtccgaggggcacatgtgcaggtttggttatgttggtaaatagtgtgccactgatgtttggtgtatgaatgatcccatcatccaggtagtgaacatagtacctgatagtttttcaatcttctcccacttcctgacatccctcctctaatagtccccactttgtgttgtgcccatccttatgtccttgtgtacccaaagttcagttactacttataaatgagaacatgtggtatttggttttctgttcctgcattaattcactaagataatggcctccagctgcatccatgcaaagggcatgatttcatttttcttttatggctgcgtagcattccatggtgcatatgtacacattttctttattcaatccaccattgatgggcacctagattgattccatttctttgctgttgtgattccatgtcattgctatgttgcaatgaacatgtaagtacatgtgtctttttggtagaatgatttatttctctttgggtatatacatagcaatgggattgctgggtcgaatggtaactctcagttctttgaaagatttttaaattgctttccactgtggctgaactaatttaaattcccaacaacagtgtatgagtgttccctattctctggaaccttaccaacatctgttatcttttgacatttgaataataaccattctgactggtgggagatagtatctcattgtggttttgagtagcatttctctaatgattagcgatgttaagcattttttatatatttattggccacatgtatgtcttatttcaagaagcgtctgttcatatcccttgcccaatttaaatggggttattttttgcctgtgaattgtttaggttccttacagattttgtatattacaccattgtcagatgcataatttgtgaatattttctcccattatgtaggttgtttactctttagttactttagctatgcagaagctctttagtttaattaggtcccacttgccaatttttggtttttgctgcaattgcttttgaggacttagtcataaattatttcccaaagctgatgtccacaatagtatttcctaggttttcttctcatatttttgtggttttaggtcctgaatttaatattttaacccatcttgagttaatttttgtatatggcaaatggaaggggaccagtttcaatattgtgcatatgtctagtcagttatctcagcactgtttattgaatagggagtcctttcaccattgtctgttattgttgactttgtcaaatatcagatagtcataggtttgtggctttatttctggatcctctaaccgtttccattggtctacctatctgtttttgtaccagtaccatggtgttttgattactgtagccttgcaatatagtttaaagttgggtactgtgacacttctggctttgttccttttgcttaggattgctttggctattcaggcctttttttttgttccacattaattttagaataatttctttctaattctgtgaaacataacacttgtagtttgacaggaatactactgaatgtgcaagtcattttgggcagtatcgtcattttaacaatattgattattcctatccatgatcatggaaagtttttccatttgtttgtgccatctctgatttctttttgtaatgttttgtagttcttactgtagagaactttgtccattctagttagctgtagtcctagagatatttttttctctttgtgagtattgtaaatgagattgccttcttgattttactctcagcttgaatactattggcatatcaaaatactactgatttttgtacattaattttgtatcctaaaattttacttatgttgtttatctgttctaggagcccttggcggagtctttagggtttaggtacagaatcatgttgcctgcaaagagagatagttgaactttctctatttctatttggatgcctttaatttctttgtcttacctgattgctctggctaggatttctagtactgtgttggataagagtggtgagagtgggcatccctgacttgttccagtaattaaaaggaatgcttccagcttttgccacttcagtatgatgttggctgtgagtttgtcatagatggctcttactattttgaggtattttcctttaatgtgtaatttgttgaaagtttttaacatagaggaatggttgaattttattgaaattcttttctgtgtctattaagatggcaacatgatttttgtttttaattatgtttatgtggtgaatcccctttattgatttgcatatgttgagccaaccttgcatccctggaataaagcctactcaattgtggtgaattaactttttgatttgctggtggattttgtttgctagtattttattgaggagtcttgcatctatgttccttagagatatcggcctgaaattttcttttttgttgtgtctctgccaggttttggtatcagaataatgctggcttcatagaataagttaggaagttgctccacctcctcagttgtctggaataattttgatgggatttgtactgccttgtctttgtatgtctggtagaattcagctgtgaatctgtctggtccaggtctttttctgataggtaggttttttattagtgattcaatttcaaagctcgttattggtgggtgggagtcggggccaagatggctgactagaagcagtggcaatcagaggctctcatcgaaaagatccaaaagagcatgcaaatcctgcactggtaactgaggtatccagatcctgttattaggactgactaggtgactggtatgacccatggagaaaaaggaagaagagtgtggtgcagcagcccatcagagagccatacagggcaggggagcccccactcccagccaagggaggcagcgagtgagcatgatacccagcctgggaaaccatgctctttccatggaaatgtgcaacccatggattggaaaatcccacttgggagcccatgccactggagccttgggtcccaaccatggagccatgcagattatcaacatcttctaggctaggatcagcctaagcctgagttcccatggggaacactgctgtggctgcctgcagtctaagccatctgagctccttgggggaggggtgggagccaacactgtggctgcagtgcgtccctgcaggaactccaactccagtcaggggcttagggacagaactatgatctctctgggcctgagccgccttggggaaaggtggccatatgctccatggaccagcagagttagtcttttctcctgctagatctgaggaatctgggcagcccagatgagtgggttttcccccagcacagcacactctttccaccaagggacagccaaagtgcctcattaaataggccctgcttcccatgccactcaactgggtgagacccccccaacagggattgtcagacaactcatacaagggtgttcctactggcattaggtcagtgcccctcgaggtcagggatcccagagaaaggagcaggtaaccatttttgctgttctccagcctcttcgagtgacatctctaggtatgggagcaaaccagatgaatagggcctgaagtgaaaccccagaaaactgcagcagccttagagaagagagacctgactattgaaagaaacaacaacaacaacaacaacaaaaacaaacacaaaacaacaacagcagcatcatcaacaaaaaacgtctccgcaaaaacctcatccaagtgtcatctgaggacagcctcaaagatcgaaactagacaaattcttgaagatgagaaagaatcaataaaagaacattgaaaaccaaaaggtcagagtggcttgtctcctccagatgatcacagcacctctccagcaaggctccagaactggacagagggtgagatggactaattgacagaagtaggcttcagaaggtgggtaataacaaacttcactgaggtaagcagcatgctctaacccaattcaaagaagctaagaaccttgataaaaggttagaggagctgttaactagaataactagtttagagagaaacataaatggcctgatggagctgaaaaacacagcatgagcacttcatgaagcatacacaggtatcaatagccaaatcaagcaagcagaagaaagaatatcagagatggaagactatattgctgaaataaggcaggtagaaaagattagagaagaatgaaaaggaatgaagaaaaccttcaagaaatatgggactatgtaaaaagaccaagcctacgactgattggagtacctgaaagagacagggataatggaaccaagctggaaaacacactttaaaatattaaccagaagcacttccagcctagcaagaaggccaacattcaaattcaggaaaaacagagaaccccattaagatactctacaagaaaatcaagcccaagacatgtaattatcaggttctccaatgtcaaaatgaaggaaaaaaatattaagggcagccagagagaaaggccaggtcacctacaaagggaagcccatcagactaacagtggatgtctcagcagaaaccttacaagccagaagaaagtggggaccaatattcaacatttttaaagaaaagaattttcaacccagaatttcatatccagccaaactaagcttcgtaagtgaaagagaaataaaatccttttcagacaagcaaatactgagggaattcatcaccacaagatcttccttgcaagaactcctgaaggaggagctaaatatggaaaggaaaaactggtaccagccattgcaaaacacatgaagatataaaaaccaatgatactatgaagaaatgacatcaactagtgtgcaaaataaccagctagcttcatgatgagaggatcaaattcacacataacaatattaaccttaaatgtaaatgagctaaacaccccaattaaaagacagactcaaaaactggataaagagtcaagacccattggtgtgctgtattcaagagacccatctcatgtgcaaagacacacatagggtcaaaataaagagatggaggaatatttaccaagaaaatggagagcagaaaaaagcaggagttgccatcctactctctgacaaaacagactttaaaccaactaagttagaaaaagacaaaaaagggcattacataatggtaaagggatcaattcaacaagaagagctaactaccctaaatatgtatgcacccaatacaggagcacccagattcataaaacaagttcttacagacctgcaaagagacttagactcccatgcaagaatagtgggagattttaacacctcactctcaatattagacagatcaatgagacagaaaattaacaaggatatgcaggagttgaactcagctctgaatcaagtgggcctaatagatatctacagaactctccaccccaaagcaacagaatatacattcttctcagtgccacatgacacttattctaaaatccaccacagaattggaagattctgcaaattcaaagaactgaaattataacagtttctcagatgacagtgcaatcaaattagaacttaggattaagacactcaaaaccacacaactacatgtaagttgaacaacctgttcctgaatgactccaggtgaaataatgaaattaaggcagaaatcaagaagttctttgaaaccaatgagaacaaagagacaatataccagaatcccttggacacagctaaagcagttttaagagggaaatgtataacactaaatgcccacaccagaaagctagaaagatctcaaattgacaccataattaaagaattagagaagcaggagcaaacaaatccaaaggcagcagaagacaagaaataaataagatcagagctgaactgaaggagagagatgaaaaacccttccaaaaaatccatagctccaggagctgttttttttttttgaaaaaattaataaaatagactgctaggtagattaataaagaagaaaagagagaagaatcaaatagacacaataaaaaatgataaagggaatatcactgctgaccccacagaaatacaaactactatcagaaaatactatacactactctattcaaatcaattagaaaatctacaggaaatgaatacattcctggacacatacacccttccaagactaaaccaggaagaagtccagtccctgaatagaccaataacaagttctgaaattgaagcagtaataaatagcctaccaacgaaaaaaagcctggaaccagacagattcaaagccaaattctaccagaggtacaaagaggagctggttaccattccttcagaaatgattccaaacaattggaatcataggtgggactcctccctaattcattttatgaggccagcatcatcttgataccaaaacttgacagagatacaacaaaaaaagaaaattcaggccaatatccctgatgaatattggtgcaaacgtccttgataaaatactggcaaaccgaatccagcagcacatcaaaaagcttatccaccatgatcaagttggcttcctccctgggatgcaaggttggttcaacatatgcaaatcaataaatgtaattcattacataaaccgaaccaatgacaaaaatcccatgattatctcaacagatgcaggaaagaccttcaataaaattcaacatcccttcatgttaaaaactctcaataaactaggtattgatgaaacacacctaaaaataataagagtcatatatgacaaacccacagccaatatcatacttaatgggcaaaagctggaagcattccctctgaaatcctgcatcctattcaacatagtattggaagttctggccagggccatcaagaaagagaaggaaataaaggtattcaaataggaagataggaagtaaaattgtctctgttttcagacaacatgatcctatatttagaaaaccccatcatttcagccccaaaactccttaagctgataagcaacttcagcaaaatctcaggatacaaaatcaatgtgcaaaaatcacaagcattcctatacacaaacaattgaaaagcagagggccaaattatgaatgaactcccattacaactgctacaaagagaataaagtacctaggaatacagctagcaggagatgtgaaggacctcttcaaggaaaactacaaaccgctgctcaaggaaataagagaagacacaaacaaatggaaaaacattccatcctcatggataggaaggatcaatattgtgaaaatggccatactgcccaaagtaatttatagattcaatggtatttccatcaaactaccatttacattcttcacagaattagaaaagctactttaaaattcatatggaaccataaaaaaagcccacatagccaagacaatactaagcaaaaagaacaaagctgaggcatcctgctacctgacttcaaactatactacaaggctgcagtaaccaaaacagcatggtactggtaccaaaacaaacatatagaccaatgtaacagaatagagacctcagaaatgaaaccacacatctataaccgtctgattttctacaaacctggcaaaaaaaagaaggaatggggaaaggagtccctatttattacatggtgctgggaaaattggctagccatatgcagaaaactgaaactggaccccttccttacaccttatacaaaaatatactcaagatggattaaagtcttaaatgtaaaacccaaaaccataagaacccctgaggaaaacctagataatacccttcaggacataggcatgggcaaagattttattctgaaattgccaagaggaattgcaacaaaagataaaattgacaaatagtatctaattaaaccaaagaactgcacagcgaaagaaactatcatcagagcaaaaaggcaatccattgaatgggagaaaatttttgcagtccacccatctgacaaaggtctaatattcagaatttataaggaatttaaacaaatttacgagaaagaaacaatcccatgaaaaagtgcttaaaggatatgaacagacccttctcaaaagaagacatttatgtggccaacaaacatatgaaaaaaagctcaacatcactgatcattagagaaatgcaaatcaaaaccacaatgagatactatctcatgccagtctgaatggcgattattaaaaagtcaagaaacaacagatgctgctgtggctgtggagaaataggaacgcttttacattgttggcgggaatgtaaattagttcaatcattgtggaagactgtgtgacaattcctcaagaatctagaaccagaaataccattttacccagcaattccattactgggtatatacccaaaggaatataatttattgtattataaaaatacatgcacacatatgtttattgcagcactattcacaatagcaaagacatggaaccagcccaaatgcctatcagtgatagactggataaagaaaatgtggtacatatacaatatggaatactatgcagccacaaaaagaatgagatgatgttttttgcagggacatggatgaagctgaaagccatcatccacagcaaactaacacaggaatagaaaaccaatcaccgcatgttctcattcataagtgggagttgaataatgagaacacatggacacagggaggggaacaacacacaccagggtctttgatgggaggtaaaggaagggagagcatcaggacaaatagctaatgtgtgcagggcttaaaacctaggtgatgggttgataggtgcagcataccaccatgtcacacgaatacctatgtagcaaacctgcaccttctatacttgtattctggaccttaaaataaaaacaaaacaaaaacagtaaaaaagaaagaaaaaagctcattattgttctgttgagggtttcaatttcttcctggttcaatcttgggaagttgtgcatttctagtaatttatccatttcttatatattttctggtttgtttccatagaggtgttcataatagtctcttaggatattttgtatttctgtagggttggttgtaaaactacctttgtcatttctgattgcgttatttagatcttctcttttttttctctttgttaacctagctagcaatgtatcaatcatgtttattctttaaagaaccaactctgggtttcaatgattttattttttccctttccctttcccttcccttcccttccctcccctcccctccccctcccccctcccctcccctccccctctcccctcccctcccctcccctcccctccctttcccttcccttcccttcccttccttcccttcacagagtattgctctgttattcaggttggatggagtgcagtggcaagatcttggctcactgcaacctctgcctccctcgttcaagcaattctcatgcctcagcttcctgagtagctgggattacaagcacatatcaccacacctggctaatttttgtatttttagtagagacaaggtttctccagatttgccaggatggtctcaaactcctggcctcaagtaatctgcctgtcttggcctcccaaagtgctggggttacagacctgagcaaccgtaactggactttcattgatttttttttttttttgatgtatgttctcattttcaattttgttcagttctgctctgattttggatactttttttttttctgctagctttgggggcagattgctcttgtttttctagttccttcagctgtgatgttaggttgttaatttgagatctttctaacttctcgatggtagatgtttaacactataaactctctgcttaacattacttaagctgtgtcccaaagataccaagtatgttgtgtttctctcttcatttatttcaaataatttttaaaatttctgcattaattttcttgtttgcccaaaagtcattcaggagcaaattgtttaatttctgtgtaattgtttggttttgagagatcttggtattgatttatatttttattgcttggtatgatttcaatttttgtggattatttgagacttactttatgaccaagcatgtgattgatcttagagtaagttctgtgtgcagatgagaagagtgtatgttctgttgctgttgggtggtgtattctgttgatgtctattcgatccaacggatccagtgctgagtttaagtgcagaacttctttgttagttttctgccttaatattttgtgaaatgctgtcagggggatgttgaagtccctcactattcttgtatggctttctaaacctttttgtagatctagaaaaacttcttttttatgtatctagtgctccaatgtcaggtatgtataaattgagagcagttacatcttcttgctgaatagaagcaatggttatttcttagtctttatttttttcgaccaatcagcagcatttggcatagctgatcagtctctcctgtataaaatatttcctcatttggctacaggataccacaggctttctttaactcttgctaatgtagttactgcttctgttttttttttttccaatacctcctgatctgtctctggaaattagctccatggtgctgtctttgaactttgtttttctagatacattattgcctatctcatctagtcttatggtttattattatatctttaaaaatagctaaaagagatgattttaaatgttcttgagtaaagaaataataaatatttgagttaatggaaatgttaattaacctgatttgatcattccacaatgtatgcatatatcaaaacattacattttaccctatatatagatacagttgtatttgttaaaagtaaaaatagtaacataataattatatattgttaattactcccagtatctatctcggctttatacttcttcagtgaactccagattcaattatttgactacttacttgatagttccacatgaagatacttactagaagtctcatatttaacatgttcctaatggactcctgatcacattcccaataccatctgcattattctagtttttcagaacaaaaccttggagtcattttgccatctttttttgttacttttctttcccctcaaatccagtgaattattaaatctcatgtttctctctttaaagtatatccagaattgggcctcgacccctgctactattctatttaaaaccatcatcatgttgtgtggatgactgtaatagtcttctaactggtctccttacttctgcttatttgccctgaagattattctatgaaaatattggtctgatgctgtcacttatttgttctaactctctgatgatgtctcatttctatgacaccatctgtaactacattcacactcactccaggcacattgtcccctagctgttctttgtataaacaaaggatactttggcctcagggtctctgcattttttcctaactctgtctggaataacatttatgtgaaaatacatgttacttctactttatatctttatttacctattcaatgaaattttccatgtcatccaatttacattttgttaccatcagtctttcacacccaggcttaatttattgttatctaaaatgctagaaaactaagaattttgtcttttgtttactgctgtatcccagtgcctagaagagtgtctgtcagatagtagacactaagtatttgttgagtgaacacatacacagccacacatgctactatctgatacaaaggagtcacagagtctgttccagtgttaagaaagtctgaactctctgatgcaccatttcagtgaatttcaaccaattacttaattgctaagacatagtgaaattaccatcatcaaaaaatgctgttatatgaatcctatacattcatattaattttattgtttataaatgtgtataatattaaattcataactcaaacattatttctatttatctttgataattcttattccagaagtatttgtttcatgcatataataagaaatcagctgtttgtattctgattcttcacattttaaagcaagacttagctgtctttgacatttgtcacatgcttctctcttgagctagacatattactcaagattgatatttttttccatgttgagtatttagttcaaatattttattgcatttatttgaccactacttcaatttgactgtcatagatagaaggtgcatgtgacagtgataaaacccaggcacaagagagtacttgttgggccataggtggaaaagagtacagagagttttcacaacttttttcttcctgtaaatgtatattaataattctgtatgattgacattattgttattagcaaatctttgagagagctgagagaaagagaaagaaagagagaataactgcaatggcaagaattaaatcatgagactggaatattctagaagctaaatgaagaaagtaattcatggagtagacacttaccagctatgccaaatgctgcaaataggatcaacaaaagtgaagattaaaaaacagcctttggcattaaaaaatataaggaccactgatgatctcttaaaagtaaacatttttattgctgttgtagagtcatgaaaggccatgaagtttgtaaggcttaattaattagggtggtcatgaattaagtgagaataattttctccagccttgttcaaatacatggttgcaggcagacaaggggcagttgttataaatatgtattttaaaagatgcaggcagagaaaaggctatttgatttcatttgcatgaaattgtgaaaaaaaaggaaagcaaaccaggaaagagaaagcagagatttattgttgcctggagctgtgggtgagaacagagattaactgaaatgacataaagctcttatttggaaaacaaaatgttctaaaactgatacatggttgatggctgcaaaagtgcataaagttatttaaaaaattgaattttacatgtcagtgaattttatgatatgtaaaatatactaaagtttttaaaaaataaacacatacgatttacacattataaatattaataagtatgcaactagcttaatttctcaccaataaccacttgtataactatattcaatttcacattagacataatatataacttgttctttatttcaatggcttatactcagttggagatttataaatatgtagcttatttctttaaaatgcaaaattctcacagatccaatatacaagacctgatgaatcctaagtggaaaataaatcaataaaacaactatacattttactgcatttgtgaatttaaatatggtacaaaaactttaaaaaggaaaatctaagcttgaagaaaaaataatatcttattgttagaaggtacaaacagatgataagtagaaggaataaattaaatgcttgatagcagagtaggatgactatatttaatgaaatgttacgtaatcaggtgatgggcaccctaaataccctcgcttgataattatatattacacacatggagtgaaatttcaaaaaaaacatgcaccctatacatttgtacaaatataaatataaataaaataaaaatgaaaataaacacaagaagtaaaaatgctttaaaattacaacttgtaaaatcaatattattggtcatttaccttctctgaaatttcatcctcattttaccctaccttctgtggaactggggtatgcaagaatattcctttagaatctgcagttgaaaaatattttttgattttatgttgtttgtatcaacaatcatctcagtcaagcaatgcttattaatcctgagtcaatggtggggtcaaaatataggaaaagttatttatgagtgtccactctccagtgtgatatacactttcacgacattatcaatggcacattgaaaatgactgagatacaaaatatcaaacaaaaaaatcagtcactgcagttccacaggatagtccagttcctcttctgaatcacactggagcccgtttctcctcagattgaaggcagtgcacccccacctctattctccatcatagagtggggagaccctgaaagtcttgctgcatgtgggtagctaagaccctgggccctgagctcagatatctcctctgctaatgtccttggctcacctggcctggtctgagacagtgtgacacatgggaggcaccagcatgggatctgggaaaggggttgtagagggtctcagagatacagggaattgttctccaggaatagtccaaccctcttctgagaaaaggaaaataaattttaggctactatgggcttaggtgggcttgtagccttccatgctcagcaaggaaggcaaagagaaagaacatggctttgccagagtgcaggaagcacagccaaggacaaaggccccctgaggttcatggcagctcttggtcactgggccaaagggccacttcagagtatagtgtgctgtccaaggaccctcgaggtgacaaccgaggttgctttctgcctgagttggctcagcattatggaatccaagggcttgggaagcttcaacagggcagggagaggaaacactagacacaagcacacacaatggagcacaactgctttgttgtggggaagcttaaattgtttaaaccctttagtagtgacgtaaaggcaaataagcatcatttgccctcatagtgaggttcttgaaaatgtctctgcatcacagttttttttttttgtggtaggatttatttattgtggagaaacaggaaaatagaaatattaattatcattactagcaattagtactaacaacttcttatgtaccactgctgacttaaatgtttaatatctttgcaaataaaaacaaatcaagaaaatgggactttatcctgataattccatcaaaaacacttttattcaactatgcatctttttaaaaatactagattagaatcagtggaggaaagggaaagaaaagctttaaaatgcaacctgattgtgttgtgtaaatagtgattctaagcactactgaagaacctgtggagatcagaaaggtagcaaggcgagggcagagaggaaaagtgacaccactgtaaaaggaagagtatgcatctgccttcctgaactttgacaaatatcttaaactgcacatgtccagaactaactcatctttttttttttttttttttttttttttgagatggagtcttgcactgtcacccgggctggggtgcagtggtgtgatctcggctcactgcaacctctgcttcctgggttcaagcaattctcctgcctcagtctcccgagtaactgggattacaggctcccaccaccactcctggcaatttttttgtatttgtagtacagatggggtttcactatgttggccaggctggtcttgaactcctgaccttgtgatccacccaccttggcctcccaatgtgctgggattacaggtgtaagccatagtgcccagccctaactcatcttttatcccatcccttacctaaaaccccagtacaccatgttacagggatgaactgtgttgacagtttgaaaataaaactctagtcaggactaaaactcaggcctactagagactggtacatctgggcaatagaaatcatgagaaagaggtaggacagtgagcatgatggtccaaaattgccctcattgccatgaggttgagataaatctagtagaaccatcccaatttgcattttaaacagccttattaagatataattcacataccacaaaagtcacccacttaaagcataagactaaatgatttttagtatgttcactggtatgtgtgatataagtttcatcttattatgaagaaactctataccctttagccatcaccctcccatacacaagttctttatcccacacctctactccctaaacaaccattaaactaagagctgcccccgttctggacgtatcatacaaataaatacacatgtaaatatctggtgtttgtgactggctttatttactatacataatggtttcaaggatcaaccatgtcgagtaaaagtgtcaatgcttcattcctttttagggctgaataatattccattgtttggatataccgcattttgtttatccattcttcagttgatggacatttggaataggaaaccctggacctctatgatgaggttcctctacctctgtcccaggagcatcttggtttgtgatggagactctgtaggtcctaattggattccaggtgggctggtggatccctaatccatgtgtaatgctctgtgatgtgtagaaatgcacccatcttagcaagagggggaggggaggggagactgaggcaagaaaatcttacccagaaaagcccagcttcagggaagacagagtggcaagtttaggttttcccaaaggacagagaaatattctagaacagtttatacagggccaaggaagcataatacctgatggtacaggtgtctatgacccacagctcagtttgaacaattcatttaaggtaggatttaggctaatgactaatgtgactgtggagctgaccttactcagcaatacctcctctctcaatattccaaaacttagaatgaagaggacaaggggataattaacgattaaaagggggtgggctgcaggtttcctctcttgggatgagagcagtcagcatgccatgggcatctgagagtgggcaggagcagtggacaatggaagtgatatggactgcagaaagggaaacacagggtggaagagggtggttccccagaaaaggcccgccctcaagcctggataccatggccctaaatgagaacaggaattcccgttttcatgcccaaaaagttgccttttggcccaccatgacccctatcttgtactcacataaaccttgaactctagcatccagaagcagacaagcagatgaggaggcaaaacaagcagacgggcagcagaatgacatggcagagaaagagagaagaggaggaaagtctgaacactgagaggagtttggctggggtcagttggagaggagtctggccacttgatggctcaactccaggggaaggtcatcttcccactccgttcccctcttccagctcctcatccatcccacttattgctacctccaccactcaataaaacctttcattcatcctgacagagcaggagcatcacgatcttggacaagcacggtcattttaaagttcaccttgatcaaaaactgcctaaatccaaagggcatcagcctaatgggtaaggtcagcatgaccataaaccacaaataacatctccgactagaaacattccaaacttctccctgaccacagacatatcagccccaagataacctcccctctggctggagagatgtcagcctcaagataacctcctctctgaccagagacattccaaccctgccataaacttctcccctacacagaaacattccaagcttgtgttaagctctctcaccctaaaaaaccaataaagactcttagtccataagagagagcgctcctgaccgaaatcatccagaagcctctctcaggttcattctccaaaatatatctgtctttgactgttgggccactttttgtgtttctttcctctttctttaactcttacacatcctttaagcccatgtgtgacccaattcttctgggcaggagctggaatacagaaagcagtcacattgtccctctgcccttgcgaaaaggcagagggtctactgagctggttaacataagccatatgtgaacggcaaagtggaaagagctttgtaacactggggttgcaggcacccaccccctagacactaccatgggtctggaacccaaagcactcaacctggctcctgcacctccctgtctgagtggtccccctcccattaggggtttgagcagtggtggcattgaataggcaagccacacccctgtcacacctcctgtgaagagatccaggaactctcctgtttcagctggggtcctgtccagaatacaaagaaaggtgagttaaaaagcaaaactgtcagatctgcctcttctccaagactctgccacctctctctttcctgctctgtttctctccggggaggtctagccaccacatgggactggagtaaagccatggggcaacgaaaagctttttttttttttttttttttttttttttgctgaaaggctccaggactgaattccgtaggccaagaccgcagacttcctttggtgtcttttcttctctcagtttaaaatggctcttatctcttcctttataacgtcaaaggctttgctacaggctgcggcaataatattaaatagaatgagcatttggctcagccatcaaagatgcaaatcagaacaaatacttcccatttgttcttaaatgtgccatccccagcctgacagccacaggcacgtgtggcccacagcacatcctctccttactccctcctgtcctgactcaggcacctagaggtgtccacagcatgcacaagagggacaggaaaagactgtggctgccacagggacccagcacagccagctacctgcccattgtgccaaaagaacatttcctccccagccaaggaatttagccaggtctgaaccagaggaagaatacaaggattaaagggacccactttgcactgagcaaggggttcttcctccaggaccttcctctttcgcctcataagctgttttttcttttttacattttctaagagagggttcctacccccagcactctgcttataatagagaaaataatggaagagtgacccctactggctgattactgaaaattcagcagggctcatttgagacaatctaaacagatacagcccctgaaatactttgtctcaaactcgattcgaagcgtcaggctgaagtcttagcaaggaaaatcagatttgagggatccaaagccaggcaacaggcacaatgtaaatgggcaggaccaattcctgccaactaaaccacccccacctcatgaaaggaggccatgttccatggcataatgaggcccagggaactcaaagtttgccaatagttgggaagatggaggcataggtgagagtggataattcctattctctaggccttccctgcttcaagggtgcatggtgcattagcacccatggtggcacctgctaaggttgccagaacttgaggacaaaaagatggaagagaaagggaggatgtttgctttctctctcacaccctgggttttcactgaaagaaagaatagagttgagggatgcctctattccctgtctttcagaacgggcaaccagctctctttaccacccccagcttatactcctctggagtgtattctgaaccactggaactgctttgacactcagaatgtggaggaaaaatgcctcatagccctctgcataaatttttggccaacttatggactggaagaccattcatttcaataccatcaggcagttggaccttttctgtagacatgaggacagatggtgtgaggccccatatgggcaggctttctataccttgaaaggcaatccagacctttgctaacagtgtaggattgatccagccctcctgtttgttgtctcaggaaaggctgcaaggggtgagccaagggaactaaagatacaaatcctagaggcacccccagaagaagagccagctccctccagccctgctcctccaggtccacctcaatctccctatccaacttcagcctctcacttaccccctcctagaaatcctcacctgagacaagccccagtctcactcttgcccttccaacagatgcctcagatgcctggtgaatttgaccccagtaaagtccagatccccttctctctacaggagttaaagcaaattaagggggatcttggcaagttttcagatgaccctgtccaatatatagaggctttccagaatttcatccaagtatttgaactcttctggagagacattgttacttttgaatcagaccctgacagacactgagaagcaggctgctctgcaagcagcagagatttggggatgagctttgtatcacatacagcatcagggaagagggcgaaaattatccaactggaagagagacagtactaatgaattaccctggatgggatcccaatggtgagatgagagactggaagaggagacagtttcaggtttgcataatggagggcgtgtgtaggaccaggaccaagcctctcaattacactaagttatccatgattgaccagggagttgatgaaaatcccactgccttcttggaaaggcttagagaggccttggtaaagcatctctttacctcctgattcagttgtggaacaactaatcctggaggataagtttattattcaggcagcccctgatatcaggaggaagctgcaaaaaacaggccctgggaccagatagtactttacataacctcctgaaagtagccatctcagtcttttataatagagacagggaggcccaggaaagacaggggaaatacaggaaagagacaagggctttaatatccaccaggcaagcccacaaaccccagaattcccagggtgtacctgttaactgctacagatgtggcaagacaagcagaccagcagatgaggggtttgagcggtgggtgaccgaacaggtgagccactcccctgccgcatgtcctgtgagggagatcagtgatctctcttgtttcagaaggctataaagcttatgatgtaacaacttccaaagttacaaagacacaaagccgctcatctcccactaaaggatcatggagggtagaagaatcaatagacacaagcttgtatgcttttagtcatatgatttatttttttctgtgaagttgaaagttttaagttaatggtgagtttcttggtaatatcctttcttcatccgatggctttgattttatcacttggttactgttgcagaggaaatgcagaaaaataaaaatgttaaatcttcattgttaataaaagctgttatttactattcaactattagtagaacacttaattagtataatgagacactgattatactggtgaagtctgtgtctgtgattcaggaagtttataaatctaaatttattttccataaatggattgtaattgctacattaaaagggaatattacaaattgatatttatatttttaatttacatagtctctaaactttacatggataaatgaaaatcatcaacaaagagacagaagaaaaatataaaggaaaaccacaaaaaggaaacagaaaaaaacagcaatataaatatgtgaaaaaataataaagaattactatacatttttctctatgtatctgaggaggaaaagaacttccaaaaaccctctgtgcatttccagtgggttcttaaatacacttgttcaaagacaaactaactcttcactcccctccacttcctcaccccaaaccaaaccagttatttctctactacacaatgtgtcactggtaaaaggtgtcactatccattctgtcagaagagtggaggtttttttagttctctcttttattctaacccataaacgtccatccagtcactactctaacagattgggcctctgtcatacctctgaaaatgtttttgtgcttttcctcctctccaatcctgtcctcatcacacctttcttgtgcattcagcagtctcttaactgcttcactactttccatttgtgactgaatctactttccctattttatcccagtgaaatttgtaaactgcaagacatatagtaccaaatccctttcttaccatcttaaaaagtaccttacctatgttcttagtcatatagaagaatatttaaactccttattgtggcatacaagatacttattttggcttatagttacctacatggattttacatctcagcattcataaacttgcaaattcccacactttgggaggccaaggcaggtggatcatgaggtcaggatatcgagaccatcctggccaacgtggtgaaaccccatctctaccaaaaatgcaaaaattagctgagcatggtggtgtgtgcctgtagtctcagctacttgggaggctgaggcaggagaatcgcttgaacccaggtggcagaggttgcaagtgagccgagatcacaccactgcactccagtctgggcaacagagtgagactccatctcaaggaaaaaaaaaaaaagccaaaattttgtaaataaggaagggtggttttactttttagccttgctattttcctgctgtatatcaatagccatattatttaagcattttttcttacattctgcatccaaactgtcagtacattctgttgtgttaccttcaaaatgtatccataagaccatccttaccacccctggtctgaagcgccatcttttctctcctggattactgcagtagtttctccacatctactcttgccatcatatagactgttttcaacaaagcagctttttaaagggtaagtcacatgcttagaatctgcaccatccagtgattcctccctttcactcaaagtaaaagacagatggcctccaagagtgccaagaccctccatgggtgttacttctctggccttatcacaactgcaaccctcttggtaactctgctccagatagaatgacatccctgatatttctccaacatttctgacttattttagcatcatatcatatatatgttttgaaagctgctgtgaagatatttgcatggataatgccagtatatgcctgtgtgggatagatttgatgtgcagctggaatggaaaagctctatctttatctctgggaaagcctggatgtctggttttgactttttcccaggataaggggagtagtatttatgatgagccatttacaatttaaaataagaaagcttgggccatagcatctctctaattcccaatgcttagtggcagataaggaaacagagacccactgacttaactataaacaaagtcagatatgagggaatggcagctaagtaattagatgaactgttgatctccactcttggttgaagttttgaattttccatttactcccagtgataggcctaacacatcaaatataattatttctttacacatatgaattagaactttgaacaatatatatgaatgtatatttatcccatcttaaagattaaaaaaaaagtatcgttctgcctttgaagaaaggtgcatttaacattttgcctggcatctcatgtgtctcaatcaatgtaaattccattcccaatccccagtcatatatcaggctatatttgttccagattgtggcaatcttaagagtttaaattctgaagtcggattgtcttaagttaaactccactacaatactcactaaaattctattttcctggggaatcaatttatttccttttatccatttcctcatctctaaaatatgggtaacaatacctatgacattttagtaaggatcaatcatcgtaaatgtggagagacaatctgtgtaaatcgcccaatgagaaccttacataaggccagaggagataatgattgtttatgaatattttacaaaaatatttataatctctttaacatcattccttattacaaaaatgttgttcaataaatctctggctaaatattagttaacattaaatatttctaaataagtataaaacataattaacatcaaatatattttcttatctttgttttactatatagtattaatacataggagtcaagatgatgaaatatgggaataatagttttctcatactgaggtattgttaaaagtaaaaaaatactccatgagtattatttcttaacaatttattttacgtcacctttaactctgtgactggctgctgttactaccgctgtcttctgagatagatctgtataaaagagataacattaggaaacactgtaatcttgagcgaaatcaagaaaagtttaaaaagctacatttgcactaattaatcaattaatatgtatcaagtggccaagtgcaagcagagcagtcaatttggaaacaatggacatagacaagaaggggtgatgtcaattataaagacttcgagtgacaaagagattgacctagttcctgatcatctggttcattgctattttgcttcagccctacttcatttcttaccctggcagccctgaaaccacttactgttataaaacttaggctgttgtgaccagattttgtcagttttaatcaatgatcccagttattctttcttttgaattatcaaatccctacatattcataaagcaaattatggtttgatgtggtgttagagttaaaaaaaaaagctgtgcaagtaccttacttataatttcagaaaaacatgagccatattaattatgcacaaaatacaaagtatcctatctgagttctctccctcattctgtaccatctccaatttttcttaccttctacatattctattcacaaaattttcttccctgactatttctgtggacctttttggcacaactggttgtcaatgcaagagaaatggggttccttgggaagtcaacagaacttcctaaacaattgtagaaaacttggctttctatgtgaaaggcaatgaggctttactgaatagctttaattgttcttggccctgtaagaacaggcaggatacttagatgattgaaataaaataaaaacataaagaaataaaaaaattaaaactttgctatatgctgagaacttactcaatatttcttgtctcactctgttgcccaggctggagtgcagtggcatgatctcggctcactgcaacctctggcttctgggttcaagcaattctcctgcctcagcctcccgagtagctgagatagctgggactacaggcacatgccaccacgcccggccgactttttgtattttagtagagacggggtttcaccgtgttgcccaggctggtctcaaactcctgagctcaggcaatctgcccgcctcggcctcccaaagtggcgggattacaggcgtgagcttactcaatatttctaaacattaatccaaaccatcctagagtctcttcttggattctgaattgcactgaattcttcccacaatgaattttaatattaaattaaaaataatacatttacttacctgctgcttactgttcccactttgctccgaaatctcttcattttattccatttaagactaacaatagcaattaaaatgagcaaaggtgaaaaaatgtagaaactgatcaaaagaccattgtttttaggagcagcacgtcgttttggaagcaagggtacacttttttctgaaaacatgagagtacatttttaactatttgaaaaatgatgaaatcataccagaatttgaattatagaaatttagaactcaacacagttaaagaatgaatatatttgaatttaaaagtgtttttagccttctctgactgggccccaaagtgcattatacattgtgtatgtcaactcaatacacttatacatataattgacaatacacagtcattggcaatatgtaatattgtcatgaatgtacttattttattgacagtaaaatttttattcacataaaatacatatttattgacataaatttacttataatcccttcatgtatacttaatatttacttatatgatataatctattttagtgtatcatatttctttttgtgaactgcattaagtacattcacattgatgtgcaaccatcaccaccaccctgcttcagaactttctcattctgcaaaacggaaatattttacccattcaatattaacccaccatttttccctctccccagaggagccaccattattctactttgactccatgaatctgactaacctaggtactaatggaagcagaactcagcaccggcaaccaccattctactttgagtctgagtttgactgctctaggtacctcatagaagcagaattgtataatatttgtcatgttctgactggcttatttcacttaatcataaggttttcagtttatatctacattgtagggtgtgacaggattgttcatttcaagggtgaataatcttccattgtatttctacaccttattatggttatccatttatttgtcaataaacatttgggttttccatgttttggctattgtaaacaatgctgctataagcatgggtatacaaatatctgctcgagtctctgcttttaatttttttgggcatatacgtagatgtggaactcctggataatatgctaattctgtgtttaatatttttagcaaccagcatgatgttttccacaaagactgcattattttacattttcaccagcaatgcaaagagttccaattttttcatatcctggtcaacactcgatatgctttgaatttttctttgtaatagccatcctaataggtacaaattggtatttcattatggtttttacttgtaattccccaaggattagtaatattaatatgtgaaaaacacaactttttctgtgcttactagcccactccacagctttacatttcctcaaagatgtattaaaagtatgcaactactttgcccatttttaatgaaattatttgttttgttgttgttattgacttgtaagagttctttatatattcctaatattaatccctcattatatagattattttcaatatttttgcccattctatggattatcttttcactcttgatagtatcctttgatgcacaacagtttgtaatcatgatggatcctaatttatctgtttttttcatttactgatggtgcttttggagtcatatcaaagaaatcattgccaaattccatgttattacaatttcctattatgtcttctgttttaagggtctataatattagttcttgcatttagattgttgatccattttgagttaattttggtatatggtatcaacaaaggccctacctcattctcttgcatgcaaatacccagatatctcaacatgatacattgaaaagactgaacttcctccagtaaatggtctaggcattcttgaaaatcattagaccatacatgcgaagatttatttctgggatccattttttattcctctggaaaatttcagctttcttatatttttgtccaatgtgatatatcaactgtcaagaaagtacaacaaagtcctggagacttctgtctttctgtcatagcttttgttgaacacatttgagaattcagcctttttttttaactgcttgtaataatatgaggaagactattgatgaaacaaaatattatacaattattaatctgacaaatgcaaagaaacataaagcaacagtttagcctgtaatgattatcttagtctgttcaggctgttgtaacaaaaatatcataaactgggtggcttacaaacaacagaaatgtatgtttcatcgttctggaggcaggcaattccaaaatagaggcactggcagatttattctccgggcctatttcctggttcataataatcttctcgttctaatcttacatagtggaagggatgaaggatctctcttggttttcttttattagaacactaatcccattcaagaaggctctgccttcataacctaattagataccaaaaactccacctccaggtgccatcacattatgaattaggttacatgacaaaaatgttgaggaatgcaaacatttagtctacaaaaatgttgcagttgaccatataaatgaaatatcagactacaaatctttagatgatgatatcctaatttttttcaagtgaagaatcagtgagtcaatgatatatttcaaaagacaaaatggatacatagaattctcatccagtaatcatataataggaaggacttcagcaagcaatatttttcataaatacctgggatttcttggactgtaaataagatctagaataaatagtattccagcttctatggaagatgttcatgaacatttattggatattgttcacaagtggacacagtgaagttaaatatttatgcagagttgattgaatggagtcagtgtaggagtttaaaaactgagtaattattttagatgtttattaaaatgaactgaaaatattttaattatagtacaaacaggataacatcaggaaaactgtgaccatcaaagttgtcttttgaagatgtaaatgcacacacaaaaaaagaatcacaaagtatagtcacctctaacctactagagatgtacttcaaatgttccttgcagtcatagaaaggatatgttctagatccatgtttgacagcaggaactgtattcaaaacacatagaacactttagttatatacccttcaaagactagagtaaatactgagctttctatatttaaaatttttattgaaatttttcataaagctgatttcactacttttatttctacttttatatatttcctgtaatatgttttttatataaaaaatagttttgggcctacaagttataggtaactaataagggttaatttcaggcaaaatagaattcaagagaaagataaacattacagaaataataaaagcaacaatgcaccagaaataaatctaaactacacatacaataatgaagaaacaaactaactgataaaatgaaaaaaagtacataattatgattagaatttttaaaaactcctctcttagtaattgatagaagtaaaaagaaatcagttggtcagttccatgaaaaagcataagctactttaactcatctaatatgaaatagataacattattgtttacatatttattaagaaaatatttatttaagaaaaatctttattttaaaagctccccacagaataaatctccagacccatatgaattcactggacattattactaaatattttttaatgctaattttaagcaatcacttctagaatacagaagaggagtaaacacttcccaattcattttatgatatcagttttagttgacaacaaaacaagacaaaaacaagtacaaggaagagagagagagagagacagagacagagacagagagagaggcaggcaatatctctcaccaacctagacacaaaaatcctcaacagaatattaacaaatcaaatttagtaaagtacaaaaattaataaataatgatgaagaatttattctatactttcaaaattggttcaaaattaaaaatcaatgtaattgatcatatcagtggactacaaggttcatacattcctatcaaccgatactaaaaagcatttgaaaaattaatactgttaataacaaaacatctcaatgaatacatattaaaggaagttcctcaaactaataaatactatctacaagagccctacagctaccatcatacttaatggtgaaatactaaattcttttctgctaaaataattattaaggagagttgtttacaactcttattcagcataggcctggaaagtctaggaagtgcaataaaataataaaagttatacatattggaaaggaagaaagaaagctgttatcttcaaagctatttgaagagggcataatcacttacgtagaaatcccaaagaacttgcaaaaacaaaaaaaaattctcagaaaaccgaattcaattatattgggaaatacaggattgatgtgcaaaaatcaatggtatatttgcatattaacaaggaacaaggggaaataaaaacataaaaaacacccaacatcacctaaaattgctctaaagataatgaaataaaaatgaaataataaatgcataggatatggtaaaaattacaatagcctgatgaaagaaatcaaagtagatttctttgatttctttcatcagactattgaagaatcaaagcagatttctttgatttctttcaaatggagagatatgctgtgttcatagactgaaagacccaataataatgaagatgcaaattcttcctaaattgatttgtaaaaatcacagcaagatttttaaataaagatagatgaactcatgctagtatgtatgcatatagagaaagaagagctctgagaatagttgtagcaattttgaaaaaaaaaaagaattaagtgacaggaattcctttttttcccccaatgttaaagaatgtggtacttgtgtatggaataagacaaatcaatggaaccgaacagagacctagtaaaataccaacaaaaatatgtttaattaatttttgacaaagttgcaaaaacaattcaatagatgagagataccttttctaaaaaattgtgctagaatttttgtagtttcaggtcttggatttaaggccttgatccattttgagttgatttttgtataaggtgagagatgaggacccagttttattctcctaccatgtggcttgccaattatcccagcaccatttgttgagcagggtgtcctctccccactttatgtttttgtttgctttgtcgaagaccagttggctgtaggtatttgggtttatttctgggttctctattctgtttcactggtctatgtgtctatttttatactagtaccatgttatttcagtgactatggccttatagtatagcttgaaatcaggtaatgtgatgcctccagatttgttctttttgcttagtcttgctttggctatgcaggctctcttttggttccatatgaactttaggattattttcggtgaagaatgatggtggtattttgagggaaattgcgttgaatttgtagattgcttttggcagtatggtcattttgacaatattgattctacccatccatgagcatgggatgtatttccatttgtttgtgtcctctatgatctctttcagcagtgttttgtagttttccttgaactccttggttaggtatattcctaagtattttattttattttttgcaggtttgtaaaggacttgagttcttgattttattctcatcttggttgctgttggtgtaaaggagagctactgatctgtgtacattaaaaagaactcattatatgaaaaagatacttgcacacacatgtttataacggcacaacttggaattgcaaaaatgtggaacaaatcccaatgcccatcaatcaatgagtggataaagaaactgtgagataaagaaactgtgagataaagaaactgtgtgatgacatatatatttatgatgaaacactgctcagccattaaaaggaatgaattaatggcatttgcagcaacctggatgggattggagactattattctaagtgaagtaactcaaggatggaaaaccaaacatcgtctgttctcactcataaatgggagctaaactacgaggatgcaaaggcataagaaaaatgcaatggactttggggactcaggggaaaaggatgggaagggggtgaggaataaaagactacaaattgggttcagtgtatactgctcaggtgatgggtgcaccaaaatcttacaaatcaccactgaaaaacttactcacgtaaccaaataccacgtttccccaaaaagctatggaaataaaaaattttaaaaaatatgctagagtaattgaacacccatttatcaaaaatttaactttgatatatatctctcatcctatataaaattactttaaagtgtattatgggcttaaatggaaaccataatgctatactttttaaatcttcaggttctaatactcataaagaggtcatatacttgacaccagaagcacaatccagtacctaaaaaagtgcaccttatcaagtaaaagtcatataaagagaaattttattctgagaaaaaacaaattatagacttggagaaaatgtgtacaaatcacacatccaacaaaatacatgtatttgtaaaacataacatctttcataaacatggcatttttttctttttcccttttcaatttctttcatcagtgtttaataatttttattgtagagatctttcacttcttttagtttattcctaggtagttcatcttatttgtagctattgtaaatggaattgctttcttcatttgtttttcagattgttcactgttggcattttgtattctgcatctttactgaatttatcagttctataatgttaaaatacctgtaccacacaaagcaatttacagcttcaatgcaattgttcacagaaatagaaaaaataatcctaaaacgcatatggaatgacgaaagacccagaatagtcaaagtaatcctgagcaaaaagaacaaaactggaggaatcatgttacctgaccttatactacacaaagctatagtaaccaaaatagcatgatgctggaataaaacggatacacagaaaaattgaacagaataaagaacccacaaatgaatccacgtaattaaagtcaatttattttcaataaaggtgtcaagaacatacactggggaaagaacagtcccttcaataaatagtgctgggaaaagtagatagccatatgcagaagaatgatgctagatccctatctcttgccatatacaaaaatcaaataaaaatggattaaagacttaaatctaagaccctaaactgtaaaacaactagaacaaaacactgggtaacctctccaggacattgatttgggcacagatttcttgagtaagacctcagaagctcaggcaatcacagcaaaaattgacaaataggatcacatcaagctaagaagcttctacatagaaaaggaaacaatcaaccaagtgaagggacaacctacagaaccaaagaaaatatttgcaaactacccatctgacaagggattaataaccagaatatgtaaggagctcaaacaactcaataaaaaattaattttaaaatgggcaaaagatcttttagacatttctcaaaagaagacatacgaacggcaaacagctatatgaaaagggactcaacatcactgatcatcagagaaatgcaactaaaaactacaatgaaatattatcttatccctgttaaaatggcttttatccaaaagataggcaataatgtgagaatgtcgagaaaggggagcacttggtacacactgttggtgggaatgtaaattagtacagccactatagagaacagtatggagattcctcaaaaaaactaaaatagaattaccacaagatccagcaatcccactgctgagtatatatctaaaagaaaggaaatcagtgtatcgaagagatatctgctctcctgtgtttatttaaagcagcattattcacagtagccaagatttggaatcaacctaagtgtccatcagtggatgaatggataaaaaaatgtggtacatatacacaaccgactgctattcagccataaaaaggataaaatcctgtcatttgcaacaacatgaatggaatggaggctattatgttaagtgaaataagccaggcacagaaagacagatggtgcctgtctgttttaattcatatgtgggagctaaaaacaacaaaaaaattgaactcatagagagtggaatcatggttgccagagcctgggaagggtagtggggatggggggataaaaagggaatggttaaggttacaaaaatacagtcagaagtaataaggtctggtgttcagtagcacaatagagagactatagttaacattgatttattgtgtattttaaaataacggaaagagtgtgattagaatgtttctaatacaaataaataataaaggcttgagatgatggataccccaattaccatgatctgatcattacacattgcatgtctaacaaaacagcacatgtaccccatgaacatatacaactattatgtacccataataatgaaaaataaaaattaaaaaacataatatctctcaaaactgaacatttaaaaaacacaaacaatccaatgagtaaatggtaaaatgtatgaacagacttttcactaaatagaatatacaaccgaataagcatattaaggatgttcaaaatcattatccgtgaggaggtgcaaatgagatattaataaacagctaatggaatgattaaaattcaagaaaaaacagtggtacaatcagatgttggtgagggtgcaaaaacgtggtaattcatatattgttggtgggactgtcaaacagtacagccattctgaaaaaatatttagcagttgcttttaaaattataagtagtttacaatatgtctcagctatttcagtcttgtgcatatatcccagacaattaaaatattattttcacatagaatcttccacatgaatgttcatctcagttattcataataactaaaactggaaaccacccaaatgtccttcagtggatcaaaggctaaaaaattatggcatatccatacaaatgaaaactagtcatcaataaaaaggaattaagtattggtacatgcaagaacttggatccagttcagggaaattatgctaaagaaaaaaatccagttgcacaaatataaaaaccatatgattttgtttatataacattcataaaaccatgtaattagagagacagagaaccatttaatggttggaaggagagttagagatgagggaaaagaaaaatatctatctacaaaggggtaatgttagacaaccatgtagtgatgatacagctatgcattgtcattgtgatagtagtacataaatctaaactgtgataaaattgcatagaacaaacacacacacaaacacacagacacacaaatgagtgtaaatatactagagaaatctgattaaggtctctgtattttaccaatgtccatttcccagttttgacattgtaggacagatttgcaacattttaacattggtgaaggatgagtgtaggttgatttattcttcttttaatttacttatgtatatatttatttcaactacttttttcatcctaaattaactgaaactactttcttcagtatcatctactaataaagtaccccaaattctaagttgtgggaagaaggaaactcattctaacaacctcttggcatatattttttcttgatcttcagtgtctttaactcctttgctctaagttgccatattaagatattcatacatctagttatatgccacttcagcatatttgacatatgaatccattcctcaagcatttattcaggtatacaattctaatagtaaaataaaggtttagtaaaaacaaatatatttattcaggacttttcatcaaatcaatttaaaaatgttcagtgccacagactactcatatgctgtaggcatgaaaaatttaatgatttttctctttcaatattacagttacctttaaagattgaatttgattgtgaattgggatatcacaataggtgacatccttggaattcacagactatataataaaactgcaacgttttctataatttaagtatacttacatagaaaactctgctgtataaatagaaatattctgggaaccctgcttaaagtgaaggggaggccttttaaaatgttttctaggtgagaactaaaactatacagaaaattttggttggcagaaagattcagagctgtctggctctagatccaatttagtagccactagtcacagtagtcatttaaatttaaattaaataaggtaaaatacagttgaaatttcagttccttagtttcactatccacatgttgggtgtttgatagttatacaggatggcaaagatgtagaccatttctatgagaacagaaagctgcattgaaacacagatctagagactaacctactgtaagccaaaatccatcattgatacttcctcctggtgatgacattgctggctcacaatctggaggagcataaccaggatcacattgacaatggaaatgttcattgcaaatctaaaaccaaaacaaacaaaaaaagcatttatgtacaaccaaaaattcactgccttatatgtgattgttagtcaatgtaaattttaaaaatattaccatttaatataaattttaaatttaatatgaaaaataattttaaaaataaaaggcagtataataaatgtccatgcaatatattttcaaacatcatagaggtatcttcttgtttgtctcttacatttctaaataaagtgaataccattcttgatacaatttaaatgctttttattagaagggcgtacagattatgatgctagaaactatagaatggtgggagtaaaaatttattataaattgtgttggatttaaaaaaatagttgtgatgagggccaaattttatttaaaaaaatagggggggaaagccaaaattttaagatgcttgctcaatcagatacagacacaaaaaatttatatagaaagctagaaaaaatgtataaatgtgatctggcagacgaatggaaaaagggccagtagagaattcagaaataaatgcatacaaaattgattacgaaagtaaattaaaattaagaaagaaaagaaactgtaaataatagatgtgtaagtaattttgaggaaaaattgatgtaagccacacaggcaggccactttttcctgaattactataaaaaatatgaatcatcaatatggcagaagacactgaccacaaagagacaaatgcatgcttagaatgacttataaagtttacaacatttctataagccagtagataagtttacaatagatgagcaaacagaaatgcaagtggcagatatgaccatatatacttaggaactgtattattaattagcaaataaatgcaaattaataatggacttagcatgttaaaagagactaaaaagattaatacaactaatctggccagaatatgaggaaatgcacattttcacacatgataggtgggagaaaaaactggtataatgtttcttgacgacagcataatacttaggaaaattcaaattgtgcatatattcagcccaaattttatttgctaataatttaaggaagcatatcaatgtgcaaaggtaaatttacaatcatatctgttgtaccactatttgtaataagctaaaatttaacattaattgaaaggccatcagtgaatggcattttgaatatagtatggatgatccatatagtgaaataagttgaagctgttgaggaatgaaacagatcttaatggattgaaaactctgatctcataaatcaatgtacataacagtgtgtgaatgttcatattgtataagtacacatacgctcaattataaacaatatgtatgtatatgcataaaagcataagtagagtccttaataaatccatttctaaaatttaataatcttaatctaatatcataataatggattctgtttcatggtgcattttttacaaagtgtaaaacttatttgctcatgaagcccataacaatctgattatatgcataaataatatgtatgtataaatagtggatctactttccttatttaatgacaattttcaaaaagaaattttcacatctactacttgtgaactttattattatcatagaacatgttattgacatagattaaaataattatactgagaaaaatagtaactgttacataccccattctgtccacaatttgtagtatattttgttatatttagttcactaaaatttctgcattctcgggagtgacatacctaaaatgttatgaagcaaacagcaacaaaaatactaaatgtaaagtcaagagataaggaatcatattcatacaaatattatatgcacaggagatatacagaacagatgaatctgaatttcatagcattttaataaaaacccataggaacaattctaaatggtatgttattaataagaaatattacaaatgagatattttcagaaagcagaaatatacatttttattacacactggtacaagaaaaaagtagccagcttgtactagcaatttttaatttataggacctcttttaacactttttatgcacctttcttttatttactcatatagacccttagaaggagatatttttgggctcattttgtatttgagtagtagggtggctgtgtcaaatggtgggtagtactttgagaaatctccatactgtttctcaaagaggttgtactaatttacattcccaacatcagtgtataaactttcctttttctccacattcttgacatctattgttttttgactttttaataatagacattctgacttgtgtaagacggtatctcgttaaggttttactctgatagttggtgatgttgggcatttttcctatgttttttggccgcttgtatgtcttattttgagaagtgtctgttcatgtcctttgctcacttgttagtggggttacttggttatttttgtcgctgttgtgttgtttgagttccttgcagattcggatattagtcctttgttggatttataatttgcaaatatttttcccattctgtagattatctgtttactctgttgtttcctttgctgtgcagaagctttttagtttaattaagtcccatttatctacttttgttttcatagtgtttgcttttgaggacttggtcacgtattctttgcctgggccaatgtccaaaagagttttttgtaggttttcttctagggttatagtttcatatcttatatttaggtctttaatccaccttgagttagtttttgtatatactgagaggtatgggtccagtgtcattcttctgcatatgctacccagttttcccagcaccttttcgaagatggtcctttctccaatgtatgttcttgctggctttattgaagatcagtttgatgtaaatatgtggatttctgggatctcttttctgttccattgatctatgtgtctatttttataattatatcttgctgttttggttaccattggattgtagtgtaacttaaagctaagtaatgtgatgcttccagcattgttctttttggttaggattactttgactaatcaagctgttttcgtgtcatataaatttcacattttcttatttctgtgaaaaatgacattggtattttgataaggattgcattgaatctgtagattgttttgagaagtatggtcattttgatgatattgattctcccaatccatgagcacaggatgttttcccatttgtttgcatcatctataatttattttatttatttaattcagtgttttgtagttcttgtagagatccttctcctccttggttaaatatattcctagctatttaattttattttttggtagctattgtaaatgagactgtcttcttgattttgtccttggctagatcattattggtatatagaaacactactagtatctgtctattaattttgtatcatgaaactttattaaacttatttatcaaatctaagagtttttttggtggagtcattagggttttctagacaaaaactcaatcatcaggaataatttgacttcctcttttccagtctggatgactttattattttctcttgccttattgttatggtgaggacttccagtactatgctaagtaagagtggtaaaagtgggcatccttgccttgctttagttcttacaggaaatgctttcaatttttccttgttaagtataatgttggctgtatgttggctgtatggttgttgtagattgcctttatgatgttgaagaatgttccttgtatgctgagtttattgcgaatttttatccgaagagatgctgaaatttatccaatgatttctctgcatcagttgagattatcatatggtttttatctttcattctgttgatgtgatggatcaaatttttgatttgcatgtgttgaaccatctttggatccctgggatgaatcccacataatcacgatgtattatgtttttgatgtgctgttggatttgatttgctaggattttcttgaggacttttgcgtctgtgtcttccagagatattggtctttacttttttttatgccgttgtttggctttggtatcagatgatactcgccttgtagaatgagttagagagaatttcctcctccttgatttttaacaattgtttcaaaaagattggtattattctaattattagttattctatttattagttagtctaattattagttattctattccggaggtagaattgggcagtgaatccacatggtcctagccttttttgttgttgttgggataatttttactactgattcaatctcactagtcattattggtctccttgggagttgtatttcttcctggttcaatcttggtaggttttatgttttcaggaatttatctatttcctctaggttttctagcttgtgagcataaagttgttcataatagtctctaataatcttttgtatttctgtggtgagttataatgcctgcttttttatttctcattttgtttgtttagatcttctatcttttcttcttgtttagtctagctggtagtgatagtgacaggggccagagaaatcctaggcagaagagggtgggtccctggcaaagccccaccatcaagccgaaaagcctgagaccgcagcccaaagtgagaactcataaccctgttttcccgctcgaatgctgcctttccctaaacatccatggcccaccccaccccctcaacctttgcctatgaagacccccagactcagccggcagagaggagaagcagctggatactggggactacagccggacattggagagaagtggcttgacttcagagggacagcttgacagtgtaacttggaggagagtccagctggagatggccggacttgaggggaagattatctgctcgtcccctttccagctcccctttccactgagagccactttccctggcaataaaatctctcgcatttaccatccttcaattcgtttgagcgacctcattcttttctggatgccagacaagagctcaggagccacgagtgtggatacaaaaggctgccacactggccctttgccctcgctggcagaggacagctgcgggcccactgagctgttaacacttaagccatctgcagactgcagagctaaaagagcactgaaacatgtcctctggagcttcaggggtcgcaggcaccccccttagatgctgctgtggggcccgcagggagtttgtttctgccagcacccaaaagcacttgctccggctcctttacccgctcacctgcacgctccctcctgcgaggggtggaatgcagcaggtcccagcgagtgaagctcactcctgccagcaccgcagtggctggctggtttctgtgctcgtatactccagttcccgccccgtttgctcctgtgctccctcccgcgaggagttgagcgcaacaagctaagtaaacagggcatccctgtcgtgagtccaacgaaagagttggggaaataccgtggttcagtagtgtatcaattttatctttttgaggaacaaaccttttgtcctgttgatccattgggtttgttttgtttgtttaatctctgtttagtaatgacggacctctcttctcactctgttagttctcatgagagctggtttttttgtttgtttgtttttttcaaggagtctagaactttcctcctctgtctcttgcttcttctctcaccgtgtgatctctgcacataccagttcctcttctctttccaccaagaggaagcagcgtgaagccctcaccagaagcagatcctggcactatgcttcttgttcagtctgcagaactgtgagccaaataaacctatttcctttataagtcacctagcgttagtattccttcatagcaacacaacaactgactaagacacattaaatctcacaagctaaggggcttcgtccctcaagactggccccatatcaggtgcaagtatcaggtaaaccatacttctgacagaccagatataaattaggggttctcatgacaccctccacagggtaacaatgttagaatggctcacagaactcaggaaaatactttacttgtatttaatggtttgttacataagatacaactcaagaacagctacatggatgatacatttatggcaaggtattggaggagaggagaagaatttccatgctttctccagctgcaccaccctcccagcaaattgatatgtttattaacccagaagatcattgaatctctttgtttgagggttttaatagagatcaatttccagccctgcctctcttcttccaaaagtccagtgagtcaggctgaaagttccaaccctctaatcacttggtcatcctgataaccagccctgttataaggccagcaaggggtcccaccctaaatcgcctgatggaaataagcacaatttcaggtgtgactgaaaggtgtttattcattctcaagaacaaaaaacactcccatcacttaggaaattccaagggttttattagaagctgtgtgccaagaatcagaggcagagaccaaatatgttctgtgttatgctatatatattatatatataaaaaagataaaattagtatatcttttatatataaaagataaaattagttaatatatttaagtatttatacttctgtatttatagtaaatattttttcagtttgttttaaatggtctttggaggaatgacgtattactttacaatatagtcagcatcagtatgttcctttgattaattcattacttttatgtgtgaatatcttttcccattctgagataagtatacttttcacttaaatttatctttttattttaaaaatatatttctatatgtaaattatttttataaaaatgtgtggtaattgtatactttttaattagtcaacttatttttcagtgttactagtttgaaaagcctttattaggtatctcaaaattcttaagaaagataaaaattaaaaaaacttaaacactatgttttattgtcatgttttatgtgaaggccacattttagacaaaatatgcttatggaagaagtagtaggagagcaggttaatgagaaaataattgctttacttcaattgtaaccaaaataattttttgtcaatcactacaagactaaatatttgtcttttttgggttttgttttctttaaagttcttgttattcaggttgttctgacattttttttttgcatcattttattcttttttgttcttggtttacacaaatcatcacagatcagatcctggcctaacagggagtcttagattctcaagcaagacgaaacaagtttaaatatcagtagtaaaagtttaataaaaataacagatagtaaaacaagaatttctttaaccagccgaaattctgatcagtgtatcttaagatcatgatattgtaaccaaaatttgtagcattcattataaatgaaaatttaatcatcctctcaatctctctctctctctctgatacacacacttcagacactcacagacaaatccaccatatatcgtatcaataaaaattttatttaccttgtgttggccacatgcagttatatcttctgtataggtctccgattgttttgaaccatttcttgcatgtgcggacaaacatacgtgacctctaaggtaagtatattgtatgtctaagtctgtcattggtactagttctgaatgtatccagtgacaaacaatctttccacaaaggatatcactagcaacataagacagaaaaaagttacccatttgtcacttaggtacacaattaggttaataacaattcaaaagtgaggataattcaaaatattactcagatcataacagcaaagcttttcacagcacacaatgccatattaaatgcaacaaataagtctatctgtatatactagatactgtctctcatttatttcaagtcactctttgcagtacatacacaaaacacaacgcacgcacttggaagatgtatacttttctaaatacgtacaaaaaatcacaacgggaaccacagtttccaaatttgtcattttgaaaattcacttcttctgtacacagaagattagcagacttagcaactgaaaacataagaagtcatagttacttatattaaaatattaaatggtaaaagtgtggtaagtcaatagaaagatatctagacaacaacaaggcccagtcagtgtaatctgctataaatttttgatgtcatctactggctttacaaggagaagcacttactgaaaactacacacatgagaagagaaaaattcatgttatagtgtagaaataattaagaaatcagtcacctgctctcttatctactattctaatagtctactccctttgcaacaaccaccttaagttggactaatgtcctactgttgcatcctgtagttattaggtctattataactcttgacatcattcaaagttgctttgatttgcaattttatttctaaatttgaatgtaaaacaacactttcagggatggctcttgggtgggttactgactttagaatagctacagtttaaatataaacctcaaaaaaaaaaggtaaaacaattacattttccaaataactgtgaacactgtctatccctttctctgcatactcctttaaagcaatagctagtcttattactgcagtattctaaatcagcagctttcacatcaggtacacaaaactcagatgttccattgcaatattctggaaaatcacacatatctacactttttctgcagacatggcctctttcgtggatctgtgagagaaagaaaaaaaaatacatttatttttcaggctcaatccagtttgcctccattaccaagaattgaaatggactaaatcaaacaaggagctccaatggcctatctatactgcatattgagaatgcttgtttgagaattgtcagcttaaaagcaaggatatccaagagatgcatagaataaaaatcctgtttgaaacaaacactcactagagcatgaagccagacctatcttcaattttaacctaagtttgtgtttatttttcttcgcttggacattcttcatccagttacaactgatcaatacataatcagtattaatgtttttatttaaaaattaccggtaggaatatctaagcactcattagaaataggtaataaaggccaggtgtggtggctcacgcctgtaatcccagcactttgggaggctgaggcaggcggatcacctgaggtcaggagttcaagatcagcctggccaacatggtgaaaccccatctatactaaaaatacaaaaattttctgggtgtggtagcatgctcctgtaatcccagctacttgggaggctgaggcaagagaatcacttgaacctgggaggtggaggttgcagtgagctgagactgcaccactgcactccagcctgggcaacaagagtgaaagtccttctcaggaaaaaaaaaaagaaagaaagaaaaagaaataggtaataaaacttaccgtacaagttttattgttacagcatgatccagtgccacattctgcagatctaactagagtacaatctgcaggattacagcattttttatgagtgcatgcctaaaagcaaatacattagatttaaatgttttacatcagattttagtcaaataaatagttttatttattttcgaaataaagtatctctccaacttgattctaatcacaccatgacttttggattctgtatttttacaccacttcatttaaacttaatgtactttccctataagaaaaaaaaagatgacaatgaaaatattcacaatttcattctaaagaaattgatctattaaaaatttagtgcaattttttaaaaaaattatttttgtttataaaaacatgcatgcaagtttttatatttttttacttactataccataagtacttttccatatcatcaagtcctctcaaggggagtggctggaagagtttggaggagcaagatagaaaaagcctacatttggccaggtgcagtggctcacctgtgatcccagcgctttgagaagcaaaggtgggcagattgcttaagctcaggagtttgaaaccagcctgggcaatgtggcgagaccctttctatacccaaaataccaaaaattagccgagcatggtggtgtgtgcctttggttccagctatttgggaggctgaggtgggaggatcgcttgagtcagtcggggtggaggttgcaatgaactgagatcaggctgctacactccagcttgggtgacagagcaagactgtatatcaataaataaatatgaataaaaagcacagattcttgttagggattaaaagacaagaagatgagggaaagttttaaacttcttagagattagataaatgctcatgaccagaatgttgatagaaatatagatagcaaaggtcattctcatgaggttaagatgaaactgaggaataaggttttagaagcaagggccatccttgctataaactggccaagaacttggctgaactgtgaccatgcctgaggggtttgtggaaggccaaacttaagaatgatgaactaggatatctggcagaagaaattttacatagcaaagttctcagaatgttgtgtggttgcttctaatttcttattgtaaactgctagagaaaagaggaatagagcagaacaacttgaaaaactcatagtttgcaatatagtaaggaaggaaagcgcattcacaggagagaaaaccaaggatgtagcacagggacacctttgcttaagagattaacaaagatagaagaaagcggatatggtcaggatcggtgttcctgcccaattctccctacaatgtcaattgtaatccccaatgttggaggtggggtctagtgggaggtggctgaatcataggggtagcttctcatggtttaacaccatcccactgtggagctgttctcatgataaagttctcacaagatttggttgtttaaaagtgtgtatcacctcttccttctctctcatcctcctgctctggccatgtgaaatacgcctacttccccttcaccttctgacatgattgtaagtttcctgaggcctcccccagccatgcttcttgtagagccagcagaacaataaaccaattaaaccttttttctttttttataagttacccagtaccaagtatttctttatagcattgagagaatggactaatacaaaagccaagtgctattcctcaagcaatgaaagaaaggccccaaaggcatttcagataccttcgaggcccagacgcctaggagggctgaatggcttcagaggacaagcccagggcactctccatgagctcactgaccaattccacctcaggatgctgctcctggccctgctgcacaatgccctgcagctaccacggcctcagctgcaacggccataggtacagcttctatcgcagctccagatggtacaagtcattaaccttggtggaatccacatggtgctaattttgcaggcttgcagaaagtaagaactgtggaagcatggcagctcccactcagatttcaaaggatgtccttgaaagcctggaggcctgtcagagacttgttgcaagggcaaagccaccacagagtccccccagagcagtgcctagtggaactgtgagagtggaactatcacagagaccccagaactatacagcagccagcatgcaatgccagcctggtggtgttgggttgattgagcccagccaaaccatagggatggggtgacccaatgccctggagcccactgtacctgtttatagaagatgcaggacatgtcatcaaaggaaattattcaggagtctgaatgtccatcattggctctcttgggtttcagacttgcttgaggcctgttacccatttcttcttgtctatttctccttttcaaaatggggttgtgtatgctgtgcttttaagtaaataacttgtgttgattttacaggttcttaaagtatcccctaacagacatattggcagtcttccccaagggactccttgtggctaaaatgagacacaccagaaaccagaatatcatggctagcaaaatgaaggggtagtcatgtattctggtataattaattctatgccagctgataaccctctcccgcaccttgtggtcctgccacaactccaactggacagaaaactggtcttataaacattctttattgataaacactcaggaacttcaagccagtttcaggcaacttatagagactgcgcacaaactgtctttgtgccctacggtccctttttgacataaagagccaaattccacctcattttagtgataattaaaagtgaagtgaatgtagaacatatgttacatgaatgtttactcactgtacacacgcctgactgccctcatgaatattcatagatttctcccagtcttgctcagtatgtgtgtaaagttgactctgaaagacatatataccacctccctcttcctttctgcagagaatgaacttttggctttcactggaagctatgttccccaatctacagattgcttccgcctctgaaaatgtcttttccttttcttccttcatggatatcaaagtcttttgttaacagttctggcaacatgggatgggatccaaagtggcccctgatttctttcttggcactgccttgaaaaattcctaagttcaattgcatcctggttacactgggcaagaactgggtaagtgctattgaatctgagagttcaggcttttagattgaaatctagggaaatgttttctttaagaaagttctgcccattcatctgtggcctagacctacctgcagtccagcagggatgcctgcactaacgttgcactgggaaggccaccttctttaggtgagtactgtgcgtaacttacccagtaaggaaatggttttggaccaactgctgtcagagactctggaggtttacatgtttaaaaactataggaaaaattcttgttaatatttggtatcctggataaaaataagtcggtatgacttaaagctttcttggtcacaatggggaacttttaacatgcctcaatcagtttatctacatgtgcaataaagaacagaagattccaaacctctcaaaagcagtgtgaggtctttttcagttgctaaaatgaaagctcaaagtgaaatcaaggatccctagttgcctctttaaaagagactaaatcaaaacttaatcaagatcttaaaaaatttgaaaattcttctaaatcggaccctaaatccaaaactaaaaaggacactgtgccttcttgcctttctccttgaactccaccaatgccacccccatatgcattagccccatgctgccagtcacttctctctgagctgcctttctttccttcaccttctattcatgagcaaccccctccagttgctaattctgcaacccctctgatcacaccttttaaagggattgctaactaggcttgcaaattaccttttactgtcctgggacaaagtctcagctttcttctagcgttagtcaaagagttttctaatcctaaaatagactcacttgagtttgaatgccgctttagtttgattataaatgtttaccagccaggacctcctgatgttcactagttgattcaagtcttagtggaaaatgtcttaacccaaggatggatgtgtttagctgactggactaagccccaagatgattttcagcatactaaggaaatagcctttgaagtggtgagaaaaacaattgttgaattgattaaagccatctcagcactctttccttgacaaactaattggaatgccattgactcagaaaaaagacaaatctgtcattgattcctttgactgattcaaaaggctttcttttttctttttctttttttttttttgtttttttttgagacggagtctcgctctgttgcccaggctggagtggagtggtacaatcttggctcactgcaacctccgcctcctgggttcaagtggttctccagtctcagcctcctgggtagctgggattacaggtgaataccaccacacctggctaacttttttggtattttttagtagagaaggggtttcaccatgttggccaggctgctctcaagctcctgacctcaggtgatccacccaccttggcctcccaaagtgctgggattataggtgtgagtgaccgctcccggccgattcaaaaggctttctacaaaattctggtatcaaagatctaactgatgatattataaatcttttttaactcactttccctcaagtaagttaaagcccttagcaccctgcttaagcaatatgatcccaattggccttctaagagaccctatgatatagcttctttggccaatcgcttctctaaaatcctagaaaagaaaaaagaggctaaagccaccaaggcactagaatggcaagaaagacagataaactcatggccttgcatattcaacaactcataaagtctctcccagatcagcaaactccatttaatagttagaaattagtttcgtcagttgcaagaggtataatttgctttttctggcatttgaaatgagactgtaaaaaatataaatgagggcttcagaaggacaccaataaggtaaagaaacccccttctgcagaaacaataagagaaatacttattgatcagaactaggggtacttcagggaaacatgggggatttttcctctcctttcagtcagttgattgggagaggtttatcttaaaaattaacaacagaatagtccaagccctaatagatactgcatctgtgcttaaccttgactccttttaaaatccaaccacccagagtgaccaagctattcaaatggctgagtcactaaccaatctaagactatcttcaagtctgaactagtttcttaccaactagggcctcttactggcattgcagcttttcacttctccattttgccacaatacacctaataggaagggactttcttgaaaaacaccaagcttgtttttcttttacattgttttaaaagtttccttgcctgaggcttcagcctctgacctcagccatgtattccccttattagtctccagtcatccagttgatcctggacatccaactctaaagtaactgtttgaaaccctttgggaataaatcaatacgaatgtcagcccgatccagtcagcaccacccatttctacacaaatagatcctaacaaacctctactgaacataaaataatatcccctccaccatgaggctttagctggtatacaacctattgtcagtaatttcattttcaagggacttattagtccatttataccagtccctgtaacataccccttctacctgtttctaagctaatagaaagggatggagacttgcccaggatcttagagctattcataacattttattcccttgcatcctgttgtgcctgttccacataccctcttatccaatatacattctaacatccaatatttttccgctgttgatcactatagtacttttttcaccaacccggttgacctcaagagtccatttctttttgccttcacatggaagggccatcagttcacctgaacagtgcaccctgaaggatgcactgaaagccctatctacttttcccagatcttgcaggctgacttaaaagacataaccttctcgatacgaacagacatttctcaaaagaagacatttatgcggccaccaaacatatgaaaaaaagctcatcatcactggtcattagagaaatgcaaatcaaaaccacattaagataccatctcacaccagttagaatggtgatcattagaaagtcaggaaacaacagatgctggagaggatgtggagaaataggaatgcttttacactgttggtgggagtgtaaattagttcaaccattgtggaagacagtgtggcgattcctcaaggatctagaactagaaataccatttgacccagagatcccattactaggtatatacccaaaggattataaattattctactataaagccacatgcatatgtatgtttattgcagcattgttcacaatagcaaagacttggaaccaacccaaatgcccaccagtagatagactggatagactggataaagaaaatgtggcatatataccccatggaatactaaacagccataaaaaaaggaggagttcatgtcctttgcagggaaatggatgaagctggaaaccatcattctcagcaaactaacacaggaacagaaaaccaaacactgcatgttctcactcataagtgggagttgaacaatgagaacacatggacacagggaggggaatattacacaccagggcctgttggggagatgggggactagggtagggatagcattaggagaaatacctaatgtagatgatgggttgatgggtgcagcaaaccaccatggcatatgtatacctatgtaacaaacctgcatgttctgtaaatgtatcccagaacttaaagtataatttttttaaaaaagacataaccttctcacatagctcaactctactgcaatacattggtgatttgcttttatgttctcccttatgaaatacctgtctcactgacactctccatttacttcaccagctatgtcttaagggccataaagattctaaagataaactacagtgttgctgacaattaaacctcttggacatctgctgaccccttgggactcaacatcaaccctttctgccttcaaggcatatttttcttccccattcccactatgaaaagacaaaacttagggcctttctaggactcatggactattgcagagcttagaacactaatttttctttactagcacaacctttatataccctgattaaggcctcttctcctgacctccttacctggactaccgatggtgaacaggactttaagtctctgaaagataagctgtcctttgcccaatacacccctcaatttgggacactatttatgacctccctttttcccctttttgttcatgagcaagagggagtttgaactgaaccacatgggggtaataatttacccaattggttactagattgccaaactggattgtgtctatccggggataccaccatgtttaaaggcagttgccacaatcactgtccttataaaagccaccgagaaaatagtaatgggatttcctctcactgtttatgctcctcactcagttaaagcccttctcacttctcgccaaatccagtatctttcagccagtcgattgactgcctatgaaatacttctctttcccaacctattttccattgtaatctccttaactctgcccctcttttgtcttcaccagaagattctctatgactgcattacctttacactcttctttcaccccatatgaatttaaaggaaatgcccttacccaatcctgattttgtctggtagattgatgggccttctttcagagaccctactggcttctattaagctaggtttgcagttgtttccctgacagaaactattgaatcaggccttctgcccaacaggcagaattccatgctcttacccgagtttgcctgttggccaaagataaaactgcaaacatttacacagatagcagatacgctttttgggttgctcatgactttggaattctccggaaacagaggatttctaacctcttctggactgctcatcagaaacagagaccacattttgtcatttcttgatgccattcaagttcctaggactctggccatgattaaaattcaaggcaattcctttagacataccgaaaatagcaaagacaaacatctagctgagagtgcagctaagtctgcagccttaaacaataccccccttctgttatgcctgtcttaatccaggctccatccttacatcctgtttcttctaaaaatctcttgaaacaacatctcaaaaaaggtgctcagaacttgaaaaggaaaattagacaaaacaaggctgtacctataatcccagatcccaactatgggctaaacctaacagacattcagtccttctagaaaatttaccaagggtcacttttacttttatatataaccccaccattagagttctgaccaaaggatccaatggtgtaaacagtgctgttggggattgcttcttaagctaatatattaggcaaaattcacccttatacaatgcagggaagtccttaagggctaccctaggcaaagtcccaatgcgaaaagggcctttctaaaactggactactgattttatccaattttccctttctcagtgatacaaatatgttcttgtcatgatagatatgtagttttactgggggaaagctttcccctgaagacaagccacagtgatgccagtagccaaagtacttcatgagaaaattatctctacctatggagtttccaccaagttccacagtgatcagggaactcattttactggacaagtattaaaatgagttgctaatgtttggcctattctaagacatttcagcggtgtttaccacaccgaatcttttgggcttgtggaatgaaccaagagaatattcaactcaattggctaaaattacaagcagcttcaatctgccctggcccaaagctcttcctctgggtttggtaattgtgaagtccatccccaccagaattgcttttccccttttgaggtggtcacaggtcaatccatatatttaaccgaagaaatattttcccctgcttagatacaaggcgatctcctgacctactgccaagtcctggaggacttgttaatgctctaaagactaacagctggttgtgaatccctttacagtcatcaatcaggagatgaaccccaatatcataatgtccagcctaaagactttatatattagaagagatattgctgaatgactccctccaatcccactagaaaggtccatttcaagtacgcttaattaacccatttgctgctaaggtacaggtcattactcctaggtacacatatcttacctaaaaacaacaccagactctgctgagaactggacttcagcatcaatatctgacactaagctcaggttgactaaagcctcaatgccaagacaagaaaaggatgacaactgaggtagactgccctctcacaaaactccaagcctatatggtctggatgaatcaatgtttatatttaccttataatagtcattgttcatatcacttcaggagttttcacgattgttactatccaatgtaaaatagaacacttatctttgccttacttattctaaactaacatgccgagcctttatgattcctttataactgtttccattattataacattagcaatcttgtctatcctggatatcttatgccatccatgctgggatagttctgtgtattccaatacttagacacccataagcctttgcaaaactataagactttttgtctggctaaactctttgttccagagctttgtgaatggttgtgttgattagtccagttcaaaataaattttactctattctttataactgtccctttgtctcactgcatagagtgacatgataacactttggctaagctgtcctgaagtgttgttacaaatagaaacctatcagatggttagattcaccaataacttcccacattcattcatggtaaacatgtgacattgacaatacttgtcactgacttctcatgtatccttaacatcaccacttatctggatcaactgctttccctgttgtctctgagtccaattgcctcaagactcaaatattaccacctcttggtttaatttgtcccatgttattgatgttagaaacccattctataccagtggacctcctcgatctttaaactaatggatagataaatatagtctaaactgagtaaagaaaggtatgtccctactattcaaatgattcatgattcaattcaatactgtcaacatgaataaattcattagtgaacacacccttaagggcatcgcttgtgccttcaccaggctttgtgtttatatgggacatagggtctgatctgcctggatagggatggtcacaccattgcctcaacagcttacacataaaaggttcaggcttgcttatgaaaagacccccgttctgtctttattataaaactaaaaggtctatgctaacaggatgtaaagataatataggtaaaaacatcctagaactattacttctaagtgcttgggtttatgttactggagatataattcaaaaacctatccactaccattggttagatagctgatgacactgcagaaagccttacagcgcaacaaaaagtttctggactcccttggtcaagtaatactaaataatagaattgccttaaattgtctcctagccaaacagagaagagtctatgcagtagcccatgtaactgcttacacttacatcaacacctcagataaggtagaggttcccataaaaagaatttccaaacaagctaaatcgttatgagatatgcaaactactgatcctctccatctatttagtaggcttcctgtcagactggaaaattctttttgagctgacattcaagtgcttgttgtaatcacagtcttcatcatagtttcttcctaatagttaaattacttgatatatatatatgtctgtgtgtgtgtgtatatatatatatatatatgtctgtgtgtgtatatatatatatatatgtctgtgtgtgtatatatatatatatatatgtctgtgtgtatatatatatatgcaactgctgtaagtctactgttaaaaccagaattatggcagcataaggtgttcaactgatagataaagtaaacctataaacctagctacagtctcatccctacagtgccgttctggtgcaggaatgtgtatatgtacgaagacagctgtgctagttaaaaacaagtgttacaatctcccataaatagagagttttaactgtaaccctaatgcctatgacttccctgtgtaactggagtctgttaagtatttcactgaaaggtaccagccacaagcttgtttacttagcctctgtaaaacattttaataatcttcctgccagattgcagttttctcccacctccaacaaaatatttttgacctgtctacccttttcccctgcctggcctaagttatacaattagctgtaagtctctctgccacatgggtcccttcaagggacttgatacactcaggacaggtagccatgccaccctggcactaatatgggacatggtgtaaattggtcatcaaggctgcctacagcaggtttcaactaacagggaaaacaatgaatatatattccaacagacaggcaaaatggactccctgtggctaaaatgagatttagcaaaaaacagaatctcatcactagcaggatggagtatcagtcacatatcccagtgttattaattgccataagttttctctccagtaactaagcagaaataaatccctgaaaagcatttctgaaacaactacagctggaaaatttcccaactgaccctgacaggctgctaatgctagtcaacacccccaacgcccccgacgcctgtgccttgcagtcctgccataactccaactggacagaggactggtcctttattgataaacagccacaaatctcaagccagttttaagcagtttacagagactatgcacagattatctttgtgtccgattggttctttttgatataaaaagccaaattctgccttattttaatgctaaaaccctaccctaaagtgaacactgaatgcatgttacatatattttcacccactgtgcaggcacttgactgcttaatatgcaggtaatttcccccaaccctgcttaatatgcaggtaaggctgactctgtaagatatgtgtcaattcccccttccttctgcagaacaagcacttttgattttcccagaaagggcatttcccaagctgtggatttcttctccctctaaagtaaagtatcctttctttcctctgtggacctcacagtcttttgttcatagatcatagatgagactttagcccacacatcagtggataggagatgttttaagatggcataaggtatacaagaaacaaactgccaaactacctagggatgagcccagctatttggtttggttttgtgtgatgagcaaggagaaagggtaaagtggttgctacagacactggttatctgatcatgtggccatgaaacaagagcagctatggcaggtggataatgaacaccttagaccctggggagtcaagagtagaaggagaaaaaattaaactctcagctctcatctgtgggacatttgggctggccctatcaactcacaatgctttggtgatcatcttgttccaggctatcacaactgctcttaacctaagtactgggtgcccctcttaaggaaacttttcttaagaaaaccttaacctgagacctttctctcttttttttaaaggatcttattttttatttctatagatttagggggtacaagtgcagttttggtcacgtctgggcttttagtgtacccatcacccaaatagagtacttgtacccaaaaggtgttttcttgtcccttacgctcctcccaccctcccacctttctaagtctccagtgcctactgttccactctccatgtccctctgtacatgatttgttgatgttacaggtaggcagccactacccaagataaagttctgcacactaatatagtttcctttagccacatcttgttatatatggatgtctccattactgtcaaggaaaagaaagactcttatgtattttgctcaagcctatagccacccctctgaattatatggcttgctggacctgtcaactcagtaatcctcctggcaaaaaccagtagctattactatgaacacttcagaaatagatttcctcccacaggaaataataacttgctcccactacaaaatgatgctgaggaaaaagaatcagacataaataaatggaggtgtatacctcaaatatatctaaagattcgatgcaatatctttcaggagatgagtctactttatttttggtaccaattgaaaaaaagtcagaaatttacaataaaattcaaagggcccaaaatacccaagataactatgaaccagaaaaacagtgtgaggaatatacaatacaatatctcagaagttaataagaaatgtgtatttatcctgtgtccaagtgttctcattgttcaattcccacctatgagtgagaacatgcggtgtttggttttctgtccttgcgatagtttgcttagaataatggtgaacatcacacaccagggcctgttgtggggttggcggagaggggagggatagcattaggagatatacctaatgtaaatgacgagttaatggatgcagcacaccaacatggcacatgtatacatatgtaacaaacctgcacgttgtgcacatgtaccctagaacttaaagtataataaaaaaaagaaatgtgtatttattaagatagtgtactattggtacaagaggagcaaaagcagaaacatgcacaaatgttcacttgattgatgatcaaggttatgattcagtgtaataaagaaaggacagtcttcaaataaattgtgaatgtttaattttatatctttatgtgtatatgtgtgtgtatacacacacacacataaactacaaactgattgcagatctaaatgaaaatgataaaaagtatgccaaatatcttgagaaaaacagagcaacacacattaagtcctatgtgttatctgtaagtatttgctgcatggcaaatacttagaggcttaaaacgatgggtcatttattattttatgttttctttgggtcaggaatgaaggtgtggcttagatggccaattatggcttaagatctcccacacagtattgttaagatgaagctctcctggttctgagtgctgtttaattcatgaatcatactgcacttcaataaacagctatatttctctaaagtttttcttttcacaaatggaagatatctttaaaaaaagaaccaaatggaaatttcaaagatgtcaaatattgcaatgaaaaattcactggatctcttaataaaaggaaatattagtggtcttgaaatacaatagtcaaatatatccatatgaaagcatggagtgaaaactgaaggaaaaaaaaagagcttccatgaaagaaagcaaaacttttaccactcaaacaaaaacatattatgaagctgaaataatgcagttttcaatggaaacacgttaatgtttcaagtagtgaaattgtttacataaaaattatattgaagaaaatgtaagaatatgaaagacatttaacatatattaatcagcataagaatatataaataaatagaaaggaaaagggtggggcatggtgactcacgtttgtaatcccagcaccttgagaggctgaggcaggtggataacctgaggtccgaagtttgagactagcctggccaacatggtgaaatcctgtctctattaaaaatacaaaaattagctgggtgtggtggcaggtacctgtaatcccagctactccagaggctgaggtaggagaatcgcttgaacccgggagaaggaggttgtagtgagctgagatcacgccactgcactcaagcctgggtgacaagagtgaaactccaactccaaaaaaaaaaaaaaaggaaaaaatacttaatagatgaaaatacaaatcaaataaacctttcaaaggaaagaacagccatttcacagcaaagaaaacttatagggttagtcaaactatgaagatacaatcaattttactagcaattaaggcaagtctaattgaaaccacaaagagataatattttatacaaatacactggcaaaaatgacggagtctggcaataccatgtgctaaatcgggtataaaataaacaacctgttatacagtaaacagtcattggatgtgttaattagcacatttatttttgaaataaatttcccattgctaaggcatgatccacccacttgataacccagaaattctacatctaagtatgtagccagaagactcttatgtacatcaagagttaagtacaagacataataaaactcttcagaatgggaggggggaaaaacctacaaacactccaactgctcataaatagaaaaaaatcagtaattgtatatttccatacataatggattattacacaaaaagtgaataaatgagctacgtcacacaaaattacatggatatttttagtaacgtaggggatgaagaaaacagtcccagaagattgtgcgatattttttaaatggtctaaaattcaaagctgataaaaactatggtcaaattataaaatgatactgttaaattaaaaatatggatagaatttgctttttggacagagaaaagggtgaaaaattaggaataattgggccatggatgtatcattattgcatcatgtatattatcataaatgacaatgaaccaaagactataattagtctaattctttggaagcaagttaacataaatgaagttgctacagatgcaaggactaaaattaggaggtaagaaaataaatgaaaacacacatttaataacttagccaaccaatgtagccactttggtggaatttaagggatgattagatgataatgatattattgatgctactgatgtgtatggtactaaaagtgatattgctactaatgtttctaaaatgataaaaatctgttttttaaattgatgtcacacttacccagggtttagactctaaacgtttcaaatttaggatgagtcagttattgcatgccccatatctccctatcttatatttgacaaaatagtaaatatattttttcaaatttcccccttatacatatcatatctatatctatagatgccataaaaaaaaaacacaaaacataatgaaagaacaaatctctggataacctgtaagctttgccactaacctctttatagccacaatcacactgctctgtaggttccaaaattccattgccacaagttgaagattttcggtaagtcatttttgaaactgttttatcctgaaaacatttaagttcaggctgcagaactatccgtttaaatccatccatgctgcaactgctaaaaaacttcataccatgggatcatctaaaattaaattgtacttcttagataaatggactaaaagaatcaaagtaatactcctcaacaaaatgctatgaattctgaactacttcacttagagaagagccaaaaggagaagagaatgcttttatttttaatacaggtgataagcaaaaaatgaattatttgctattgtaatttgatatgatagacactgagagagtaaagaaagttaaaatggtaacacactcaataatatttggtacacaataagctccatttgagtatatcctattattgtcaacattaagaaataaaatttggttgattgtgttaatgaaaaatcataattacttgttctttgttaaaattaatcaaaaaagttatcccaatactgaggtatataaattgtacaaattctagattccttttattttgttttattttttgtatttctatacatttaagtatactacttaatgtgtaattttgggtaattttgtaataatctcaaacttaaataatgcaaatatggcccaaaaaaataaattttgttttctgaaacagttaagaggccggcaatgtgttctgtgaacactacatacatctatgtagttcttacatagaaatgggttattctacatcagcaccctagacccttcaaaatcataaaataatgacttattattaatatctaatgctcggactccattcggattttcccaaacatcacaatcctagcattttatagcaaaataatccagttcagaatcaagcattgcaaaattctcatgtctccttagttctcatgtctccttagtttagttgcttttcaaacttcttactacctaagtactatttcacttcatgacactgaacagtttttcaaccaatgcaactagactgctgtaaggtaatcattagcatccacttttcctctaaataatatcactgaatgtagaactattaagcacatttcctacaacattctatactttctttaatgtcttaagcacatttgtatctaaaacaatttcttaaattatattgcaagaggttctacatcaaggaatactagaaatatttcttaagagaaaacatagagctgataaaaacaactccttacatcgcatcaggattcattatgcatgtagttcctggacagtaacaattgtagatatcatcatatgtcaatcccagattaattccaagcaactgtgccataacaactgaaaaggcctctgcagtgattttctttggatactaaatagaaacaaacaaacaaaaacccagatttattgcctaagatattttttcactcctttgatcttgtcaaacgtttctagccatactatataaatacaaatgcaaattttaaaaactgctatttatttacttagaaataaattatttctaactacttagaaataaaaataggtacaattttttattccttttgagtgacaatatttttaatcaaaatgacattgacctaaaataagaataattcaatcatatatttttatgacatactattgaatttaattccagcaaatttcagaaaacgttctgagaagtaggaggattattttagtaactacaatatttctcaagagaacacttggaaaagatacacagattttggagagttgaacaggcaatcagttttgacctcagaaataatttgagaagagtcaattttttaaagtagaataatataacatcttacaagtagcatttctacaaacttccagaaactttgtcattatctctatatttttcctatttctgaaaatcatatagtgaaaatattaccacatatagtcttctaataagggtttctctcaccacaaatttaagggttttccacatcttattgtggcttaatagcttattatttaaatcactgggtagtattccattgtatggatgttctaaagtttgctcatccattcacctgttaaaggctatctaagttacttccaatctgtggcaattatgaataaagctaaaaacacttatgtgaaattttttggtggataaaagtttttaactcatttaggtaaataaatggatggtttaccataaggaggatgattgctggaccatatggcaagggtaagttgagtattgtaagaaactgtaaaactgttatccacagtggctatatcattcgcatttctgtcaacaataaatgagagttcctgttggtctcacagaatttggtgctttccatgtatgatgttgaccgtgactggtaagctactttcttgtgtttttcctgatctaagtagtaatgtgttatttactcaaaatatgttgtttcctgttttttttttttgtagatgctctctttaagttaaataagttcccctgtatttttagtttgctgagagtgtttattataaatagtctaggatttggtttttctgaatctactactagaatcatataatttttcttttttagcctattaatataatggaggacattattttatattcatgataaaccagccatgcatatctgggataaattacatatatatgtacattattattatatatatgtatgttacatatatatatatacacacacacacaaggagatagaaactaaaaaataatttaaaaaatctgtaactggattgggggggatggagcaagatggcggaatagaaagtgccactgatcatctctcctcctgcccctgactcccaccaacgacaccaatttgagaactattgacacaaaaaaagtgcctttataagaacaaaaaaatcaggtgaacacattacagtacctggtttgtttatttatttacgtttttgagacagagtctcacttttgtcactcagggctggagtgcaatggcacgatcttggctcaccgcaacctctgccttctggatttaagcgattctcctgcctcagcctcctgagtagctgggattacaggcatgcaccactacgctggctaacttttttgtaattttagtagaaatgaggtttcatcatgttggccaggctggtcttgaactcctgacctcaggtgatccacccacctcggcctcccaaagtgctgggattacagacgtgagccaccatgcccagctctggttttaatttcacatagctgaaagaggtactgaagtagaaaaaccactgacaccaaccctcgtcaatcctgtggcaacagtggcatggtgcagagagcatttctttgtgctggggagaggagaacgcagcaattgtgaggcattgaactcagtgctgcacttttatagcagaaaacaaaactgggccaaactcagctgatgcccacctacggagggagtattcaaaccagccctagccagagaggaatcgctgatctcagtggttggaacttgagttcctaccagcctcaccaccatgggctaaagtgctctagggccctaaataaaacttgaaaggcagtctaggccacaagaactgcaattctaggtgaatcctagtgctgaactgggcccagagccagtagactgggggcacatggcctattgagataccagctggtgtgactaagggagtgctggcatcacctcatccctaaccccaggctgcagagctcatagctccaaaagagaccccttccctctgcttgagaaggggaaaggaaagactggggaaggctttgttttgcatgttggatgcccgctcagccacagcaggatagggcaccagtcagagtcctgaggccccctttttaggccttagctcctggatatcatttccagaaggaacccactgccttgaagggatggactcagtcctgaaaaacgtcatcacctgctaactgaagaggccttgagacctgaataaccaacagtgatacccagggagtgtgccatgggccttgagtgagcatgtgagatttgctagctttgggtgagacttcatacactctcagctgtggtggcaacagggcaaggctccttcgcttgagaaaagtggagggaaaagtaaaggggactttgtcttgcacgttaggtagcatctcagccacagggcagcagagcaccaagcaggctctctgggtccctgattccaggacttggctcttgggaagcatttctggacctgacctaggctagaggagagtccaatgccctgaagggtgagtcccaggtcaggcagcattcaccaccagctgactgaagagcccttgggcattaagggaacattagcagtagtctggcagtgctctccacgggcctgtgttggtgatggcaatgaggtgaggctcctcacccagtttgtccaaacatgacaaataatatgctcctgaataaccagtgagtcaatgaagaaattaaaatggatattgaaaaatttctttaaacaaataataatggaaaaatgacataccaaaacctgtgggatatagcaaaagctgtacgaagagggaaatgtataactataagtatgcacaccaaaaaagaagtaaaacttcaagtaaacaacctaatatgtgtcttaacgaaccagaaaagcaagagcaaaccaaacccataattagtagaagaaaagaaatactaaagattagagcagaaacaaatgaaattgaaatgaagaaaataatacaaaagatcaaagaaacaaaacgttggtcttttgaaaagttaaactaaattgacagacctttagccagactaagaaaaaaaaaaagagagatccaaataaataaaatcagagatgaaaaaggagacattaccactgatactacagaaattcaaatgatcattggtggctactgtgagcaactatatgccaataaaatgaaaatctagaagaaagggacaaattcctagaaacatacaacctaccaagattgaaccatgaagaaatccaaatcctgaacagaccagtagcaagtaacaggtcgaagctataattaaaatgtcttcctggagcgaaaaggccaggacttgatcgctgcactgctgaattctaccaaatatttaagaagaactaataccaatcttaaacaattctgaaaaacagagtagaaaggaatattaccaaactcattctatgaggctagtactaccttgataccaaaaccaaacaaagacacatcaaaaaaagaaaactacaggccaatatctctgatgaatattgacacaaaatttctcaacaaaatactagcaaaccagattcaacagtacattaaaaagatcattcttcatggccaagtgtggtttatccctgggatgcaaggatggttcaacacatgcaaatcaatcaatgtgatacatcatatcaatggaaatcaaggacaaaaaccatgtgattatttcaattgatgttgaaaaagcctttgatcaacttcaacatctctttgtgctaaaaatactcaaaagctggtatagaagatgcaggtctcaaaatgataaaagccatatatgacagacgcacagttagtatcatactcactgaggaaaaactgaaagcctttcctctatgatctggaatatgaaaaggacacccagtttctccacagttactcaacatagtactggaagtcctagctagagcaatcagacaagaaataaagggcatccaaattgaaaaatgaaaagtcaaattatccatgtttgaagatgatataatcttatatttgaaaaaacctaaagattccatgaaaaaactattagaattgataaacaaattcagtaaatttgtaggatacaaaatctacaaacaaaaatcagtagcatttctatgtaccaacagaaaatctggaaaagaaaattttaaatgtaatagcatttccaatagccaccaataaaattaaatacctagaaattaaccaaaaaagtgaaagatctcagtaatggaaactataaagtataaaacattgatgtaagaaattgaagaggaaacaaaaaaatgaaaaagtattccatgtttatggattggaagaatcaatattgctaaaatgcccatactgcccaaaacaatctacaaactcaatgcaaacccgatcaaaatccaatgacatgattcacagaaatagaaaaaaaaaatctgacaatatatatggaaccacaaaagtcccagaagagccaaaggcaaaataacaaaattgggggaattacattacctgactacaaattatgctacatagctacagtaaccaaaatagcatggtactggcataaaagcagatatttagaccaatggaacagaatagagaacccagaaacaaatccacacagctacagtaaactcatttttgacaaagtttccaagaacatacactgtggagaagacagtctcttcagtaaatggtgctgggaaaactggatatccataggcagaaaaatcaaactggactcctatctctcaccatatacaaaattcaaataaaaatgaattaaagtcttaaatctaaaacctcaaactatttaactactaaaaaagttagagaaattagagaaatacataaaaggatgagtccgtccatggattaaactattaacgggctatcataagaatgagactggtggctttataagaagaggaagagtgacctgagctggcatgctcagctcccttgccatgtgatgccctgtgtcaccttgcagcatcctcatcagccacaagcgctcaccagatgtggcccctttaccttagactttgcaacctccacaactgtaaggaataaatttctgtaaaattacacagtttaaggtattctgtaataggcaacagaaaatcgattaagacagtatttatccaaaagtaataaaatcagaatatcaaggagatgtatgcacttccatgttcattgcagcactatatacagtagccaagatatggaaataacctagacatcctttgtcaggtgacagggtaaagaaaatgtggtatatacttacaattaagtacatttcagccatcaaaacaatggaaattctgtcacatgctacaacatagattaacattgaagagattatgttcagtgaaattaaccaatcacagaaagaaaatactgtatgactacacttatatgaggaatctgaagttgtcgaattgatggaaacagaaagttaaatggtggtttccaggtggttaatgggtatagagtttcagttttttaagaaaaaatgttccagagatttgtttcacaacaatgggaatatacttaacactactaaagtgtacacttgaaaatggctagagttatacattttatgttacctgttttcactcccagtaagaaacctcttgtaaaattacatttgatttccaaaatctaaaaatacaattttcaaagatttatcaaaacagtgtgagagattaccagagcaattcctgttgcaaactttggatcgcatgccattccgtgatatgttgctcccacataagtagaatggttcctataactgaataatgaaatttttcttgtggatatgtgtatttaaaaatagcaataacttactcatattttatgagttggatttctatataaaggtatgctttctccaaaacacagaaattacatataatgtcttatgctttcagtcattaagatttgggtatcccctatagttcatataaagttaagtcctaaaagttgtttaacattatctaatacacagctcaaaacctagcagtgcatgattctttcaaaaaattaatcatcactggaaggatataattaattccatgatataaaagtcaaaagtgtttattgctgtaatttgtatgtagtaaaccaaccccaaaagtgtgaagaaaggtaggactgaaagagatagagaaagataaaatatgcatcagatttacgaagagaaagagaggtagggtgtagaaaccatccttacatatttatatcttaatattgctctgtaatcctagacactctttattccaatacattgataaatatgttccacatattgcttaaggtctttaaaattgtgtttttgatttttgcacatgaaataatcaagttggtaaaataaaagtatataaagacttttgaaagatacaaaacaagtaggtaaatagctacatcttaggtcagtacagaaataccagaaggaaaccacatggagaataaagtggtctattttagttatttattaatatttcatactgtaacaagcattttatgcaattattgcattcaataaattaacttatatttatgtaatgttaaagtgatggtttcaattatttactagtgagaaggtctttacaaacagagaggtatcatgtttttatcacaagactttccatttttcagctcgttacatttctataagtaaacagtctactatgggctaccatgatttaattagtgtcttacatggttattagaatcttaatattttgcagtttgccaacacagtcttcagatagctttttaataattattgttatataaaatttatatataattatgatagctaagataatttgataaaacctttctaaatatgaataaagtacttacattaataagtatgtcatatcatgagacctttgaaacaaaaatttttgtttccaaggcaaaaatcgctgtagtatttcatcagcatgaccacttgttgaaatcttattttgatctgaccagatctccaaggaagacagcataactgtcatattaagctgggaaaacatctgagaacagaaattacgtgttttacaattttgggtaaccataaatatgacactacttctcaatatctaatgataatatatttaatttactatttttgaagataaagtcgttggtggataaaattagtggttgggctacatttacatttttactttttgttaaaatgtaaatgctatatatatgtacataagcacaaataattttacgtcattaattgctatattgcttactaaaatataaaatataaatactcacagtgttgataagaccaaagatttggaaaactttctcaactgcaactgccaccgtggagcccatataagcatactgaaagacaaattttgtttcttaatcgctagtaaaaacaactaactaccacattttaagtggatttaaatataaatgtaaaaataattcagtggtcaattgaagaggcactaaatagaattaagatatatcacagtttaccaagttttacacatcggcctagtattttataaattaatcaatgatattaaaatgaggtaattgtgattatcttcctctttacagataaagaaattcaaagtcaaagtgttaaggtatgaagagtgaataacctactggttagcccggtgtggtggcaggtgcctgtaatccaagtagctagctttaaaaaaaaattaattaattaattaatttaaaattttaatttgcatatagttgttttttattgtctttgtcatttagttactgtttaatctgttgatattttgtgattatatatcaattgtttatcaaaatatcaattttgtgactatatatcaattacatatcagtatatcagttttgtgtttatatatcaataatcacaagatgtcaacagaccaaacactagatggcaaagacaatgaaaaaaacaactatatgcaaattaaaaatgtaaaggacccataaaatataagtacatagaaatattaataatcaaaggatgaaaacacatcatctagcatcaggaaaatactagaaaagaaaaaatatgttatgtgataattatattaactaacataatacattgataagaataaaacttaaaggcaaaaaatggacatgcttatcacaacatattaataaaataattcatcagagagatggagacttttaaatttgcttataactaaaaacatggctgcaaaatatataaaacaagatttaacacaattaaaaatagaaattgactatcatactgagatattttaaataggtctcttaataacacataaattaagaagacaaattaataggaaagatactcaagactttaaaaacccaaagcaatgttggataaaatatacatacatagaagcttatatacaacaatgagaatatgtattttttttcaaatacaaatgaaagttttatgcacattgattcatattaaccaatattaggccatagaacacagctttgaataagaaacagagtgtcacttaaatcacattatctgaacacaatgcaactaagttacagtggacttgataaaaatattttaacaatgttatttttagtgaaatggatacctctgttgtggttatatgagataatagtcttattctaggtaaatacacactaaagaatgtaagagaaaagcttcatgatgagcttcacaacttactttcaaatttaaatgaagagtgcacaagtgataatgggatacaatattaataaatgtgagaaaagagaataagggccctctttgtattattttattcttgtaacttttctaaaagtttcaaattatttccaaaagaaatgtttaaaaagtgcagatgaaataaagacaatttcagatgaaaagaaactgaagagaatccagcaggctaaagagaaatatcatacattaagtaacctactacaaggtatgaaaagctctgcaagtgaaaaatgtatgtgtgtgtgtgtgtgtgtgtgtgtgtgtgtgtgtatatatatatattcatatatatgaatatttatgtatattcatatatatgaaatacacatctatgaatatatgaatatatatgaatatttatgaccatatatgaatatatgaatatttatgaacatatatacatatattcatatatatgaatatttatgaacatatatacatatattcatatatatgaatatatgaacatatattcatatattcatatatatgaacatatattcatatatgaatatatatgaatatttatgaatatatattcatatatatgaacatatattcatatatgaatatatatgaatatttatgaatatatattcatatatatgaaacacttcatttccttaatttctttttaaaataattgaatattgaatttttaaaaatctatttttcagtttataacacatggagaggtaaaatctttaaaaacagattcataatgacttaccagggttaaatgaaattttactgctctgaggctcttacattattaatgaagtggtataacattaattctagatcatgataagtaaagaatactaatcagaatccctagggaaaccgctaaggttggagactggaaagagaggcatagcaaaaaaaaaaaaaaaaaaaaaaaatagagggaaaaataaaggttaaatataaccccttgatccaagggtaggaaagaagaaacaaataagcaaataattgatggtatgtaagaacactaatagtaaagtattatttaaccaacatccatagttatcaattcttttgagaaaaaactaaacattctataattcttcctatttttaagatacagaacttctaccggagatggtaagcaactataaaacataaagtaatcttctgagggataatatttaataacaaagatttccaactgagtaataaaacaactcacttaaaaatagaaatacattgaagaatttcaatcaacaattggagtagatctaaaagtatctgcagctagatatgctacaatagattagagtgtagtggaacccttccatatgaagttatacattattgggaaaattgatatcgatttagaaatcaatatataaatattgatcccccatgtcactgtaaaggcaagtgaaaacatttctttatctcctgctagactgagacacacagtctagaaatcaatataaaaatattgatcccccatgtcactgtaaaggcaagtgaaatcatttatctcctgctagactgagacacaatgcagatatattaaaatatatctgcattgaaaacgttgttttttattcatattctctctgaatttcaacaaaagcaaagatataataaacatactgatattgcataccatggctttatccataatgatttgtattttcagagttcttttcgatagcatggcacctgaatttatctgtgaaatagaggacatgaattaaataacacattttcaaaatttttacattgcagttgtcatgtgcaatacacatgcacacacactcacaggtgagatatggaatatccatccatttagctacccatctatctatatgcagatggatgatagatattcagacacagatacacgaatatagatataagtaataacacaagaggatgatgggtacacccttagcaggtaggattccaaatacaaattttacaagaaaatcagaagcattttattttatgttattgatcattagaattggcaaaaagtcactgaaatgaaaaatcccatatttccttccccttttaacattcctatatactctgtagcacaccactacctcaccaatttttttttttttttttttttttttttttttgagacagagtgtcgttctctcgcccagtctggagtgcagtggcgcgatttcggctcactgcaagctccgcctcccgggttcaagccattctcctgcctcagcctcctgagtagctgggactacaggggcccgccaccacgcccagctaattttttgtatttttagtagagaagggatttcaccgtgttagccaggatggtctcgatccctcaccaatcttcaaggtaaactaacatccgtaaacatttcccctaatgttgccttcattttcttattatttttgtacttttacttctttatgttaactttattggggtttacattcaataaaatgtgtccattttaagtataaacttattagcgagtaatgtatacaccatcacaatttataaattggtatttagaacaattggaagaattacatcaaaatattaagagcactatctttaaacaatgaggtttcacacaatttatacaatttctagtgtattatcttgcccccttttcacttttacattttctatcaaaataacacttttaaataaaaaaacgcatgtgcaaaaaaacttataaagcaatttgattaaattggtaataattttattagtaagatgcaaaatcaatataaaaataactatatgtctataaaaatccctgcaattaaggaaacatgttatgatgctttagaattatgtgtgtttataacgattacattttctaaatatctgaataaacaaatatatgttttaaacgtcctacaactgaactttttaatataaatatcagtttaaatttattctccaaatgtgtcaaatttcaaaatttcactgtgaataactttatcaacagtaagaccaatgaagaactcataaatgagaatactcacgtctgatttgacaagaatcctgtaggactgatctatatattgagccacaggataattttcttgaaaggaggaatgaccaatagcatcatttttaattcgataaactacatgcttatatgtaggtgaagattccaatggttcaataccataactgatattatctaactgcagtaatcctctggatattcaaatacaaaaaaggaataaaaatgttactgataaatttgaatacattttatgctagtgagagtttttttctgaatacattttatgcttgcccacctgggatagagaaaaagagaatagaaaaatagatcaacaaaacaggtaaaaaagaaaagtatttaagaaaataaagtttatattcctctatatttattctacccttcaagaagtttctggaaattaaaggctcacataaaatctcaatgtacatatctggaatacgccattacctgagtccagaacaggtgcgtagtgccacaactgattttggaatgtctgcagcatatccttggtaaaagcaatgaccctaaaaaggaatatagaaagatatattcataaatgatttggaaacaaagtcctagcttttatctttacttcctatatattgtcaagcattcatatttaaccattatcataatagtatttatcaggtattgaatctccatatcaatctacaatctctttctctaagttcttttctgctatgttattagctcgtaaacattttcatcagtaacatacactttttctcaaaatgaggcataatctctattcccacttgctgacactggcaggccaaatctacccctagtagcagttatcagagcccaggtggaccaatcaatcctacccaaacacacatttacagcaatgtgcctgttacactcacaccatcaagactaacaaactcaggcagggaaatccatatcctgctccatgtcaagcaacagcagcagtcacctgcacttgcagtggtgccagcaggacctgaatctataagcccctcacaaagaggtagaaggcaatccaggtcccaacctctctccagcagtagagagtaatccagactcaatagcttctggctgtgcacccagcaggagaaaatgatcttcatgagttacttcccatttctccctactataagtagaaaaagatcattcagataggagctatcttcaaccagggtcactggcagagatagaatcaagcacactgaaatctagtagcagagaaaagacaggagaaatgttctccatcctatggatctttccttacccacctcaaccggaaacactacctggcccagggaagtacgatttacacctctagcttaaacgcttaagaggcagcagaaggtccaatgcagccagaacaatgaaacacaacacaataatattgtaaagaaaaaaatgttattggaacagtggactccaataaaacaaagctcaaactgaatgactgtcttctaaaatagaatattaaaataagatcaagagtcttgactaaatgtcaaggatataatcaaaataattcattataacaaggaccaggaatatcccaacaagaatgagaaaagaaaatcaactgatgacatgataagtcataggatatcaaaaaatatttgaaagaagtaataaaaattgcattaatgaataatgacaaattctcttgaaataaatgaaataacagaaaatcttaggaaataaatagaagccaaaaagggaacaaatgaaaatattataactgaaatatataataaacaaacaagtgaaacactgaataagctctatagtctggagtacagatgacagtggataggatcaccaggtttaaggagaatggatcacatatacccaacctgcaaaatagaggacaagtggctgaaaaatatatgatgtttcaaaaacttgtaaaacaatagcagaagacctataatttatactttaaaaagaaaaaaatggggtttaaataatatttaaaatattagtactgaaattttggtcagccagattgtgaaacaggaatcccgggacgcttcttctcccacaagcataccaattcagcaacattatatggaaaaattacctttgtgagtaatcagaaactaatatagagacatatacgctgggaggatgcaaaactagactcactaaagctcgtagagagacttggatcactctcttgccaggaaacccaaagatatctacacctagacctattttaatcaaacattaaaagatcaaaaacaaagagaattttgtaaactacaaaagaatagcaacttgtcgcatacaaaggaaactccataggactatgagcagactttttttttttttttaaggagaaaccttgctggccacaagagagtgggatgaaatatttttttaaagtgctgaaagaaaaaaaaaagccaaaaagaatgctatacaaatcattatggatttcttataaaatctataagaaactcacttgagacttaagcacacatataggatgaaggtaaagagatggaaaaataaattccatgcaaatggtaagcaaaaggggcagagatttgtatacttatatcaaagaaaatagattttgacacataaatcatcataagagaaaaaatgacattttataataataaaagggtcaatatctgaagaagatagattacttataaatatgtgcacactcaatattagaacatataaataaataaatctgaaggaagaaatagacaccaatactataataataggagactttaataccttattttaaataatgaatagaacatccaaagagaagattaataagaaaacagaagatttgaatattactataaaccaaatagttctaacaaacatataaaggatttcattgaacagcggaagaatatactttcttctaaagtacacttggatcttttccagacagatcacatattaggttaaaaaacaaatctaaaaattttaaaaagattgaaatcataacaagcgtcttttctgaacgcaatagaatgaagctaaaaataaatagtataaggcaaactaaaatattaacaaatattgaaattaacacactattgaataactattggctgaaagaattggctgaagaaattagaaactattggctgaagaaattagaaaataccttgaaataagtgaaagcataaaaataaaagtaaacaaaaaatattaaaacaaacggatgcaggaaaagcaatactacgagaaaagttcgtagcaatgtatgcctacattaaaaaaaaggcatatctcacatatgtttacctgaagaaactagaaaaacaacgataaaactaagtcccaaattagcagagaaaatttaaaaaacaaagattagaacagaaataaaccaaataaaaatagaaaaaccaatatagaaacaaagaagttcattttttgaaacaaaattgacaaacttagctatgctaagaaaatagaaaggatgcgaataaataaaatcagaaataaaacagagacattacaactaatgccacagaaacagaaaaagatcatgtaagagactagtatgaacaattttctgtcagcaaactggataatccaaaagaaattgataaatttctagaaacatacaaacagccaagattgaatcataacgaagtagaaaatttaaaaggactcacaactagaatgaatattagatcagtaatcaaaacctaccaacaaagaaaagagcaggatcagagaactttactgttgaactctatcaaatatttaaagaataattaatgccagaacaaccattcttaaactcttgcaaaaaactgaaagaggaaacacttccaaacttattctatgaggccagacaccacagccacataaatcattacaggaaaagaaaacgacaagccaatatcactgatgcacatagatggaaaaaaatctcaaaaacatctgaactcaacagcgtattaaaagtgtcctacactatgacaaggtgggatttatctccggaatataacagtggttcaacataagaaaatcaattaatgtggtacaccatattatataataaataatacaacttacaggatgaaattaatagatgcagaaaaagcaaatctcagcttcctttataggaccttatacatacattattatgagcctaatacaaaaatcaaacaaagccagtacaaaacaaaacttgcagatcagtatctctcatgaatactgaggagagaaacctcaagataataagtcatgtgtaaaaggaattataattatacatgtcaggacttggttgtaattttttaggtatgcaaaactatttcaagatttaaaaataaatcaattcgatccaacatgccaaaaggccaaaaaagaaaagaaaaacttgtaatcctatcaactgatgcagaaaaagcattttctgtaactaaatagccattaatgaacaaaaagaacaacataaacttttagcaggctagaaatagagaattttctcaacttaatacagagactataaaaaaacctaaagccaaaattattttttcacaatgaaagactgaatatgttttccatgaaattgggaataatcgaagaatgccctcactacggttattcaacatggtcctggacattttagcaaattacagtgaggcaaagcaaagaaatgaaaagcagacttacatactggttgaaaatgaagaaggaaaattgtctatatttgttaaagacgtgtctatgtaggaagtctcaaggcatctattaaaaagcccttctagaactaatatgtgaatttagcaagattgtagaatagtagatgaaacctgaaaaatggattgcatcactagaaaagaacaatatacaggtggaaactaaaattaaaacacaatatcatttacaattgttccaataaaatgaaatacttaggtataaacctaaaaaatgtataggatctgaaagctgaaataacaaaaacactagtgaaagatatacgtaaaagaccaaataaatagagagacttactgtgtttgtggattggaaaagttaacatagtaaagacatcagttctccccaaattgatctacagatttaacacaatttctatcacaatcctagcaagttttttttttttatttgcacatggagtagctttatctaaatcttacatgaaaaagcaaaatatctagaacagaatagcttaaaaagtttaaaaaagaataataaagtgggaaaaaccactgtagttaacaatccagaaatatatccacactagatccatggatttttttttgacaaagtagttaaaagagcgattcaaagcagaaatatagccttttaaaaatatagtgttgtaactaatatacatctagtcaaaagactgaactttgatccaaattccacaccttatacaaaattacctcaaaatagataaagaattaaatgtaaagtataaacttaaaaaaaacccagaaagtcttcagaaactactgctatgtagcgtccgtaggtttgacatgaaaacaaccaatcacaacaagaaattgttgataaattagtcttcatcaaaaataaaactttttgaccagtggcagaccatttgaaaagtaagacaaatcggccgggcttggtggcttacgcctgtaatcccagcactttgggaggctgaggtgggtggaacatgaggtcaggagatcgagaccatcctggctaacacggtgaaaccccatctctactaaaaatacaaaaaattagctgggcgtggtggcgggcgcctgtagtcccaagctactcaggaggctgaggcaggagaatggcggaatggcgtgaacctgggaggtggagcttgcagtgagccgagatcgccccgctgccctccagcctgggcgacagagcaagactccgtatcaaaaaaaaaaaaaaaaagaaaagtaagacaaatcacagacagggccaaaatatttgcaatgcacatgtttgacaaaggtcatattcaaaatatagaaaacttaaaaatcaacagtaatcagcaaccttaaactccaaactctcagatttctgcttggttccacgtctggatgctatggtccagactatctacagtagggggcaaacttaaacatgaaattcacctcctgtgcttacattctctcaggtacaaaattcctaatgggcctattgtcacatatctcaaaacgggtgcctcacgtatttttctttttctgacttctaattgtaatttggtagggagggaaaatcctttaccagttaccataccgtagatttcatcatctctcagttccaatatagcaatagagtgtgaccagtcattgcctttcacttcctcccagtcacgtgaataaatgtcttacagagtaataaataccttacagggtgtaataaatatcttacagggtaaagtgaattttctcacataatttcaaacctttcttgactctttaatgtctttcagcctgtaatcccagcactttaggaggctaaggcaggcagattacttgaacccaggagctcgagaccagcctagggaacatggtgaaacccccactccactaaaaatacaaaaattatctgggtgtggtgttggtacctacagtcccagctacttgggaggctgaggtgggaggatcacccgagtctgggaggcagaggctgcagtgagccaagattgcactggggtgacagaatgagccctcatctcaaaaaaaaaaaaaaaaaaaaaaaaaaaaaaaaaaaaaaagaaaagaaaagaaaaagaaaaagaaaaagcttttctgatataactcaaattctgcggtttcacatgtggacctattaaggtttggtacactgtctactttctcgcattctcactctcaccagttccctggagtctttctgtacggtaatgtctacgattttctccactgcccaggccctctcatatatcaattgaaacttctcagtgtgtcttagctccttcagacaccttttttcccctaaaactcctactaatactttcagacatacaaagtttaaatgtcctttttggagaaatgattcctaagttcccaattttcaaaaaagtagttgttctattcaatatgctttcatagtaattgccacattatatttaattttgtaatctgttttctcaataattatgtgggccataaagcattcatttcctcctcaacaatggcaccttaaccacataaaaaatgtaaatttacttggcagaaaccaaaacttacctttgaaaatgaagaatctgcatacaatgttcctgatttgttgtataaatacaccaggaaatgtgggtgtaaaaatgacctaattcaatcaaaataatgacacttcattgtaattatgtcattaattaaaaaataacttccagaataataaaattaaacaaaatttactttcaatacaaacatctaaaaatgaaatggacttatctctatattaacttgctgctttttgatagcatattgtgaatataagaaagaataataaccagtataatcagaaaaatgtgtggatgctttaatgaatttaaaataatcatctagggccaggtgcagtggctcacacctgttatcccagcactttggaaggccaaacctggaggattgctcgagctcagtagttcaagtccagctggggcaacatatggagacccctcatctctactaaaaataaaaataaaaataaattggtgggtcatggtggcatgtgcctgtagttttagctatttgggaagccaaggtgagaggatggcttgagctcaagaaatctaggctgcagtgagttatgattgcaccactgcactccagcctaggtgactgagtaagaccctgtctcaaaaataaaataaaataaaataaaatataaaataaaataaaataaaataaaataaatgaaatgaaatgaaataaaaaaataaaaaaataaaataaaataaataaataaaataaaatcaaataaaataaaatggccgggtgcagtggctcatgcctgtaatcctagcattttaggagaccgaggcaggcagatcacaaggtctagagattgaggccatcctggccaacatggtgaaaccccgactctactaaaaatacaaaaattatctgggagtggtggtgcgtgcctgtaatcccagctacttgggaggctgaggcaggagaatcacttaaacccaggaggtggatgttgcagtaagccaagatcatgccactgcactccagcttggtgacagagcgagactctgtctcaaaaaaaaataaataaataaaaataaataaataaaatcactgacagacacagatttatgtacagtaataagtaggtctgccagatttcaaaaggggttttcttttagattcaactgtaattttatggctcatataccttagttagtatttgttaacaagtaacaatagattttatatatttacattagttttcatggtgttatactttggtaaaaacaaccccaaaattcttagtgtcataaaacagcaatgagtgtccttcgcaagtttactaaagattcggctccatcctgccttccttctggaacctaggaaaaggcatagcccctccctgaaacagtctcaaaatgacaacctgaaattaatcactaaaatgaatcacagagaagatatacaatgttaaataaatctaatattcagtctcttatttaagctcaatttagggtagtgattgtaaaaatttaagacactaaaaataatgaatgaaaaaaatggtaacttactgtttttcaagcaggaagtgtatggtttcccctcaattttgatggaataagtggcctgtagcaaaatattcagagagaaagtaattggtagagattctaacttcttaaatgttgcagttccttgaaacatatattcattcatatgaatgtaggttatatcctgcatgtatcaaaattggaatgtataacagaattaattgtaatttaaataaacacaaggagtctaaatttcaaaactcagatcattaatcattagcatgtattattatgagatttgaagtcaaaatggggattatgtttagaaatgctgagaaacagttgaaaaaacttgaattttgttatctttgttctattttgcagctctcagcacaaataaattgaaaataaaataatgcagcacaggttcccagttaagaataaaataattattgcccagctgccagaggtactacccacaggcaatcctcatctccttacccactttggctattgccttagctcaaaagagtcatcttatacaaagtcacaactttctgggacagcccacatttaattagaagcccctccatttaatggaggtttcttgtttcagatagatttagtatggtcttccaaaaagattaaatgtggtgatatcttcatgataaattgatatttgtatcaataataaaagtccctttcatttccagaatggtttaaggcaattttatttttttcaactttattgagctacgactgaaaaacaagttttattatttatttaaagtgtatataagatgtgtatgatgttttaacatacatatacattgtgaaatgattaaaacaatcaaattactgtatccatcacctcacatagttaccattttatcatttgtggtgagacatttgagatctattcttagcaaatgttaagtaaacaaaacattattattaactatagtgaccatgatgtgcattagatcttctgaatttattaatcttataactcaaagttataactcaaagttataagattatataagaaattaataaattttaaacatatttgaccaatatcttctcttttcattcacacttccaacccctggtgactaccatctaatttctgttactatatgtttgactttttttaagatactacatataagtgagataatgcagtatttgtctttgtgtgtctggcttatttcacttagcataatgtcctccaggtacaaccaggttgttacaaatgatggatggcaggatttccttctttttacaaactgaatactttctgttgtttgtctatttatcgatcaactgatcgatcatctatcaatctacattttctttatccatatacccagagattaatgccatactcttttgattatgatagatatataatttacttttaatatattgtatatatttaaagtatacaacataagtttttgatagtcttatcttgatatagaaatagataagtgatttttgcaatcaagcaaattaaaatatacatcattctaatatagttactttcttttatattttccttgttgttgttttggtggtaagagtacctaaaatctacttattggcaaattaccagtataaaacatcatattgttaactgcagttcttctcttgcacattagatttcttagatgttttcatcctatataactacaactctgtacctttttacctatattttcacatttgcccctgcactctcctcctcacattgagtccctggtaaccattgtttactccaagcttctatatatgaaaatttttgaaattccacatataggtaagatcaggcagaatttttcattctgtgtctagcttatgtcacatagcataatgtcctttaccttatttcatgttatcacaatggtagagtctacttcttttttaagacagaataacattctatttcatatataaatatatacataccacaatttatccattcagctgtatatggacattttggttattttcatatcttgactgttgtgaataatgttccaatgaacatgagagtgcaaatatctttatgaggtagtgatttcattgtaatataattggaaatgaagaagtgtgatggtgcatcagggttttttactcagaattgttttaactattttgagtcttttgtggtttcatgagaattttagtttagttttttttttgtttctgtgaaaaatgccatcggaatgtcaatgggcattgcatcattgcattgaatctggaggctgctttgggtaatatgcacattttaacaatattaattcttccaatccatgagtaagggatatctttccatttgtttctgtctttttcaatttttcttatcaatttacagcttgcagttttcagcgtacaaatctctcactaccatagttaaatttattgctaaatattttattctttttaatggtattataaatttttttaaaaatttattcctcagctagtttactgttagtatgtggaaatacagctgatctgttttatgttggtttttggatactgcaactttactgaattcatatctttgttctaaccttttcttcatgtagaatgtttaggattttctatgtataagatcatgtcatctgataatagacaatttcacttggaggcattttattttatcttcctgaataacccttctggtgcaacttccacctatggtgaagtccaaagataatgttagtcttatctcgcaaagaggcaagtttctctcatctaattgtaggggaagggctatccaagaaaagtaaggtcagaaggacttcctaagctaggggctttacgtcagggcctgcacgggcacttcctctctcttggcaaagactgtggtatctcacaggacacttaaggtgacttaggtcttccctgcttaagaccagtggctgccatccaagtcccatctgtgtttggagaaggcaatactccatttggctgtagttggcagctcaggcctggcttgggattttccaagtgtccccatcccttggcctcttcactggaagcaccacatctcctgtcacttgcacactccgccattgacagcatgcaacgatttagttttcctgtgcttgtttcctgagagcaaggcattggcagttctcagatttctttgaataaatgtggggtgttatgtaagaaatgaagccacagatacacttattttattttatttatttcttttattgagacaaagtctcactctgttgcccaggctggagtgcaagggtgctaccttgcctcactgcaaccccgcctctggggttcaagcgattttcctacctcaatctcccgagtagctgagattacagatgcatgccaccacacccagctatttttttttttaagcagagatggggtttcatcatgttggccaggctggtctcaaactcctgagctcaagtgatctgcccacattggtctcccaaattgctgggattagaggcatggccactgtgcccggcctgatctctttacctttttcaagctgttctccccacaccttccctttcttgcttcagaacatgctcacaaaggccccctaagcagtgggtactggagatagcagagtgagcaaggcacagccctgctaggtgcagtgtgggtggcagacaaggatattggagattacaataacccagtctcctggtggaaatgcacaggggatggaccgtgggaatgcacaaaaatgtggcctagcccagccttgagagggttttgcagggggggcttcgtgggcccctgggtgaggatgtgaattccggcttccactgggcctacactgagtggccccggccaggaggggtcaaaagacctacaggaagaaaccgaggcacaaaatacaattttaaagactgagttgaagtgaggactgctgtcggggacgcacttccaagttgtctttgggagtggtccacttggccttcgttacaagcagatgaagttcaatgtttaacagtagtggtgagactgggcaccagtgtagttttcatgatattagaggaaaagctttcagcttttccatattgagtatgatgttagatgtaggcctgtcatttatggcctgtattattttgaagtaaattctttctgtacccaattagttgagaatttttatcataaaagaatgctggattttgtctaaagcattttctttatctattgagatgattatatgatttttatcctttattctgttaatgtggcatatttgtactcatttgcatatgtttaacaatccttgaatcccaggaataaatcccagttgatcatgacatacagtccttttattgtgctgttgaatttggtagtattctattgaggatatttgcatctttgaccagggatattggctcacgtttttattttggagtatctcaatccaactttgatattagagtaatattgtaatactggcttcatgaaataagtttggaagtgctccttcctcttccattttttggaaaactctgagaataattgttatttactctttctaaaaaaaagtatttggtagaaatcaccagtgaagtcatctggtcctggacttttctttgtaggagatttttgattattgattcagtcttacttgttactgatctcctcagattttctgtttttcattattcactcttcgtagattgtttctaggatgctgtccattttttccaggttatgcagtttgttggcataaaattgttcatagcatgatgcttttacttggtgatgtcaattgttatgtctcctcctttatttctggtattgcatatttgagccctctgcttttcctaatattgttaaaggtttattaattttatttatatttttaaaaatataactcttagttttgttactctattctatggttattctactcttttcttttttaccctttgttttcttagaccaattggttgtttaagaaggtgttgtttaatttccacttatttcggagtttcctatttttccctgtttctatttgatggaatgttttatagaggtcttttaggtccatttggtctaaagtgcagtttaagtctaaatgttccttattcattttctgctgtatacatctatccatggttgaaactggggtattgaagtcctctgttaatattatttctcatttcaattctgtttaaatttgctttatacatttagggggctctgtgctgggtgcatatacactttaaattgttgtatcttcttgattaactggcccctttatgattacattatgacttttttgccttttgctacggtttttgacttaaattctatttttgtctcataaaagcatagaaactcctttcctctttggattttgatttccatgcaatatccttttctatcccttcactttcggcccctgcgtgttcttaaagcagaagtgtgtctctctcaagcagcatatctttggatacttttaacccattcagccactctatgtcttttgaatggagagtttatagtccatttacatttagagtaattattgacatgaagacttactattgccattttgattattgttctctggctgttttatatgttgttttgtgcattcttcctctcttgctgtgttcctctgtgatttgatgttatcctgcagtggtatctcttgattattttctctttaatttttgtttatttactatagatttttgcttcatggtttaccatgaggcttacataaacatatagttatatcaggttattttaagatactagaaatttaacttcaatcacatacaaaaactatgcaatattacttctacacatacacataattttatgttatctatgtcaaatttttcatctttttatattttgtattcattaacaaactatggtagtgatagttattttaacacttttgacttttaacctttatgttagagttataagtgattcatacaccactaatacagtattatagtattttgaaattgacttatatttacctttaccagtgggtattacactttcatatgtgctccttttataatttatcctcctttcattttagcttaaataactccttttagcatttcttattaggcaagcctagtggtaataaacttcctcaggctttgtttgtacaggatattttttatccctcatttctgaatgagaggtttgtcaggtaaaatattggttaattatatatattttagttatattcctatgcacttttcaagtgcatgtcaaatttctgtatgtaatttatttatcttgtccatcatgtattgtgtaatatccattatcacttatttcttcttcaccctgtgaaatatatagaagtacatctacaaatttctaaatgcatttttgagttccttgttaagttttattctaattgattgttaccatataactagttttatactaccagtatttgatttttaattttctttctttactatcatcaattttgttgactgttctatatattcttcagaagaatatacattacttacagtggcatagagctaaattacagctggattggcaaagctctatctttagatctggggatccctacacatctggatatttcagattcttgtccaaaacaaaggcagtgagtgatatttataatgggctttcagaactcaaaacgtccctggccaaggaagcctcctcagtgtttgcctaattattttgacaagccctgcttgactatttaaagagtcactgaaagatttcagctgacttctccaaaagccaaaatttctcctgtagttcttgttggtagactcagtatgctttaggaacacagagattgtgtttctaaacagggagctcacagtgaatgtttcttggattcatgtgtaataaactgtagagtctagtgagtcctaaaacatatcagaactggagaaaacaatatattcactcactgggttcatgttctatatatatccactggataaaaatatttttgttgttcaaattttctttatctttatgaatttttttatgatttgtcaaccaacatttgaggaaaacattttaagatctcgctatggaaatggatttgaccatttcttcctctagagctatgaattttcactttctaggtgctgaatgcattttattaaatttatacaacttcagaactgttaaatgttcctagtgagctgaatatttcatcattaaaaaacaatgcttatctctcacagtggtgtgtgtgtgtgtgtgtttgtgtgtgttagtggaaatgagaaaattgaacaaagcctagtgacagttcaaaaagatatatatcactattgtttgttaatgagagtcaaatgtaatgcaacttttctggaagatattctgcaatgtttacaaaaagttgtaatggcttgcccattgatctacataaacaactatcaaagaaattttatgaaactatctacgagttgaaaatttgataaatgttacatccatatgacatatcatgaagtcataaaaatgacagagccatattaattaccataaaagtaaatccaatatttataaataaatgaaaaagtcaatcgcagtcatatataatcgttaaaaatatatgtgtgcatgtgcatgtgtgtttaaatattcatttagtataaatttattatttttagagactggtgtggacattcactgtattcagcattctctgtattacctcaatttaattttacaacatacctactttcctgttctaatcagatgaaagatgacattactttcatttacaaaggatttatatatacatgtataggcatgaagatagtctttatatattatcatgttaaaaacatgttgcttggtaaatattagtatgacctcaactatataataacacagatttaaatgtacatattttctaaaagaacccagtagactgaatatggttcctttgtgttataggaatttggggattcttttcctgaatctctgttttaaaacagttatctaacattcatatattgagaaatgaaaaaaatatcaaagtcttgctgtcattcagaccaaatgactccttagcacggtaaattagaacacaaactaaatttcacaaagggatatgtatgaattgattggggccatgtagtccagaaaaaacaaaacaccataattttaaaaggtgatctcttaattacatgcgtttctgaaacatcaccatcattggtgtttgtctggatcttctgtggtactgtaatttgcagaactggtgtttcagaatctgcatgaggaaaagcatatgtgagcattcccagtgtattcatgtcacagtgtcctttcttatcactctttaagcttccatcacacacacacacacacacacacacacacacacacacacacacacacacacacgagtccagttccaggaagacgctcctccaggcgtgggaggtttaccctagctctgcccaaggacacttcagggtttggtgacttcagccctgcgtgggagaagtgtgggctgctgctcccagaccccatccggcatccccacttcccactgcagcctggggtccgacacttgtaagcagttctggggcccccttcccagcctggcctgcgcttctaggccttgccaaaggcgaaagcggaaaggcggcctcctctcctgcagggctctttacttacgtgggcccgcggaggtcagccggcccaggcctgagaggatcagcaagagagacagcattgcgtagccggcggcccagccacagggatggccgttgtccttggaacggctgcagctcgaggccagggtggtggaggccgagcggagcggaagggccgtggggtccgcggggcgcggcggggacccagctccgtggatcccgaggcgggtggatcctacagccccgcgcgcccacccacagtgggctgcaccggaggaggcacgtgggagcctgcatttctgggtacgtgggctcttttttctaaagagttgacatttacaacgcattcaggggtaacatagggttataaagcacatttctactctagaccttttgctgatgaagccttggcaatatgattgttcaacatcatagccttctgggaagacagttgaattactgtagtgaaggaaaacagaaaaaaaaaaaataagaatcatagtatgtttagcagcagccaattgccaattttagtaatatctacttctagttttctgctcttaagactcaggtgaaaacacaaacagatactaaaaactaaaaaatcaatttcttagaaaactgtctaaggagtttaagtaaaatgcgaaatatggatatatggatgtattttattattttagtacgatttataagtatcaggcaaaaaaatcacacctataaaattacttcataaaaacaatcaaaatccatttatttattgacttttccacacttttgtttcttagaaaagctttatggcttagggagacttaatgaaaagccagacatattttcccccatcaatatggagttcacacaaggaatgataatatagttagttggaaataattttattttatctcttactgtataagtaggtggtttgcctaatttcaattttttttcaatttattatttattgtaacatttgtattgtagtaaaatacacaatataaaaattatgatcttaatgctttttaagcctacttttcagtggaattaaatacatccatattgctgggcaaccatcactatcattcacctccaaaactttggatttcaccaatttttacataaactgacttgtttgtgatttcgtgtattgatttgtgtacccaatacaaaaattgacatacatattgacatacagaactatttcatgaccacaaggaacctatatactacggctatagagtatactgacctaccttactcgtaattcctagtcactggcaaacactaatccagtctccacaatccatctccataatattatttttgatactatatataagaagcattatatagtatctcttgaaatttgttttttcactcatatcattcccttgagatacatcaaatttttttcttgtattaataattcattttgttacttctgagtagtatacataatacaaatgttccacaggttatttaaccattcatccatcaaacaatatttgggtagtttccagtttttaaatttgcaaaaaacattgctatgaatgttcatgtacaagtttttatatataaatcaaattatacattagttagactaagtgagaaaacagtagactgaaataaatgaaaattcgaaataaatgaagagacatcccaactgataccacaaaaatagaaacgatcatgagggaatactatgaacatttatatgccaagaggttggataaagaaggagagatagatactttttcacatgcatacaatctattaagattgaatcatgaaaaatagaaaatctgagcaggccaataatgaataagaagattgaattaataataagaagactcccaccaaataaaagtgcaagactttatagctgaatctaccaaacatctggagaattgataccaatccttcaaaactctcctgagaaattgaagaagaggcaattcttccaaactcactttaatagacaaacattattctgaaaccaaacccagacaagggaatcacaaagaatgaaaacaacaggtagaccgtggtggcacacacctggaatcccagcaattagggaggttgagacgggtggatcacctgaggtcaggagttcgagaccagcctggccaacatggtgaaaccctgtctctacgaaaaatacaaaaattagccgggcatggtggtgggcacctgtagtcccagctacttgggaggctggggcaggagaatcacttgaacccaggaggcggaggttgcagtgagccgagatcgtgccactgaactccagcctagatgacagaccaagactccctcttaaaaaagaaaaaaaaaaaaaaaactacaggccactagtcctataaacatggatgcagaaatcctcaacaaaatactagcaaatcaaatttaacagtatattaaaggggtcgtccactgtgatcaagtgggatttattcctaggatacaaggatggttcacaatacacaaatgaatttatataatataccacactaacagaatgaagtacagaaaccctatgattatttcaaaagttgcatacaaagcatttgaggaaatttattcatccttttgtaaaatactctgatcaaattaagtatagaaggaatgtttctttattcaataaaggctatgtatgacaaacacagggctaacatcataatcaatagtgaaaggttgaaagatattttttctctgagattagaaacaagacaaggatatccacactcttcactttgttccaacataatatcatttctggtcacaactaggcaagaaaaatttaaaaatgcattctaatgggaaaggaagaagtgaaatggactctttgtaaatgacatgatatcatatctaaaattatatgttttatggatataatttatatatattaaaacatataaatatgtatatatttaatatataagtatatataaaattatatataatttataattttaaattaatttaaaattaaagactccaccaaaaaactgatagaactaataaaccaattcagtaaagatgcagaatataaaatcagagtataaatatcagtagtgtttgtatgcattaacaaaaaactgtgcaaaaaaaagggatttaaaaattagcctctttattaaaatacttgggaataaatttaaccaaggatgtgagagatctgtgtgctggaaataataaaacattagtgaaagaaattgaagaagatacaaataattggaaagatattccttgtttatggattggaagaattaatatgttaaaatctcaacgataccctaagcagtctacagatcagtgcaacccctatcaaatttacaagaacattttccacagaatggaaaaaacaatgctaaaatttttatatacaacaaaagacctcaaatcatcaaagaaatcttgagccaaaaggacaaagctgaagatatcacactgcttgtttcaaaatatattacagagctatggtaatcaaaccttcatggttctgtcataaaaacagactgattaaaaaatggaacagaatagatcccagaaataatccccacaaaattttggtcaattgatttttgagaaaggtgccaaaaacatatactggggaaattacagtttcctcaataaattcttttgggaaaacttcatatccacatgcagaaaaatgaaattggatccatatctcataacatatacaaaaataaacaaaaattgcattaacgacataatggtaatatctaaaattgtaaactattaggaaaacacaggggaggagctccacaacattggttggggaatagttttttgagaactgcatcaaactaaaaagctttttcacagcaaagagaaacaacacagtgatgacatattttctgattggcagaaaatattagtaagctataaatctgataagcgacgattatccaaaatatgttggaaacaactcaacagcaagaaaacaacctgatttgggcaaagtatctgagtatagacatttctcagaagaagacacacaagtggccaaaaagtatataaaaatatgcacaaaatcaccaatcatccaagaaatgcaaattaaaatcacaatgagctatcacctcagacatgttaaaataggtattatcaaaaagacaaaagataactagtgacaacaaggatgtggataaaataaaacccttgttcattgttggtggaaatgtaatttagtgcagccattatggaaaacattatggaatttctcaaaaatattaaaacatagctaccatataatccagcaattatacttctgggcatatatccaaagaatttaaaatcagtatattaaagagatatctacaccaattttcatttcagcattacttacaatagccaagattcatcaacagatgaatggataaagaaaatgcccagtatttatttctcctattccattgtccacaatggaatacttttcagccttaacaaaatgagaaaattatgtcatttgcaacaacatggaggaagcttgaggacattatgcttagtgaaataggccaggcacagaaagacaaatattgcattatatcacttatatatgaaatctagaaaagtcaaacttagaattagggaacagaatgatggttaccagagtttggaggtaaagaagtggagagattttagtcagagggtacaaagtttcagttagacagatggaatgaggttttgaggtctatcatacagtatgctgaatatagttaataataatgtaattcatatttcaaaaatgctattagagtagattgcaatttttcacaccacaaaaataattatgtgaggtgatgaatatgtaatttatcttaagtattccataatgtatgcatatataaaaacatcatattgtacccataaataaatatatttattttatttaaaaattaattacaaacacccaatctgtaatgtgaaagtcacttttaaggaagtagagaaaaaagtaaattaagaaagcaatgatacaaaaccaatgggaaagaaaatctaatgacatgtgatggttaatttcatgtgtcaattttggtaggccatgttgctcagatatttggtcaaacattattcttggtgtttctatgagagtgctttaaatgtggttcacgctggcggactttgagtaaagtggattgtcctccataatgtgggttggcctcatcccatctgttgaatactggagagaatgaaaagactgaccttcctccaacaggaacttcagcatcaggtccttttgcgttttcagcctgatagcctctggacctcaattgtagcatcaactcttcctctctccatcctgctggccaactctgctgattttgaacacgtcagcctctgtaatcatataagccaattccttatgatagacagctttctatttatataaacctcctattgattctgtttctctggagaaccctgactaatatagtaagaaaaactaacaatggcagttcaagataagtgaaattatcatgaataaagtagcatgaaaactattccaagttattaaagaatagaagtttattgaaataaaggtgccctgaatgagaaaaaaaatttcaagaaactctgataaaaacttatatcactgaggtataatgaaattaatatattggactttgtaattaaataatgaaaaatcctatgggcatcttggccacaaagaaagtcaataatgaggttaggaaaactgactcgtgttgggctttgacaaaatggagtgcttacaagtgagtcaaataatttctatgaacttagtagaggacatacagtatctcaacaatgttttacacagtcaaattcacattgtagtataaa

SEQ ID NO: 331 - DNA, 163733 bp, Homo sapiens
atggtttgatgctcaattctaatgccagattgttttgagaagaaatgtttcatgtgctctttccagagacaaatctcctgatagagcaattacacaggatatttggtaaagctctggccagtttgataattcactacgtaagtccagatagcctgactggtgaattctaacaaatatttaaagaagggataatacaaaaatactccacaatcttttgcataaaatagaagaggaaggaacccttctaaatttattttatgagaacagtattaccttgatactaacgctagacaaagacaagaaaagaaaactatagatcaatatccctcacgaatatggatgcaaaaagtcctttaaaaatggcaaacagaataaagaaacataaaaggaagtatccaacatgaccaaaaaggattatctcagtaatgcaaaagtggtatagttaatgtaacacaccatactaacataataaaggacaagaaaatacaagatcatctcaaatgatgcagaaaagggatataacaaaatgtaacacccattatagattattaacaaattgtaaatagaagggaacttcccctacctgatgcaaagtatttatgaaaaacctacagctaacatcatactaaccatgaaattctcactgctctccaccctaaaatcagaatgaaagtgaggatgcaagctctcagtacttctactaaacattgtattggaggtccaagagagtaaaatcaggtaggaataaaaattaaaatgcatctaacttggaagacaaaaagtataactgtctttatttgcagattacaccaccccgtgtatgtaaaatcttaggaaatttaccaaaatacctgtttgaataaataaatgaattcagcaaagtcacaggatacccaattgctatgcaaaaatgaattgcacttctatatattagcaatggaaaatagaaaaataaaattaagaatagaatttcattcacaatagcataaaaatacatacttaggcatatattaagaatacaaaatatacatgcaaacaacaaaaaatttctgagaaaaatacaaaaacctaaataaatgctgagatcttccatgtgaatgggttgaaaaatggtattgttaagacagcgattctcccttctgtcagggatccccagtattaccccttggttcagtaaatcagtaggaagactcacgtgattgagcatagaatgtactcatcactataatttattacagaaaaaggatacaaagcaaaattagcaaaggaaaaaggctcatgggtcaagtatgaaggaaagtagtcacaggcttccaagagtcatttcctagtagagtcacccatgatggacttaattcctccagcaatgaattatgacaatatgtgtgaaatcttgactgccgggaacccagaccctaagatttttattagaggctggtcacataggcatcgtttgcctagtatctacccaaattccaaattcttagatggaaattggttgttcactataaataacaaggtctaaacagttcaggcacagtgacttattagttaggcaatggtgtgggaacggtaactgaggtgtcagccaaaggccagctttcgaatatacctttctaagtatagcagtctgaagtctgctatgttaactcttctgtacatctctaaattgatctatggatttaagacaagctttggcgaaattctagtaggcttctttgcagaaattgatgacataatcctaaaaattctggaaatgcaaggcacccagaagtgctaaaacaatcctgaagaacaaattgatggagtcaccatttcatatttcaaaaattactacaaagctaaagtaatctagcttaacattgtactggcataacattaaatacatggataaatgggatggaattgagagtccagaaataaactcttatatttatagtccattgatttttgacaaatgtgtcaagacaatttgatagaggaataatagtcttttcagcaaaggctattgggacaattcaatatccacatacaaaaatgtaaatttggacccttttatcatgccatacacaaaatttaactcaaaatagacaatcaacctaactgcagtagttaaaactatacatctattggaagaaaacataggaaaaattattcataaccttggatttggcagaaacttccaagacacaacatcacaagtataattcataaaagaaatagttggtaaactggactttatcaaaattaaaaaccttcgtgcctcagaaaacactattaagacaataaaaagacaagtcacagaggggaagaaaatatttacaaactgtgtttctgatatagtacttgtatacagaatctattaataatgctaacaactcaataattgaagggaaacaatccaattacaaatgtatgaaatatttgaacaggtaaaatacctgttcaaagaagataggcaaatatatacaaagttatatacaatgatatacaaaatatatagaaatatatacaaaataattacatagaataataaatacatgaaaaatagtaaagacattgttagtcattagcaatgtgtatattcaaacaagatactacaagacacccactagaatggctgtaatcaaatgacagaaaataacaaatactggtgaaaacatagagaaacaggaactcatagactgctagtaggaccaaaaaatggtgttgctactttgggaaacagtttgacagtctgttaagcagtttaacataagtttaccaattgaacgaaggattctactcctaggtctactcaagataaatgaaaacacgtatttacaaaaattcgcatatggatgtctatagcaacattattcaacgaccaaaatctgaaaacaactcaaatatctataaactaattgacaaaaactatgatatatccatacaatggaatactagagagcaataaacgttgacagaatactcatacatactacaatctcaaaaacactactgtgcaagagaagctaaatacaaaaccccacccattttatcattttatttgtagaagaggtcccaaaatgcaaatttatagagacagtaagtagattagtggttacctggggccagccacagacatggggattaactataaatggatacctgggatcttatcctatgctaatagaaatgtcctaaacttgggttgtggtgctggttgcacaactatgtaaattttcttaaaatatcactaaagtgtacacttaacataggtgaattttatggtatgtacgttataaattaaacctcaataaagttaaaaacagaaaaggtcaccctgatgaagataaactcccacctagtggacaagaaacatgtttctcctgaatttagtgattgtggactcaagagttgtgttagttgataataagtgaaaaaaatgatttcagcatatctgtaggccatgggaaatatttattaaaatggtgtccttgaaggttttacagtgagaattgtagaatgatggaaatgtcatccagtatgtcagtggagcagatgatatctctaaaaagaaaaagtaaataagaatatgtaggtgttattgaaaataatatcacattgtgagaaacaatgtggcataacagaacaaaactgaaatcagaatgtttggatttaaatttgtgtctatacttttgtctctcataatgtcatatagttgtaagaatatacgcatgtagccttttcagattggcttttttccattaccaacatatatttatagttcatctatgttctatagctatagttcatggcttggtagctaattgctttttatagctggataatattcaattatatgaatgtaccagagtttacttatgtatttatctattgaaagacatttaatttacttcccaattttggcaattataaataaatctgtaataagcctttaaaaaataaaaaattccattacccatcttgtcgagtcacattataggctcacaatttcctaactttaaaaacagtgtttgttctaattatttaacagatatatatttggggtgcaatgtatttgaaaattgtttttttgaaatatgctaattcagtaagctattcttttttataatacattttatttgagattgctacagatttctggacacacacacacgcacacatgcacacacatgaataagcaaaaaataatagattgaccctgaaaaaagcataattttcaaaaaattataagggctactctcataatatacaattaatgtgtcagagttttattcaactcattaatgagggaactagaaagaataataggcttgttcaagagtaagtaacaaaactagataaataggatttggaaacaaaagaatgttagcataatattactatgttcaaaactggttaatatccacaggaaaaaaacaataacttatttggttatcttttctaaatgacaggaattatttcctattctatcagacaaaaacctaaaagttaatatgtaacttcacaaagtctatgacaattaatcaatatttcttagtttcattacttttttctagcctctatttcatttatttctgttcctatctttatttccttttttctactaactttggattttgctttttctagtcccttgaggtgtaattacattaggttgattatttgatatctttcttcttttttgatgtagatatttattgctataaacttccccactggaatgatttttgctgcatctgataagttttagtatattgtgtgactattattgtttgtatcaagatatttcacaatatttttaaattttcattttaagtgcctctttgatccattgattgttcagcagtatgttgcttaattttcatatacttgtaaaatttccaaattccaagtcctgttattgacttcttgttatatcaatgtggtgagaaagatacttgatactattttaattattttaaattttctaagacttactttgctgcctgacatatgatctatcctggagcatatttcatgtgttcttgagaaaaatatatattctgttgctgtttgatagaatgttttttatgtgtatagtaggtccatttggtctaaagtgtagtttgagtctgatgttttcttattaattttctgtctggattatctgtctgttgttgaaagtggaatattgaagtccattatgattattgtattacagtatatctcttctttaaaatctattaatattgatatatatcatactttatatattatatatattatacacacacaattactactagacctcagaaatgaagttgatggcaacacaatgatagtgggggtcttcaatgctccactgagagcactagaaaggtccaagacagaaagtcaacaaagaaacaatggacttaaagtataccctagaacaaatggacttaacacatatttatagaacattctacccaacgactgcagaatgtacattctgttcatcagcacacggaacatactccaagatagaccatatgatagaccacaaaacaagtctcaataaagataagaaaatcgaaatcattatcaagtgctctctcagaccacagtgcaatacaattggaaatcaacttcaaaaggaaccctcaaaaccatgcaaatatatcaagttgaataacctgctcctgaatgatcattgggtcaccaatgaaatcaagatggaaatttaaaaattctttgaactgaatggtaatagtacacaacctatcaaaacctctgggatacagcaaaagcagtgctgagaggaaagttcacagcattaaatggctacatcaaaaagtctgaaagagtacaaataggcaatctaaggtcacacctcaaaaaactcagaaaacaagaataaaccaaatccaaccccagcagaaaaagagaaataacaaagatcagagcagaactaaatgaaattgaaataaaaaaatacaaaaaataaatgaaacaaaaagttggttctttgaaaagataaacaaatatgatagaccgttagtgagattaaccaagaagagaagagagaggatccaaataacctcaattagaaacaaaataggagacattacaactgatgttacagacatacaaaagataattcaaggctactataaacacctttatgtgcacaaactagaaaacctagaggagacagataaattcctggaaatatacaatcctcctagattaaaccagaaagaaatagaagctctgaacagatcgataatgggtagcaagattgaaacagtaataaaaaaaatgccaacaaaaaaaaagttcaggaccacatggattcacaactgaattctttcagacattgaaagaattggtgccaatcctactgaaactattccaaaagataaagagggaatcttccctaaatcattctattaagccagtattaccctaataccaaaaccaggaaaggacataacataaaaagaaaactacagaccaatatcactgatgaacatagaagcaaaaatcctcaactcaatactagataaatgaattcaacagcatattaaaaagataatctaccatgatcaagtgagttttaaacaagggatgcagggatggtttaacatacagaagtcaacaaatgtgatacactacataaacagaagtgaaaacaaaaatcatatgatcctcaatagatgcataaaagcatttgacaaaatccagcattcttttatgattaagaccttcagcaaaattggcatagaagggacatacctaaatgggaaaaagttgaaagcgttcccccctgagaactggaacaagataaggatgctcactttcaccacttctattaaacatagtactgaaagtcctagccagagcaatcagacgagaaaaaaataaaggggatccaaattgataatgaggaagtcaaaccgtggctgttcaccgatgatatgatcatatacctagaaaaccctagagacttattaaaaaagctcccggatctgatgaatgaattcaataagtttctggatacaaaatcagtgtgcacaaaccagtagcactgctatccaccaacagcgaccaagctgagaatcaaattgagaactcaacccccttcacaacagctgcaaaaagaaacccttaagaatatacctaaccaaagaggtgaaagatctctacaaggaaaactacaaaacactggtgaaagaaatcatagatgacacaaacaaatggaaacatcccatgctcatggatgggtagaatcaataatatgaaaatgaccaatggcaaaaaacaatctgtaatttcaatgcaattttcatcaaaataccatcatcgttcttcacagaactagaaaaacaatcctaaaatgtatagggaacacaaaaagagcccacatagccaaagcaagactaagcaaaaagaacaaatctgcaagtaccacattaccagacttcacactataccacaaagctatagttaccagaacagcatgatactgatataaaaacaggcaagtagaccaatagaacagaatagaggatgcagaaataaggccaaatacttacagccaactgaacttcaacaaagcaaacaaaaacataaagtgtggaaaggacaccctattcaacaaatggtgctgggataattggcaagccacatgtggaagaatgaaactggatcctcatcactcaccttgtacaaaaatcaatcaagatgaattaaagacttaaatttaacatcatctgaacgataaaattctaggagataacatggtaaaaactcttctagacattggcctaggcaaagacttcatgactgaggaccgaaaatcaaatgcaactaaaacaaagataaatagatgggacttaattaaaaagcttctgcacagcaaaagaaatgatcagcagagtaaacaggcaacacacagggtagaagaaaatcttcacaaactgtgcatcagacaaaggaccaatatccagaatctacaaggaatgcaaacaaatcagcaagaaaaacaacagcaacaaataatcctatcaaaaagtgggctaagggcatgaatagacaattctcaaaagaagatatacaaatgaccaacaaacatatgaaaaaatgctcaacatcactaattatcagggaattgagaatcaaagccacaatgtgataccaccttactcctgcaagaatggccataattaaaacttttttaaaaaaaatatgttggtgtggatgtggtgaaaagggaaaacttttacactgctggtgggaatgtgaactagtacaaccactgtggaaaggactatggacattccttaaataaccaaaagtagatccgccatttgatccagcaatcccactgggggcatctacccagaggaaaataaatcattatatgaaaaagacgcttgcttatgcatgtttatagcagcagaattcacaattgcaaaaatatggaaccagtctaaatgactatcaaccaacaagtggacaaagaaccaacaagtggataaagaatttgtggtatatatgtatgtgtatatatatttgtgtgtatatatgtatatatatgtgtatatatatgtatgtgtatatatgtgtatacatgtatgtgtatatatgtatgtatatatgtatatatgtatgtatatatatgcatatatatgtgtatatgtgtatatatagtgtatatatgtgtatatatacacacatatacatatatagtgtatatatgtgtaaatatatacacatatatacatatacacatatacacatatatacatatactcatatatatacactatatatacacatatatacacacacatatatacacgtatatatacacatatatatatacacatacatatatacacatacacatatacaatggaatactactctgccataaaaaggaatgaaataatggcatttgcagtaacctggatggaattggagactgttattctaagtgaagtaactcaagaatggaaaaccaaacatcgtatgttctcacttataagtgggagctaagctataaggatacaaaggcataagagtaatataatggactctggagatgcgtgggaaggtatgggagtggggtgagggataaaagactacacactgggtgcagtgtacactgcttgggtcatgggtgcaacaaaatttcagaaatcacacctaacgaacttatccatgtagccaaaccccacctgttctcccaaacgattgaaataattaataataataaaggtgagatccagaacaaaaaaagatgagcccatgaggtgcacttcttgagcaacacaattcaatttatttaattttacctcaatgattgtgaaaatatagtttttcaatattctaaagtcacgactctcatatacctacaaagtaaaaatatttttaaaagaattttctctgcctctcaatgaaggagccagtaggatgataaagcttgattcaaagagtacttgaggaagtgagtgttcacaggtatttttaaaaatgttagagtaggctgggggcagtggctcatgcctgtaatcccagtactttgggaggccgaggcgcgcggatcatgaggtcaggagatcgagaccatcctggctaacacggtgaaaccctgtctctactaaaaaatacaacaaaaattagccaggcgtggtggtgtgcgcctgtagtcccagctactcgggaggctgaggcaggagaatggcatgaacccgggaggcggagcttgcagtgagccgagatctcgccactgcactccagcctgggtgacagagcaagactccgtctcaaaaaaaaaaaaaaaaaaaagttagaatcaaagtacgattgccttttataccagttcgtaaaaggaaacaaattctgaagaaacaagtgttgatactttctcattatacatatgcaaattttcctctataaatactttgaacaattagttttgaattaaatgttgactctgtaagcttgagtgacagtagatattgtatttgtcttctcatgcatcacctggaaaatttgtgtgagactttttacagatagcaaatacttgaaaacttaagaaaaagttggcgaaaaacaattttgagaagataaatgttatataagctgggccttcaggacctttgaaagctaggaaaatttttatttactttgcataggataatgacaatagccataagagactggggcatgtgttgaagaaagaagagttttcagagatgatgattagatgcttcttagcaaaagtaaatttgtagaaagggaagcccagaagcagatcagaaatatgtaattatggaagttatttttaagttttttgcaacatgaaatttgaaataaatatgaaataaactttctcctgcgtgttcttagaatatcttcatcatttgtgtgattaaatttcttgtgcataaaaaaatgggtaatgcttataagagaagctagaaactcaaagataagcagacatccataaaggaaagaaaggcaaagtggagctagggatataaaaattacttgtaatccattttggctctgctcagttgggcagtttctggtttctccatattaatcttaaagaagaaatcagcagccatttataaaatgataaatcctcatcataaacattttaaaaatgttgcaggctttaaaaggagatattttaagaatcctgtgtgatgcttaaatagttaacaagaagatttaattttctaattgctattagaaacttagggaaaaaaatggaccagcatatagagcctacacagaaataaaacttaaatagcattgatatttaaagttttatgtttctctttcctcctagttcaaaccggctaatatgatttgtaggaaatcagttggtaaagaatgcgatttcactgaatattgcaatggggaccttccatactgtttgcctgacacttatgtacgtgatggagaatattgtgattcaggtggagccttctgttttcaaggaaagtgtcggacttttgacaaacaatgtgatgatttaattggaagaggtaataatcataattttcttcttagtccctaaattctgattattccaaactctgttattgaattttatggaacaaaaatgtaaatgtatgtgttaatgactgaattcttgcataatgtatattagtgttaaagaaaaaacaaaattatcttttctttttcttttttgagacggagtttctctctgtcgcccaggctggagtgcagtggcctgatctcagctcactgtaacctccgcctctttggtccaagcgatcctcctgggttcaagcgatcctcctgccgcagcctacggagtagctgggataacaggagcacactgtcatgggtggttaagtttgtgtttttagtagagacagtgtttcaccatgttggccaggcttgtctcaaactcctagcttcaagtgatctgcccacatcgtgctcccaaagtgctgggattacaggcacgagccactgcgcctggcgcaaaaacaaaattttcatgattgtgaaatacaacaacaaaaaacctctctgaatttatatggaatttctgtaggaacagaaaataaacctcaagtgaaaatgcagtttttcaaaatattatatagaatttgtggtgggggtttagtttaaaggaaacaaggtttcttaatcagaggaaagcagggctaatcactgattagttgggtttctaagcgcttgctgaaaagtgagggcttcagttcattagcaatctagtccattttgataatttcctataaatgtcatttgcttgattggaagatacaaattcctgaacgtatgcagtgcatgttctccgagagagtgaaatttttcattcttagccctcccttgaggtcttctctaaccaggtcatagatctctaaatattgtctacagcaatgtgactgccaggaatttaaggagaaggtgagatgggggttttgatgattttcataattttgtcctgcttttctaacagaatcattatttgtaccatatggcaagacaatagctatagactttaaaacattgttaacatacaaacaaagagctggggccagtagctcatgcctgtaatcccagcactttgggaggccaaggcgggcggatcacaaggtcaggagttcaagaccagcctggccaacatggtgaagccctgtctctactaaaaatacaaaaattagccgggtgtgcttgggatgaggcgggataatcgcttgaatccaggaggccgaggttgcagtgagctgagatcacgccactgcactccagcctgggcgacagagcaagacaccgtcttggaaaacaaaaacaataacaaaatcattcaaacgaatgaccagtaaaattaggaggaatgggacagtacttcagatctatgatctaatgtttctttaagtaaagccaggactcaatgctaggcagataaaattagagccacatagtggattgccaatcaggtgtcttccgggttatgccattcactgtgtatttagtattatcagtgattttaagagattttaaagtcctttgtgagaactgtgggagtacacgggtatttgccccaaagagtacagttttttttttttggaaggcaagcatgacttctaaagcaccttgatttcaaaataatgtatgtccacttctagtgaccatgtgttcatgcatctaggacgtgataattctggacttgactaccagtttttgtacttatttttgaaaaacaatctcactttgctagccccctgagggcaatagaagcctgatgaaaatttaccctcaatggtagctgtatttcaacgcatattaaatccagttctttgtacaataacatgctatacgggtttgcagcctaggagcaataggctacaccatatagcctaggtgtgtagcaggctataccatctaggtttgtttaactacactgtatgatgttcacacaacaatggatacattgctcagaacatatcctcatcattaagcaactgatgactgtactcagtaaatataaggtattattattattattagattatgatgtgtgttccctacaaatatccaattatttgagtaggtcatctatgacctgtcatggttggctcaaatgatccttgagcagggtttgatataattctgaagtaggcattagttttgcttggtaaaacctatatgctatttgtaggaaacagacaataagaattcttataccacaggcctaatacaaatcatcatgcccccccaaattgttgatttctggacaaaatatactaatgaagttgtcacattgaaagacatagcttatttatcaagcaatggcatttaaaatagggaaatctgtagatctatggtaaaagaacgaggttaagtattaagctttttttttttcaaaaaaatcaaaccagtgaaggaaaaacacctcaaatggttaccacctttttctaagctctttactaaattttgtttttggaaatgtctggcccctacagcatgctcctcttcagtgttatctctgcaaatgcagaaacttcctattgtaggtataatataaaatgatgttattacctttggtgttatttggtttgtggttatgtttgccctaataaggctgaaagtctcatgagttgtaaagttccatatattattagagggctttatgaccaagttgagttgtatatcatctagacaaatgttaagtgctaatccaaccgttatacaagggtttctcaacctcagcactagtgataatgtaggccagctcatactttattgtgagaagtgggggcagggaatgcttctcctgtgcattgtaggatatttggcagcgtccttggcctctgcccactagacaggatgcctggagagacttttggttgtcccagcttggatggggtgaatcttggcttctagtgagtacaggtcaggggtgctgctaaatgctttgtaatacacaggatagcctctacaacaaagaattatatctgctgtgctgtgttgagacctccttctctagagagggccagaagtttgactacttaagctgattaagactctgaaaaaggattatattccacactaaagtatgaacagtctttgcaaaactaacctggtaatgtttctttttcaatttttaagatatgatttatcaaaaaccatattggatcaatattcttatgaaagtggcacaaaggttggctctgggcgtagatattttccaaaccatagaagcatacttaccagggacgtgtaaaagatttgctggattattgaatagttgtgtgagaaggagaaataaacaatatttcatgattatttaatcaactaataaaatatgttcagggttttcagcatctatattcaggcttatttagtatatagcactataaaatttaaatgtaatccttatacaaggtctgaggatgcttcaactaatttatctaaagctacaattgctctggatttaagaaacagactacaaacaggtgatggagctttgatgagcactgggcagttaggtaaatattcctataatgtgacttgacctttaatgaacacatagacactaacatttatgataatctggaaaacacagtaaagatgtgaaggctgctttggggtcctgaaggcatcttttacctctcagttcactgaaagatattctgaaatgtttgaaaaagtaaaatcatgtatggaacttagtattccataaaattaggaaccaattgtatatttagccatttaatcctggacatccttaaatttataaatgtctttcagaagtttcttttggataattatgaatagtcaacaatcttttgactatttcagacaaagttcttcctttggctgacaaattatggctaggtgataaaataggatagggaagcttttccttaaaaattttatacttccttttagccaatggaatagataaatatatagagatagcttgaaaactccaaataagtacagataggagatcgcctactttgggcaaaggtagatctggaaggaaactttatattttgagatgctgatttaaaccatgagaaaagtaaggtggatactcagaaaagccttaatgtattattgtcgaagtattattgttctgtagcaccttgtacatgtatggattgtgctccttaactgagtgaaatttacagatcatgttctccaagtatgaaagtctgtgaaattattgaagatagctctcttgtcaattaatagtggtaacaacaaatgatctctattttgattacatatgactaacatgatcaacgtaaactacgtctaaactactaagtcaaagtaataggacagttattatagatgtttgaatttttcagaattttaaaattagacataactaaatatataaaggactgaagtagatgaacattgatattctaattttaaaattcaacaatttttatttagtgattattaggatctaataattattaagatctaataatctaataatagattatgactctagtgtggagcaaggagagttaaatgaagtgttctttgtgtttgtcatcattattgcactaaagatactatttttctactgtttcatttagaataagagtaaacagcattttcacaacgggtagggaagtaaggcaggaagtaaataatttataggaaatagagagggcgacagttgcttatttgtctaacaatacagaagcattctaataatgttgttgtttgttttctgtttctgcagaagaaagtcttctaggcttataaaaaggagtttgttttttaatcctagctctgcccccagaaactttttagtcctgggtaattataaactttcttatggatcacattgtaatttccagattgagtctttcatttctttaatataacttaaattctgtattgtaatttacttaagtttttgttgttgttcataggttcaagaggtgctccggttttctgttatgatgaaattaataccagaggagacaattttggaaactgtggcactgcacactgtctttttcagtatgtatttagaaaattataaaactgtttggaatgtaggttagagattgttaaaatcctaggaaatatattatatgcagtaaaatcgaatgttgggggtcaggttttctttattacatcatctgagctggacaatattatccactgcctacaagaacatttgttcagcgcctataatgttaaaacaacaatgaccataaaaatgtcctctgtttattgttgtgatgagctagacattgttatgcagcttatatatattatatatttataatataggttatattattcaatttatgtacatcaaatgtgtataagaattacttatcccatttactattgaaaaaactgaagaccagagatcattttctcaaatttcagcagctattgtggaacagatcacagctgtcatagtgtaaaaaccattagtttttcacttgccagattgcctcatgaaacaaaaaagaatcataacataagtcattgtgcaaaaaaatatgtactgagagaaaatagttgaaatttggatttaaattagtaaatcactttttaaaaatttcactgtatcagcaacctatgttatctcaataaacaataaggtaatttttttcttccttgtgcttctagacatattctatgtggaaaattagtctgtacatgggaacacagagacttaatatcacgtccaaatttatctgtgatttatgcacatgtacgagaccaaacatgtgtgtctacatacctacccaggaggacgccacctccagtaaattcacctatttcaatcacatcatattattcagctgaagacagagatgaaacatttgtacaagatggttccatgtgtggtcctgatatggtaattagaactacacaaattaaagtgttttaaaatgatttttctggttatactcattttgacaatgtactaaccaatgcattttcttccattttttcttgtggtaaaatgcacgtaatataaaaattgccattttaacctttttaagtgtacaattcagtggtattatatacattcataatgctgtaaaaccatcaccaccctctatcttcataaatcttttcattttgtaaaactgaaactcatttcattaaacaataactccccattcctacctcctctgatcccctgaaaaaccaccattctactttctgactctataaatttgactattataggtatctcacataagaggaataatatagtatttttctttctgactggcttatttcacttagcataaggccctcaagtttcagctatactgtagtatgtcagaatttccttcatttttaaagctgactactattctgttgtatgtacgttctgcattttgtttatctattcatctgttgatgaacatttggaatcattccatgttttagctattataaacaatgccactataatcatggcagtataaatatgtcttcaaaactgtgctttcaatttctgggggtatatacctggaagtagaattgctggatcacatggtagttctatttttaaatttttgaggaactgctccactgtcttccatggtggctataccattttacatttctactagccatgcataatgattccagtttctccacatcctcaccaacacttactttccgtttttttttttttcgatagtagccatcctaatgggtgtgaagtggtatctcactgtaattttgatttgcatttccctaatgatctgtgattttgagcatcttttcatgtgcttattgaccatttgtatatgttctttagggaaatgtctatttaaatgctattcccgtttttaaatcatcttttttgttgttgagttttaggaattctctatatattttggatattactctcttatgatatgattttaaaatattttctttcattctttgagttgcctttttactctgttgatagtgtcttttaatgcacaatttaaaaacaactacgaaatccaattagtctattttttcttttgttgcatgtacttttggtgtcatatccaataaatgactggccaaatcaatattatgaagcttttgccctatattttattctaagagtattatagttttaagctcttatgtttacctatagaatccatttcaagttcatcttggtatgtggtgttaggtaaaggttcagttttattcttttgtgtgtggacatctagtttctccagcaccatttgttgaaaagactgtcctctctccattgaatggtctcagcacccttgtaaaaattcagtagtatctcttaaccatatatgcaagcatttgtttatgggctatttatgctattccattggtaatatattagtctttatgccagtaccacactgttttctttcctgtagcttcctagtaagttttgaaattgggaaatgtgactcttttagctttgttctttttcaagattgtttttggggttctttgagattctatatgaattttagtataaatttttccatttctgcaaaaaaatcattgggatttttatagtaattgtattgaatctgtagatcactttgaatagtatggacatcctaaactgctttgttaaattaattcttaagtactttaagtactttttgatgctatcataaatggaaatgtgttcataatatccctttcagagtgttcattgttactgtatagaaatgaaaccagtttttatatgttgattttgtattttgccactttgctgaatacattgttaattctaactgtttggggtaatccttagagttttctacttataaaattatgtcctctggaagcagaaaagttttaattgttcctttccaatttggatgccttttatttctttttcttggctaacatctctggctagaacttccagtacaatgttgaagagaagtggtgaaaggaagtatccttgccctgttcctgatcttagcggagaagctttgaagtcttatcattaagtataatgtcagttgtgggatttttatatatggatttttatcatgttgaggtagtttccttctacctcatgactgagtgtactttgaatgtttgtgtcatgaaaggtgttgaattttgttaaatgccttttctttatcaattaagatgatcattttgtttttctccttcattctattaatgtggtcattacatcgatcagctatcatacattgaaccatccttgcattccagaaatctcaattggtcatagtgtatactcctaatatagtgcagtttgccagcattttactgaggattctgcatctatgttcataatggttattggtctgtattttttctttgtagtatatttgtctggctttgatatcaggataatgttggccttataaaatgagttagaagatatttcctcttcttcatgtttttggaaaaatttgagaagaactggtgttaattcttctttacatatttgaaggcattatgtccagaaattttcttcataggaaggcttatgattattaattaattaattaaattattaattaaatctccttatgagttaggagtctgttcaggtttttaagttcttcatagtgttgataggttttgtttctaggaatttgtcagttttatcaagctaatccagttcattggtaaacaattgatcttggtattcttataatcctttctatttctgtagaattggtagtaatgttctcacttttattcctgactttagtaatttgagttttctgtctttattagtacatctagataaaggtttgtcaattttgttcatcttttcaaagaaccaatttttggtttccttaagtttattgttttactctgtattttatctccactttaatctttatttccttccttctgctagaatttagtttatttatttatttatttttctatttccttaagttgtaaagttaggttgttgattttaaatttctcttcttttttattgtaagcatttatactaataaatcttccccctagtacttctttcactgcattccataagttttgggatattgtgtttatatttctatttgtttgtaagtattttctaatttccttagtgattccttctttgatccactggttccttaagagtgttttgtttaatttctatagctttgtggagtttacagttttatttagattatttttccaaatttttaatttacttttttattagaaattattattctaaattttttgatacattaaacaatttatttttaaatttttatatattcatggaggtacatgtgcagttattggtgaagttttgacatccagtgtgcctgtcacctgaataatgaacattgtctccagttatttttcaactctaaccctctgattcttcctcacttttggggttgctggtgcctattatttccatctttatgtccatatgtacctattttttagcttccacttacaggtgagaacacatggtatttgattttcagtttctgagttagttcatatatgataatgatgtctacctttatccatgttgctgtactgcatgggacatgatttaattatttttattgctatgtcataattcatgtattatatatccttatatgtctagatatataattcatttattatatatcataatatataataaatgtatatatcatatattaatatcatatatttatatatatatttatatattatatatttatttatataatatattatataacatattatatatttatataatatatattaatatataaatatatatttatatattaaattaatttatatatatttattatattataataatatataatatattatataatatattaaataatatataatatattatctaatatattagataatatataatatattatctaatatattataatatattagataatatattatctaatatataatataatatatattatataatatattatatagtatacaatatattatataatatattgtatactatatattatattatattaatatatataaattatatattaatataatataatatatagtatacaatataatatataatacattatattaattcatacataataaatgaattatataattcatatataataaattcatatataaataatatataataaattaattatatacctagatatgtagatatataatacatgaattactacacagtaatgtatataatataaatacataaataatgtataacataaattcatttaattattgtatatgataaatgcatatattatatattgtataattaatgtaatttattatatataatgaattcttatatataataaatgaattatatatctagatatataaagatatttataaaagatatttatatataaaagataaagatatatatctagatatataaatatctttatatatctagataaataattcatttattatgtattatatatttatataattaattatatattatatataataaatgaattatatatctgttacctttatacctgaattatatatatgtgttaccttttctccacatgaattatgtatatgtgttaccttttcttcacatatatataattatctataagtgttaccttttatccacatcctcaccaacatctgttgtttttagactttttaagaatagccattctgaggcatggcgcggtggctcacgcctgtaatcccagcactttgggaggctgaggagggtggatcacgaggtcaggagatcgagaccatcctggtaaacactgtgaaaccccgtctctactaaaaatacaaaaataatagccgggcctggtggcaggcacctgtagtcccagctactcgggaggctgaggcaggggaatggtgtgaacccgggaggtggagcttgcagtgagcagagattgtgctactgagctccagcctgggcaacagagtgagactctctctaaaaaaataaaaaataaaaaatagccattctgactggtgtgagatggggcatcatcataattttaaattacatttctctgatctttggtgatgctcagcattttatcgtatgtttgctagccactcgtatatcttcttttgagagatgtctgttcatgttctttgcccactcgttactgggattatttgtttttcagttgagttgttgcattcctggtggattctggatatcagttctttgttggatgcatagtttgcaaatattttctcccattctgtaggttgtctgtttactctgttgttatttttttgctatgtagacacttttttagtttaattaaatcctatctatctattttttttgttgttgcatttgcttttggagttttagtcctaagttctatttggggttttaatcctaagtttttgtccagaagagttgtttcctagactttcttcaggaattgttatagtttcaggttttaggtttaagttttgaatgcatcttcggttaatttttgtgtattgtgaaaggtaggggtccagttttattcttctgcatttggctaaccagctatcccagaaccatttattagatagagagtcctttccccatttcttattgaattttgggtgtggctcttttatcctgcaactgtcctgtgttaaattagttgtaggagtttgattgtggacttcttgggatttttttatgtagaaaataatttggaaatagagaccattttattttttccttttcaatctgtatatgttttatttctttttcttgctttactgcagtggttagaacttacagtatgatgttgaataagagtgttgagagaggatgtctctgactttttcctaatctaagaggaatgtattaagtctttcatcattaagtatgttagatgtagggttttttcttttttgcagatgccccttaagttgagctaaccgtcttctactgctaatttattgcaggtttttattatacttgtgtcttgaattttgtcaaatgctttttgtgtgtcgattgatgtggtcacatgagttttcttctttagttcattgaatgttggattacattaatcaatttttaaatgtagaaacagcattacatacttggtattaatatcacttggtcattgtgtataaattttttatacattgttgcatttagtttgctaatattttgttgaataatctttgtaaccaaattcatgaggggtattggtctgtagttttttttttgttgcaatgtatctatctgattttggtcattttatatggcattataaaattaattgaaaactgtttttcactcttctatttttggaaagagattatgtaaaatgtatgttaatttttttctttaaatgttgatagaattctctagtgaaatcatttgggcctggaaatttcattttttaggaggttttaaactatgaattcaatttcttcaattgttgtattggtcttcagattataagctgtttcttggtgatttttggttgctcatagtttcccagaaattggtcaatttcctcaaagtttctgaatttataaatataaagttgttcatagtatttctttataattctgtgtaatggctgcaggatctgcaatgatatcctctatctcatttctgatattggtgatttctgtcttctttttttaacttctcagtcttgctaaagttattaatttcataaaaaattttcaaagcatctgctttttgtttcgttggttttctcagtctagctaaaaatttattaatttcataaaaaatttattaatttcataaaaaatttttaaagactccactctttgttataatggttttctttattattttccagcttttaatttcatatagaactagcaatcaatttcattgatttctgcttttattatcgtttactttcttttgctttgagtttaatttcttcttcctttcctccagtttcttgaagtggtaacttcaatgattgctttgaggctttttctcatttatagcatttggtcttataaatctccctctcagaactgttttagctgcatcctacatattttaatgtatatttttgttttcctttgattctatgtatttttttttagtttctttgagggctatttgatacatgaattgtttataaatgtattgtttaatttcaacatatttagaaattttcctgttgtatttcttttattgatttcaggtttgattttattattatcagagaacatgttctcataattttaatttttaaaaacttgttgaggttttctttatggtaaggagtatgatatatcttgctgcatattccataggcacttgtagaaatgtatattctgttgatacgggttgtagtgacctgtatatgcatcagttaaatcctgttttgtccagattcctgtatatctgctgactttctgtataatttctgtaaattgctgagacaaaggtgtcaaaatatccaactgcaattgtggctttgtctattttcctttcagtgctattactttttgccttatgtttggaggctttgtggtttgggatgtagacatttaggagaactgtgtattattgttggaatgattatcatatcatgacataatgtcttcatttgtctctagtaattttctttgctctgaagtctactgtatcagatataaatatagctactcctgcttttatggataaatgtttgaatgatatattttttctgtcctttttatttaaatctatctctgccattgaattcgaggtgagtttttaaaagcatcacagagttgagtcatgccttcaatacagtgtggcatgtcttttggttggtataatgttattgcctaagtatgttatttcattatttgtttcctctggttcccattcttatttttctcttttcttgcctttcaatgggtgatttaaacattgttttaggatgctatcttgatccagttatagtgtttctaagttagccatgtctttctgtagttttcatagtggctgctcaaggttttatgatatatgtatgtggcctaaagaggctactgctataaacattttgccactttgagtgaaatgagaaaacaacctcattcccattttagttgtgtttaccttccctacatttaagtatcattggtggtgttataatttttgtttcaatcattaactataattttaaaaacctataaagaaatggatagtccattttatttactcatcttcctttccctgtttttttcttcctttgtggtgttccaagatttttgataaacatttctttgctatttcaagtttactgatttaagctcagtcacttggctttttttaaaatttaggttattgtattttttcattctataattcccatttggtttatttttatatcacctgttcctttgctaagatttttgtatttttttatttgtttcaagaagatttgtaattgattattgatttttttataatagctgctttacaatccttgtcatgtaatcccatcatctgaatcatcttggttctgatatcagctggttgtcttttatcattcaagttgtgattttcttagctcttggaatgacttagttgcatccagaaattgtatttattatgttaggagactctgtgtcaaatataaagcactgttttagcaggaagtgatcttgtttaggtcttggccttcttttgtgggctgttccaaaggcagttcaatgttcagagcctttacaatattatttggttggcttggtttacctattgccactggggctctccatggtctttgctggtgcctcctggaaggataggagattcatcaggccagccaactgcatgtctctctgtaggggagaggtgtggtggagttctccatcaggtcccgtttctcactcccacagttttccttatgtctctggatagagaatggggtctcagacctgcacattcaaacaagcctcctgtgctaatatatttgttatgtttccatctctcctttttgttctacccattcacctggtaatgtctttacatggtatgaattttcactcaaatgattaaataatctttaggtggaccttaggtgggcctcttaaagaatgtttaaatagaatattgaaaagttaggtaattctccattttccctatttatttaaaagttcagcagtatatgttattaatcatcttcacacctcttttaagagtaatataacattttagtaatttttatacacacattttttgatgttctgacatataatctaataattttgcatacattattagtgagtaaatctttagacaagagctgaagatctcaaatgaataatagttttggttgagtaagatattatgtgagcaagaatttttctttattagcatggtttttgcgataacatttcttgaattgtatttattgtttcaatagaaaagccaaatgtatgttggtttttactttttataatggactctgattttttcctgattggtagatgaatactttacttaaactgactattattatactattatgttctactataatataatgcacattattgttattatttatttaacataccaaaatatgaaaacaacattaacaattaatatagcacaaaataattatgcaatattattggagacatgtaatattctataaattaagtatatatttaatacaattttaatattctaattgatttaagtcaaaaagatactatgtgaagttaaattaacatactgtttttgagagaaagcttctgagtagacttgctaaatacaaatttatttctatttagtaacattttgataataaatagcacataaaaaggaaacagagtccctgttacttcttgctcattttgaaacatatggaatacaaatatgatctgaagcctcccttacccttgaaatctaaatgatattagctcaaacctccattacagagtcctgactctcctgtttctgcatatagtcattattatgacccaaagacaaaactcactccaggtataaaactctttcacaacgtggtgaatttagtgacagttttttgataattaaagaagatcacataaatgtatgtcataaattagaaaaatttaatttcatccatgaaacttttctttcttagaaggccttttatccagctcaccaagggagtttcccattgtcctgttacctcatataattacctgttgtcctttcttccctctttctttttattttatcatatggaatagtaaactatcttcccttgctgctcatactcatgattttaagatctcacttctctgctcaatagttctcaaacctggctgctcctgagaaacaactggatcctctccccagagtttttgatataatgctctcaaggggagcccacacatgggtatattttaaaatgttcttcagataattcttgaactcaaaggactaatcaagttatttttcccagtagtttatctaagttgacttctggtactaaatggaaagaaaataacacctctggcttcttacatatgattacatctttacaaactgaaagtacatagtttatttcatgtttacttcagtgtagtcacaatttttttttccactggacactcacagctttttaatgcaagtttttgataatatgaattctaatattttcttgaatttttgaatgtgttagccaggcacaaaatctgattttttgactgattttattttgtactttttggctttgtttttagtattgtttcgaaatgcattgtaaacatgttagattcctgatgaatttaaaattgtgtgatgcttctaatcattgtgatcgtcatggagtaagtaactgcaatgtttattttaaacaacttgcttttaacaatcaaacaatttgaggattttaaaaaaataaatgactttttttgtttgccatttttatgtcatttggtgtcatttaatagtctataatttataacctcaattttgtcttcttaagaaacttatcaaactatttattaaagaagacaaagagaaaacatttaagatgattctggatatattaaatgtttgatggatatgtgaggaggatgtgctataagcaatagaagatagaaactggtaaataaagaccattagaattttcttgctagtgctgcaagttaatttagagtctgggctgtcagctagcaagtaggttataattagtgacaggttactggtaatttgaggtatttgggcctggctatggggggagttaaaagaattttttagaaaaaaatttgatttgacaacacaagatagatgtactttgtgtagtatgaacattagcaagggaaaatttgacaaatttatctatttagataaattctctagaatgagatactctgtggaataagtatagattattcattagtctccatcgaaattattcttttttttattatttaaggtttgcaacaattttaaccattgccattgtgaaaagggatataatcctccttactgccaaccaaagcaaggagcatttggaagtattgatgatggacacttagtaccaccaactggttagtgttcttaaaattgtattaattatgcacagtatgtaagatagtaaattataggtttcaagccagattacaaagcaactaatgtcaacatgcttttttttatttataagatttaaaaaatgttgacagtgcaagtttatactgttctttctatatcagcattgacattctttactgagaaaaagtatggccaatgttaggcagttttaaaagtagaaattttggtgtgtaaaatttgaccagttaatttaaactgttcactttggattatctcctatatttatatttactattatatttatatttactatatttattataaactcctataaactagagtttataatagtgtcagtatagtcattattatattaatgcccctagaatctttcaggctgtcttttcttcctattcacttataattggttatttttctcctgcattgtaagggctccatgctaatctttggagatttgctctttctaatcctgtcctgatgttcctgagtagtattttgagattaatcaggcctagatgaattgggctcaactggtggtgaagggcataccctggttctagaaggtatgagcctacccaaaataactgggagcatagatgggctgcgaactctacccccatctctctcttttttgtgtgtgtgagacggagtttcgctcttgtcccccaggctggagtgcaatggcacgatctctgctcactgcaacctccgcctcctgggttcaagtgattctccagcctcagcctcccaaatagctgggattacaggtgcccaccaccacgcccagcttatttttgtattttcagtagagacgggtttcaccatgttggccaggcctctacccccatctcttttaggaccttgcaagaaagtcctgaaactttggggcagacttatctgtagcttgggtgctatataaacacatacctaggttgatcaactttttaaagagacaatacaaagccacatcaaactatgtatcagacaaaaaaaccccataataatttagcctataacctgtaactatacgcatatattattattttcacatgataacatgaaaaatacatgtttatttgaattatgtattttcagtaaacagtagtttacaatgagaaacagaaagtcctataatatagcaatttaactctttaaaaatcctttactagttcatatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagaccaatggaacaaaacagagccctcaaaaataatgccgcatatctacaaccatctgatctttgacaaacctgacaaaaacaagaaatggggaaacgattccctgtttaataaatggtgctgggaaaactggctagccatatgtagaaagctgaaactggatcccttccttacaccttatacaaaaattaattcaagatggattaaagacttaaatgttagacctaaaaccataaaaatgctagaggaaaacctaggcaataccattcaggacataggcatgggcaaggacttcatgtctaaaacaccaaaagcaatggcaacaaaagccaaaattgacaaatggatctaattaaattaaagagcttctgcacagcaaaagaaactaccatcagagtgaacaggcaacctacagaatgggagaaaatttttgcaatctcctcatctgacaaagggctaatattcaaaatctacaatgaactccaacgaatttacaagaagaaaacaaacaaccccatcaaaaagtgggcgaaggatatgaacggacacttcttaaaagaagacatttatgcagccaaaagacacatgaaaaactgctcatcatcactggccatcagagaaatgcaaatcaaaaccactatgagatatcatctcacaccagttagaatggcaatcattaaaaagtcaggaaataacaggtgctggagaggatgtggagaaataggaacacttttacactgttggtaggactgtaaactagttcaaccattgtggaagtcagtgtggcgattcctcagggatctagaactagaaataccatttgacccagcaatcccattactgggtatatacccaaaggattataaatcatgctgctataaagaaacatgcacatatatgtttattgtggcactattcacagtagcaaagacttggaaccaagccaaatgtccaacaatgatagactggattaagaaaatgtggcacatatacaccatggactactatgcagccataaaaaatgatgagttcatgtcctttgcagggacatggatgaagctggaaaccatcattctcagcaaactatcgcaaggacaaaaaaccaaacaccacatattctcactcataggtgggaattgaacaatgagaacacatggacacaggaaggggaacatcacacaccggggcctgttgtggggtggagggagaggggagggagagcatttggagatatacctaatgttaaatgacgagttaatgtgtgcagcacaccaacatggcacatgtatacatatgtaactaacttgcatgttgtgcacatgtaccctaaaacttaaagtataatttaaaaaaataataaataaaaaaataaaaatcctttactgggcatttaaatttttatttttatttttatttaaatttctatttttatttaaaattttcagcctatattatataccctgaaggtacataaatgtaagactttcaaagaaagaacataaatcagctaattgcttcaacttgggaggtggaggttgcagtgagctgagggcatgacactgcactccagactaggtgacagagtgagactctgactcaataataataataataataataataataataataataaatacagtcatttagcctccttatctgtgatatcttggtcatgctggtgttcgtattataattgttctattttcgttatccaagttcttagaaaacacaattacaatattctcaatttgaaaaattatatgtgtgctatcttgatgcaaagcacaacagtgattttgtagtgtacgtcaaagatggactgttaacactgatgcttttgatacctttaaattgcacatttaagttacattaatcagagtgaacacacaaattgtggttgccaacgtcagcagtaatggaaagaaaaagaaaaaaaagcagcaatagcaactatagaagatggataatcggtgatttagtcatttgacactaaaacagtgttgcttttagtccctatttttttcaccttttatatttcgttttatattaatattttatatttggttcttttccctgcaaccttccacactagttgccaaccagaaatttttctgtcccagtgacagattcactagcatgtaagactttcagtactacaactaggataagttctaggcaaacctatgtgattggtatcctaggcctaccgctctaagtccagatggaagtccagatcgcagcacatgagcctgcagtcagagaaaaccttctaacccaactagtttcctttagccagctgccatgggctcttctttcatctcttccattctggggcttacaggtctaccctgaaagacctaggctgatatgctagttggctgtatgttttgtccccatgtagtccctttggaggccctctacccagtcaaggaggccttgagctttccccaataaagcctggactcaatgtgggagaaacacttgtgatcctgaatgcattttaggacataaagagtttgggctgcaatggtcatctaaatgagtccaggtttatttcatcatccccattctgcttacttttaatgtcactgctttgtgttaacataatatgacccagaaaaaatgtcaaattatggattttatgattgccttaattgtaagccaaaaacattgttgacttttgttactatttcatgaatattttcaaggaacttacaatctgttctacagctctatgtatatagatataatcatataaaatatgtacataattgaatatatatgtgcttgtatgtatgactatcagctttttgcatatgctggagtctaaattcacatatatttttgcctaattgactacttagtatataaaattataaagagtatattttaatctcactttatgatttttctttccatagtttttcattttatcctaaacctcagagatgaccattaataatactatatacattcctgattttcagaggttattattaacccttttaatatttgacaagttcatagaccagaaaaaattatattctacttacatttctttaatgttatggggcttcccagttgcttgatggtgataggaaatttataatttttctatgaattactatttcatcaccgttgtctctctattcttatgggtttgtttgaccttttataacatacgcatgcaaacacacacacacacacacttaagtgttgcacaatactcataaaatttaccatctgaatgctttttaagtgtataattccatgacattaagtacattgttgtgcaacatcatctctctgcagagctctttccatgttgcaaagccaaaactgtaaatcaattaaacaataagccctcattcctcctcttcccaggccctgcaaactattattctattttctgtctctgaatctgacaacttcagtaactcaaaaatggaatgaatcatgctgtatttgtcttttttgaaaaagcctggcttttttcactaagcccgatgtccttaaggttcatacatattgtagtgtgtgtcagaatttcatttcttttaaaggttgaataacattttattgtatgtatataccacattttgtttagctgttcatctgtcaatggatacttgggtttcttccacatttgggctattgtgaataatgtttctgtgactatgggcttacaaatatctcgagactctgttttcagttattttgtgtatatgtccagaagtgaacttgctgtgtcatatgatgattatatttctaaatattttgaggaatcaccatactattttccagcagcgactttgttttacattcccactagcagtgtacaagttattttctgtttcaatttctccacatccttgtcaatacttgttattttctgttttttttttttttttttttttctgattatagccatcctgatgggtatgaagtggtatctttttgtctctttcatccctgtataggtataatagggtcttatagatcagaaatttatcatttttaaaaagggcatggttttgttaaaaattggttattgggagatattttctgtcattgtatttcaacattacttgttacatgtagaaaatctactgatatttgtgcataaattttatcaatggattatcactatattgagaagtctatttgtttatttttggggatgaacatttttgaaatgatgtaaactgcaattaacagtaattttgccacatcttttcaacaataattctgtgaatggagagagagagagatagagagagacagaaagagagagagggagggagggagcacatgcattctggtctctcctctttttatgaagacaacaatcccatcagattaggaccccacacttattacctcatttaaccctaattatttctcaaagtcctcatctccaaatatcatcacattgggggttgaggcttaaacatatgtatttagggggacacaattcagtctataaaattccactctgtgttccccaaattcatgttcttcttacatgcaaaaaaattcatcccatgccaagagtcccaaaagccttaagccattccagcatcaattttaagtagaaagtctcatctgaatagcatctaaatcaggaatgggtaacatttgagatatgatttatcttgagacaaaatttctccccaactgtgaaagtgtaaaaccagacaaattatgtgtttccaaaatatattttatttatttatttatttattttgagacagagtctcgctctgtcgcccaggctggagtgcagtggcgcgatctctgctcactgcaagctctgcctcccgggttcacgccattctcctgcctcagcctcccgagtagctgggactacaggcgcccgccaccacacccggctaattttttgtattttagtagagacggggtttcactgtattagtcaggatggtcttgatctcctgacctcctgatctgcctacttcggcctcccaaagtgctgggattacaggtatgagccaccacgcccagccctgtttcaaaaatatagtggtgaaataagcataggacagacattcccattccgaaagggagaaattagaaggcaggaagaggtgatgggtttcaagaaattccaaaacctagcagtgcaagttccgttgtgtcttaggcttgagagttggccatacactacacaccagacacctcaattgctttgtctttagtctcccatatgaactgagatgtaaattaaatcctatccaaatcctatttggctgaatgttcttccttccaggctcactgaggtggtgcattacttccacaatcctaggtggcagtcccactcccttggcttgggagcctaccctgttcatactatctttacaatgtcccacccataaggcactgggctagggcaacttggtccgctgaaattaaaaaggaggccccgccctgtataaccaaagagaatgcagccttgatcctttggtctgtggcaccccgataatctttgagtcaaaggcgcaattattctttacttttcttgaaagataaagcatgctcatagcaaaatagcccttttgtcccattctttttccttcatttccaactggcaatgtctctgccagtataattccatctatgctggtattgtcttatgtttctgatttctgctgagatggctgattaaatccattattcacatccgtaatctctttatcaaatgattttctagccacacccttggtattctctccagaacacgttttctgattttgggaaatatggataggctgagaatttctggctaacaattatttcaattacttctttaatccatctctcctctctttcattttaccataagcagtcaggaggactcaggccataacttgaacattttgcctaggggtcacctcagctgttatctaacgtcagcttgcaaactctatctttcacaaaactttagaacacaagttagccaagtctttgccactttttaacaggaatgacctttccttcattgtccaataacatgttgctttatttctgtctaagacctcactagaagcacctttaatattcatatttctcccaacattctgttcatgattatgtacatattctctaagaagaggtaggcgttcccttttctctcagtgccctcaccagaatcacctttaatatctatatttctatcaacagtcctttattgcaatctaggctttttttagtttacaccttaaaatgattccaacctctacccattacccagtcccacagccactgctgtatttttaggtatttgttagagcagcacctcatatcttggtaccaaaatctgtattaatcagggttctccagagaaactgatcgaataagatattagttcatcatatggtggaaggttgagaactcaaaaatcatcaataaaacactagtaacatcccatttggtacattagtgtttttgtttttattatattcactttatatatataaaagaaatgtttgatgtttggaaatgatgttggtaatgatatcttctccttttcattgggataataaaatctctgacgtaacttaaaattgctgtttttcattccagagagaagttacatggaggagggaagataggccacttttcaaaaacaacggtttcaactcattttctacatttctctacctgtgcttcttattactactgccattttaataaaacagaaaaaattgagagagctatgctatagaggggaaaatgaaagtgagaggtatgtatatacatatatatgtaaaaaaatatatatacatatatttactcttattacattaagaaagacaagaaaaatgtatttatgtttcatcaggaataatctccaactgtagctaaggcaatataaagagaggctcagggagacattttaaaaatggtttgatgctgtttgttatttgttttgatattttttctcatcttacaaattactaaaactacagagtttaccactagtatcatggtaagagcagatatggctgccaggagaattttggaggtttatttagcctcttagttcaccgaccctgtccatacagtcatatcacctatgagctctattagaattatatgacactgcatttcaagggaacttccaaaaactaaatttattagatacagattttcaggccagtgataaacatctttattagaacacctctctcaattagagataatatctataaacctattttgacaatatttatttttctaaatatagatattgctgatttgtaaaatcatttcttaattagaaactacatgtgtagttaataatgtcaggttaaagagacaggaggcaccaccatgtaggaagagaattacgcttagcttcaggaaacctcgttttaagttataaatcttgcatgtaatactgtgataccgtgagtaagtgatttaatctttatttccttaagattattctctataactctacagaatgggaggtaataatagcttttcaatttatctaaacttttgagtacatccatttaatgagtgaaatcatcatgttatctgtaatcagttgcacaaatttttaaacatcatattgagccccttattcataatttacaatatttcatcacagatatatttacatctaggtttaccctccgagaactgatgcaaagataaaacgtgtttatattttctgagagagagaaagaaatatattgatctgtaaagaaaaagtatttaaaatttttgagtgctactttatggtttgccttattggaacggaggaattagggatatcataaaataaggggagctgcctatataaatgtgggtttacaaacataaattcttgattaaatgtagaatgagaatgagaagactcagttaccagactgaggtaactgatggcatttgttctaatattgaaacagtacctgtttaagttgttaaaaggagacctttcatttatttgaatcgctgtttctttgaagaacagttttcattcagttgtttaattattcaagaattacaattttcatcactttaaaacaaagtttatcaattttatagctctgtgtcagaagaaagcagcagtaacagcaagtcatccctcagtgaaaggtgagtatgggactatgtgttgaatcattttgcattgtaagttttgatcattgcttaggagcacttaaaaatggttagtttgaaaccaagcattctttatgtatttgtttaattctctccataggtcattttataataataaataataaaaccttggttttgtgaaatctcagcctctccttgacctataaaaggagagatttttgtgcactcacactggcaactaccatctatgagcatgtaaattgtgagttgtttttttttttttagcatcggggttttttttttttaagcatttttttttttagcatgtgttttagtgatatcttactggcatataaaaagataactgatgctctaatcagcggtaccatcctttttggcatcatggaccggtttagtggaataaaatttttccacagggtggggtagagggggatagtttcagctcacatcatcaatcattagttagattcccataaggagtgtgcaacctagacctctcatacgtgcagttcacaatagagttcatgctgctatgagaatctaatgccactgctgagctgacaggaggtggagctgaggcagtaatgcttgctggcctgtgctcaccttgtgctttgtggcctggttccttttatttatatgtgtgtgtgtgtgtgtgtgtgtgtgtgtgtgtatatatatgtatgtgtatatatatatgtgtatatatatgtatatatgtatatatatgtgtatatatataaattatactttaagttctagggtacatgtgcacaatgtgcaggtttgttacatatgtatgcatgtgccatgttggtgtgctgcacccattaactcgtcatttacattaggtatatctcctaatgctatccctccccctccccccaccccacgacaggccccggtatgtgatgttccccctcctgtgtccaagtgttctcattgttcaattcccacctatgagtgagaacatacagtgtttggttttttgtccttgcaatagtttgctgagaatgatggtttccagcttcacccatgtccctacaaagacatgaactcatcattttttatggccgcatagtattctgtggtgtgtatgtgccacattttcttaatccagtctatcattgttggacatttggcttggttccaagtctttgctattgtgaatagtgccacaataaacatacgtgtgcatgtgtctttgtagcagcatgatttataatcctctgggtatatacccagtaatgggatggctgggtcaaatagtatttctagttctagatccctgaggaatcaccacactgacttccacagtggttgaactagtttacagtcccacgaacggtgtaaaagtgttcctatttcttcacatcctctccagcacctgttatttcctgactttttaatgatcgccattctaactggtgtgagatggtatctcattgtggttttcatttgcatttctctgatgaccagtgatgatgaacattttttcatgtgtctgttggctgcataaatgtcttcttttgagaagtgtctgttcatatccttcacccactttttgatggggttgtttgttttttttcttgtaaatttgtttgtgttctttgtagattctggatattagccgtttgtcagatgaggagatagcaaaaattttctcccattctgtaggttgcctagtggtctgctttctaagaagccatggctgtggggttggggacccctgctctaaatgatgtcataggtgcttatagttctgctattatttcagaaaaaaaattactgagagtaagtttgagcattgaaattatcattcatttccctgtctcaattcatctgagatagtaaatttagggatcagattatgaagaatcaaacacaacattttataaaattagatatccttcttttactatcagtatatacagattttccctaccaaatgttggatagactataaaatgggagagtatttcaagtagcatccaatattatttctcatgttctctcttcatccttggagtacaaagttaaacactgactgtgatgattcatttagtaaatattgagatacatatctgcagtgagggaattcctgcttttaagagaagcactgttaaatatgggccatcaccgtcctaattctattgttaatgttggctgctttaggttctacaaaaattaagcatatctctgctttctaggcaagattatctttgatccttactttgatcactttgtgatgcatattatagaagagaaaataatcaaaagtgtttttattataattcctaccaagaagatagaaaaaagagctacttacactcaaaaattgtggatggaaggaagtactaaagagcagaaataatgtagaggaaaataaacagataaaaacataagcaaagacaaaagctgattctttgaaaagattaatataattgataaacattagctaatagttcaaaataaaacgagaaatgatacaaattactatcatgtaataaaatgatatcatgtctaattttctggacattagaagaagtcaaagttgataagtttaaatatttagttaaaatacaacacatttttaaaaaaacacttctttccatcttcccaaaatggaatagagagaagaaaaagaaagtataaagaagtctatatttattcaagacctggaagctgtaatttagaactttctcacaaagtggatacttgagcatgatcttttcatggcatgcatcagaacacaaagccaagccaaattcagtgaacatttcctcaattccatcagcttatgttttattatataaacaagtaacaatgtcaaactcagtgtcaatgaaggtggtgtgtgtaatatactccatccactataatgggagatactacaaagtcacatggcaaagaacatgtataaataatcgtatcttaagatataagtgaaaaattgaggacaataattcaaactattacatccagatgtttaaggaggaaatacagaaatacagcagtcctcccttatctgtgtgtgtgggagacattccaagacccgtaatggatgtctaaaatcacaaatagtaacaattctacatttacttgttttttcctatatatatgtacctatgattaagtttaatttgtaaattagacacatcaagagattaagaataaataataatataattgaacaattataatagtgtaatgtaataaaagttatgtgaatatgatctctctgtctcaaaatactggagttttttttgaagtgtggttgactgaagataatttaaagcataaaaaacaaaactgcagataagaggggactactgtaataccactcttacatatacttatgccgagaatacaacaaagggagcatttctcatcatgttttatgaggtcagcctagctttatggcccccaaatttaagggaactatcagaaaagaaaattatagatctatttctaattagagatgtagaaatgctaaataaaagatttctaaataaatccacttagtattatagaggatcatatattatggccatggagatagcctaggtatctaagaatgaaaaactagtttaaaatatgttttaccatattaaggaaaaggagaaaaaattatatgataatttctatatataaagaaaaataccctttaaagaaaaaaaaacacttttatgataaaaattcctagttaactagtgaaaaaaacttttaaaaactgataaggaacatcttcaaaaaagcatacaactattttagttaatagtgaaatcgtgaatgtttccttcctgaggtcaggaggatgtccgttattgttttcaacactgacattttcaacatcatatgggaaatcctagctggtaaaataaggtaagaaagaagtaagcaaatgtagtaagatcagaaatgaagaaagaatactgttattgtttgcagatgatatggcttcaaatttcaatgcacaaaaatttgaagaaataacaaaacaaaattaataaagaaaatataaggtttttggatacaaggctacatataaaaatcaattttatttttgtgtaagcaacagttataaaatgaaatttaaaaaatgcaactatatatagtatagggaaatatgtatatatgatacatagggatatatatccagtgaaaaagtgcaatacagttacacttgtaatataaaatactgctgagaattttaatatctaaaccagttgaagaacatactgttcaatatttttaagatataatttttccctaattgatatgtagatttaatgcaatcccaaaataaatatcttgacattttttggtggaaaattaaaattagattgtaaaatttatataaagataaatggagtcatatagtcaacaaaatcttgaaaacacaggaaaaagaaaacttatactacctgatattgacaacttttgttaagtaatcaaaacaatataggagcatcataggacagacaaataaaccaataaaaaagaaggaagtgttcagaaacagttgtataatatactcacatcttatttatacttctggtgccactattatttagtggataaaaaagtgatcttttcaatatatagtaggttttaaattgcatttccttgatgacatatgaattagtgatgtggagcacctttccatatacctgttcttcgtttttatgttttccttggagaactgtctgtctagcttatttgcccattttttgatcaatttatttgtttttctgcaattgaattgtaaaagtattttatacattttggatattaatcttttgccagagatgtggtttgcaaatatttttcctagtctataggttctcctttcattatattgcttctttagctgtacagaagcttgctagattaacatagttccatttattcatttttgttttgcggcctgagctttggtgtgatgtctaaaaattaattgctaaggccagtatcaaagagctttccttctatgttctctgttaagagttttattatttcaggtcaagaatttaggcattttcttcctttttgatttcattgttgtgtatggtgtaagaaagaatctgattttattcttttgtatatgaaaatctagtttttccagaaccacttattgaagagactactgtttccccattctgtcctctaggtgcccttgttgaaaattagttgatcatatatgtttggatttatttctgggctccctattttgttccattggtcaatgtttctgttttgatgtcagtgccattaatgtcttgattactatagctttgtaatataacttcagatctggaaggcaaagtctccaactttgtttttctttctcagtattggtttaactatttggaattttttgtggttccatattaattttaggtttgtttttctatttctgtgaggaatgccactggcatttctagagagattttgttaaatctgcatattgatttgaatatcatgaacatttcaatattattttgatccatgaacatggtatgtctttacatttatttgtgtcttcttcatctcctttaatcaatgttttattgtgttcagtgtacaaatgttccaccttcgtgattaatttgaattctaagtatattatgtttttgatgttatcagaaatggaaccgttttattaatttctttttcagctaggtggttcttcgtatataaaaatacttgtgattttttatattgattttgtatcctacaactatactgaattcatttattggttttttctaagctttggggttttctacatataggattatgtcaattgcaaatagagataatttacttcctcctttctgatttagaggccttttatttattttccttgtctgattgtatgtactagtacttccagtactatgttgaatagaaatgatgagaatgggcatttttgctttataccagatcttagtgcaaaagctttatgatgttagctatgggtttttaacaaatgtcctttattatgttgagaaaactgtcttatatatctaaactgttgaaaatattagaaaaggatgctgaagtttgtcaaaagcttttttgatgagtctgtcccacagactctggccaggcaaccaatgaaagaaatacacagacacaggtattttgcctgagaatgcagctagggaactgcacagcttagcaccgctgacaagagtgcagctccaataagctggagatgctcgtatttattcagtgcagatttaatgacaaaggcttggagcaaacacaatttgtgggtaattaacattgtccactcccctgagtatagagcagtcctacagtaaacaaatttatctagataagttcctttacattcccttgttatctaccctttgccctcagcctctggataagagaatttggctgccttcagccataattctcttctgaagcttttgcaaaactacccagccttccaagaaggtttgcgtctttcctatttttcccaccaccctgactgatcctcctacacttctttgtgtgtaaatttacatgatcatgaggtttttattttcttattctgttaatgtgatatggcatattgatttgcatgtgttaaagcagacttgcatgccaggaataaatccaacctggttatgatgtgtaaacttttgatgtgttgttgagttcagtttgctactgtattattgatgattattgcatcaatgttcatcagagatactggcctgtagtttcatttatttatttttttgggcagtgtctctgacttaggcatcaaggtgatgctggtcttgtaaaatgttttagaaagtgttcctttcagctctaatttttggaaaaatttaagaaatactgataataattcttccctgaatttttggtagaattcagctatgaaaccatctggtcctgggatttttatttgctgaaatgtttttaattcttcaagctatctatttcctcctgattcaatcttcagatgatatttttctaggaatctatctatttcctcaaagttatcaattttgttgacgtataattcctcataatcaccctttttaaaacttttttatttctgaggcatctggtagtgatgtctccacttttatttctaatttatttatttaagtattatctctctctctttttaaaaattactctatctaggagtttgccaattttattttttaaataatcaactcttggttttattgatttttttttcttgtttctcggtcatctatttgatttatttcagttctaatctttattatttcctttcattcaataactttggatttcatttgttctttttacagctccttgaggcacaatgtttggctatttacttgggatctttcatcttttctaatgtaggcatttattgctacaaacttctcttttagaactacttttgctgcatcctgtgctatgtgaactccaggaagctccctaggttggtgtcagtggctgtaaggactacaggattctccagtagcaaagagtgtggtgtctgtggtgataatgggaactgttggggtctactgcttacctttttccctgcagaaaaacttcccttcaggttttgatctgattctgactgtggggatggggtagcacagggaaagtgttttcttctcttctctatgcagccatcctgagtgtctatgcttcacaaaatttctgccactcccttgatgtacacctgagctctccttagtctttttggtcaaaactagcttatttgttgttttggtctttttgtgggaggagatgagcattaggcacctctagcttaacatctagctgatattcctcagaatatgtaatggtggtgggtaaatcacttttaattctactataatatcaaaagacaaaagcattaaaataattataagtaagaatatgttaatgggcacataatgtaagttgtaatataaagtgtgacatcagtaacaaagtattattgggaggacaataaaagtgtattattgggaggacaataaaagtgtattattgggaggacaataaaactgtagtgtttaaatgtgattaatagtatcagttcaaaacaaactgttacaagatttttaaatataagctgcatagtaataaaaatacttacagaagttacacaaaagtgaaagagaaaggaattatacaataaaaaagtaaatgaaacatgaaggaatacagcaagagaataaaagagggacaaaataaccataagattaaacagaaaaagataattaacaaaaggcattagtaaggcatgatggctgaatagaatccttcagcaattgtacgcactaccaagaacatcaagtcaaacaattatcaatttaagaaagcatcttcataggagcccaaaaccagataagcaatcacattacatggtgttagcataataacgtggaaggatgcactgaaggaggtcaaaaggacagagttccatttcctgcatcacccctcccccagtgccaggcagtatatcacagaagagaggctgtgctcttgggggagggaaagcaaagttggtgtggaactttgcactgaaactcagtgctgcactgtcacagcggaacacagcactaggcagaattccaccagtgctgacagcgagcatttagatcagtcgtgggccaaggggactccactgcttcagcacgaggaacccaagtctcagcctacttcactgcaggctgatgaacatggcctggggccccaaataaccttgagtggcagctaggccatagtgactacagtccttgggtaagccctggtgctgtcctggtctcagatgctgtaggcttgatgtacagcccagcgcaacactagctgtggcagccatgagagtgcctacatcacccctttcccaattccataccatgtagtatggagagagactttttctgcttgggagaaggaggggaaagagtacaatagactttattttgcaaccaggtaccagcccaggcacaggaaaataaagcatacggcagaatcccaaagtcctaatttcaggtcattgctcctaaatggtgtttctaggtcttctaaactttggttagaagagatctggctgcccttgtgggatggaccgttgtccaacctgtgtgatgaaccaccagttaactaaagtagccttgaataaacatcaatggcagtcaggcaatggtagcttcggtcctcagatgagccccaggtgagccccagtactatgctgatctgggaggctgtaggcttcaggtgtgacacagcagggtaccagctgtgatggccacaggagtgctcgtgtcttccctttcccaattccaggcagcccactacacagacagattccttctgcctggggaaaagagagagaagagagcaagggactttgcctgtgaacagaggaatttctccctattttcctccaagtccatcagagttgtgtatttaggagtctgcaagagatacagcatatctgggcttagagatccctctagcactgaaacgcctgtagaggcaacagacttgagtaacttaatactcaatcttctttaaattcttggaaagtcatttgaagaagggcaagtaaaaacaaagccagactctgaagactagaataaatacctagagacatcaatagactgcaatgcaatagtagtaggggccttttaacaccacactttcagcaatggtcagatcaccagacagaaaatcatcaatgaactattggaattaaacaacactagatcaaatggccctaactgacatttacagaatattttatgtaactggtgcagaacatatgttaatttcatcagcacatagaacatcctccaggacagatcatatgtaaagccacaaaacaagtcataacacattcaaagatggaataatatcaagtatcattttgaaaaacaatggaatgaaactagaaatcaatgaaaagaggaactttggaaacgatacaaatacatgaaactttaacaatgtgctcctgaaagaccagtgtgtcaatagagaaattaagaaagaaatatttttaaaaattgaaggaaacaaaaatggaaacagaacataccaaagtctgtggaatgcagcaaaaccagtactaaaaggaaagtttatacctatacatactgacatcaaaaaagtagaaagacttcagttatgcaacctcatggtgcactgcaagaaaaaaagcaaggacaaaccaaaccacacattagtagaagaaaataaataataaaaactagagcagaaataaatgaaattgagaattagaaaggtccatgaaacaagaagtttgtttttgaaaagataaacacatcttttgctacattgactaagaaaaagaaaaaaatggattgaatacttaaatgtaagatacgatttatatgaacccaaatcagagaaaaatcattacaattgacacttcagtaatttaaaggcagcattcaagtagagatattatgagcaaaagtgtgtcaataatttggaaaacctagaagaaatggacaaatttctagacacattcagcctatcaagattgaaccatgaataacagaaaatctgaacagatcaataatgaataatgacatagtagctgcaataaaaagttttccatccaagaaaagttcaggactagatagctttaatattgtatcctaccaaatatttaacgaagaactagtaccaattttactcaaactattccaaaaccttgagaaggagggaatattcccaatatcattctacaaggccaacatttccttcaaaaaccttacaaagacacagcaataacaacaaaaaactacaggccaacatcctgatgaaaatgcaaaaatcctcatctctactaaaataccaaaaaaaaaaaaatttagccaggcatggtgatgcaagcctgtaatcccagctacttgggaggccaaggcaggagaataacttgagcatgggaggcagaggttgcagtgggccgagatcatgccaccaacctccagcttgggtgacagagtgagactccatcttaaaaataaataaaaatgaaaataaaaataaaaataaaacacttataaaagaaattaaagaggacacaaaaaagtggaaatatatcccaagctcatggattggaagaattaatactgtttaaatgtccgtataacccaaagcaatctacagattcaatgcaatcgctatcaaaataccaatgacgttcttcacagaaatagaacaataatccaaaaattcgtatggaaccacaaaagatagtctctttaacaaatagtgttgggaatactttatatcctcatgctaaagaatgaaattgggccattatacacaaaggccaactcaaaatggattgaagacttaaatgtaagatatgaattataaaactcttagaagaaaacatagagaaaaatcttcatgacattggtcttggcaatgatttcatggatatgacatgaaaagcacagacaacaaataaaaaaaagacatatggggcaacattaaactcaaaagcttcttcatagcaaaggaaatgctgaaaatccaatggaatgggagaaaatatttgcaaaccatttatcagttaaggggctaattcccaaaatatattaagaactctttcaactcaatagcaaaaaactaataacctgattaaaagttagctgaagacttgaatagacattttgccaaagaaaatatataagactcttacaactctgtagcaaaatacctaataatttaaaaaatgggctaaagacttcaatagacatttctccaaagaggacatacaagtggccaataggcatatgaaaagatgctcaatttcattaactatcaaatgtatgctaatcaaaaccgcaatgagattcacctcacacctgttaggatagatcttaaaaacaacaacaacaacagagaaatgttgaggaggatgtggagaaattagaatctttgtgtatactgttggtgggaatgcaaaatgttgaaaccattatggaaaatgacatggagggttatcaaaaattaaaaatacaattacaatataacccagcaattctacttcttgaaatttatggaaaagaattgaaatcaggaaaccgaagagatattagcattctaatgttcactgaagcactattcacaactgccaagtgtggctacaacctaaatgtccatcgataaataagtggataaaaataaatgtggcatctctctcctcctttctctctctctctctctcgctctctctttctctctctctctctcactctctctctctttctctctctctctctctctctctctgtgtgtgtgtgtgtgtgtgtgtatgtgtatgtatctaatggaatattattcagccttaaaaagaagatcctgtaatgtgtaaaacatggatgaaccttgaggacaaacactgaataattccacttatgtgaggtatctaaaaagtcaaactcacaaaattagagcagaatggtggtttccaggaaccagggggtggagcaaatgggtagttgcgtcagtgggcataaagtctcaaatatgcatgatgaaaatgttctagagatctggtgaaaaacattgtccctaaaattaacaaaaccatattgtacacttaaaaatgtggtaagatggtcgatctcatgctgtgttcttaccatatatagtacaaattttttaaaataaatacttttgccatttataagatacccttaagaagggaaaaaggaaccgcagggatgcggttacactggcgagaaaacagttttggcggcggggagagttggggagggtggagggggtgttgtgatgggaggggtgatttacagagtgagtagcagatgtggaaggtgggctctacagataaagacttcgaggaaggttgtttcccagggcaagggaacacagagagtgagggagtcttgtcttgaaagcaggaaacaaaggactaggaaacttaaacaagttaaccctttgaagaagaatgtcttactgtatttaacattttgaaagtctattattgtgaatatttatgccacttccagtttttagttattacaaatacaccgtaataagcattctggtatgtatatatatctgtgagcaattgtcaagttatcgcctgagataaatccctagaagatatcaagaataaatatagtgtaatatgaagacttttgttgttttaaaatatctattactaaattatcagtccatttgtatcaagttgtaactttcataatttattaatttattagctagtttggatatgtgagtggtatactttctgagccctagcatatcttaaattctacttcttttattttactaccttactgaattttctttgtaattttccactatgtcactttgtaatgagctatttctataaagaatatagaaatagaagtagaaaatacgaaatatgaacatctggaattagaggcattttgagactccctttagtatgaaggaagcttagcatattttacctttaaaaaatctctcccttcactaatctttctgttatgtaaattgagattttagacctagcctactgttaataaatttctgcttttaaatattatttattttggttctaaaatattttgtctttttcagttttataaagtttacagcaaacattttgaattcatttatatttaactggttttattttttaaagttctaaagaatgattttaacttttaatggtgttaagatccttttctagccagagaacttggaatgcatgaatcttaactttaccatcactttcttctcttattcaataaataatgtgtgcatgtgagtgtgtgaatcattcttattattatagtagtaacacataataaacattgattaaaatatatatgtgagtaaaagaatgaaatggtaatcatcattagtcccagcaccaggggtgatcattctttaaaaatttcattatatagatatacacaccaatgtgcatgcatgcatgtgtgtgtatatgtacatgttggtgttatctaataaaaagatacttagaattaccacctttcaattttaaaataaaattgttgcatatatttagaatggagttttcaagtcactttatttattgatgtaaatagttaccaaacatggataaaaaaccagtgtactttaaccagtcacttctattttaaaactaagagtatcttcagtcgtggtaacaagtaatatttttctggaatttttattttcttaattttttgcttttaatcacccatagttttaaaattacttgagttagaaatgtgttagctacaagaaagaaaaatgagcaacattggcgtttgttttgttttctcctacagcaccagtctctaacaaccttgaatgctactgcttggagagaggagagtaacaaatacattatcagaaactggcccaaaccaaggaggaacaagacacaatttctctctcattgctcttgtcactgctgagggttttaaactatgaaataaatcatctggcctgaatctcatgacttacgtccattgaattctctgtatttgcagtccaaattctaccctatcaaatttggatccataagatgctctgaatcaggtgaaaggagcctaagaccctcatctcataaaggcaagagggactgccagtcagcctcacagcagagagtatctgttttcccttctgcttcttaggttgaccagaatctccctcaagtctgacctatcccctttccttcagagttcctagcgtctaggtattctgtgactggttacagtgacatttatgcagatggtatctgagtccaatccctgtcttcttactcctgctcatttatgaaagctgtaaagccactttagtgtgttaaaatacctgtttgccaaaagtagatttaccataaagctaaggaagcaaaaacttaagagcaacttagttgcacagattctcttcaaagtcatgaagctaactttgtattcttagagtttatcaaattttatatggtcaggccccattgagcctgaatcatctcgctgttcacaagttcccttggcagtggtgtgctagagccatttcatactatctcaccagagctcaccagttaaaatttcagaatatttgcaagtcagttgttaaacagccactattaaaaacattacttaaatctaaataaattaaaaatcaatacttgaaagacaccatttattcattattttgttgtatttttatctttgctttttaggttataattattgcatctttatggtggaattagtatattatggtaatgtatgacttgcatgtattaccaactcttctagaaatatcaaatggtagcttgaaattagcctttgctgagactgataaacctatcaatgtggacttcctctccctcacatcacagaaatagctgtataataattgctagcaaaccactgttcttgggggtagttcaccttttttctatttttgttttcaatagcttgttgaagctacttttctatcatggctcaaatctatctccaactctttctgaatatgattacccaattggtatcaaaaaattgggtatagaaagaatataactaaacacaataaaggccatgtgttaaaaattaaaccccacagttaacatcatactgaatgaggaaaagctgaaagcttttcttgtacgatctggaacaaggcaagcttctcacttctaccacttttattcaacatactattggaagtactagccagagcaattaggcaagagaaagaaaataaaaggcatataaataggaaaggaagaagtcaaagtatccctgtttgccgatgacataatcatatatatagaaaatcctgaagacttcaccaaaaaaattgttagaaaaaataaatcaagatagtaaagttgcagaatgcaaaattaacatacaaaaatcagtagcatttctatataccaatagtaaactagatgaaaaagaaatcaagaagcaaattaatttacaatagctataaaattttaaatatctaggaataaaccaagaaggtgaaagagctctacaatgaaaaatataaaagattgtaaaagaagttgaagaggacacaagtaaaaaattccatgttcatggatcagaagaattaatattgtcaaaatgtccatgtttatccaaagcaatcttcagattcaatgaaatctctatcaaaataccagtgaaattcttcccagaaatagaaaaaacaatcttaaaatccatacggaaatggaaaagactctagtagccaaagccatcttgagcaaaaagaacgaagctggaggcatcacagtacccacttcaaaatatgctacaaaagtataataatgaaaacagcatggcactggcataaaaacagtcacatagaacaatggaatcaaatagagaaataaatccatgtatttagggccagctaattttcatcaaaggtagcaaaacacacattgggagaagaactgtctttgtctcctcagtaagtggtgctggcaaaactggctatccacatgcagaacagtaaaaccagggcactatctctcaccatatacccaaacttaactcaaaataaattaaagacttaaatttaagaccccaaactatgaaactactagaagactataggggaaatactttataaaattggactaggcaaggatttttttcaataagacctcagaagaacaggcaataaaagtaaaaatagacaaatgggattacatcaaagtaaaatacttctgcacaacaaaggaaatcaatagtgtgaaaagacaatctataggttaagaaaaagtatttgcaaaatatacttctgacaagggattaatacccagaatatataaggaactcaaacaattcagtagcaaaacaaaccaagtaatccaatttaaaaatgggcaaacgacctgaatagacatttctcaaaagaagaagtaatggccaagagacatacaggcatatgaaaatgtgctcaacataattgattgtcagaaaaatgcaaatagaaactaccatgagatatcatctcaccccagttaaaatagcttatataaaaaagataaggaataacatatgctggtgagaaagtggagaaaaaggaacccttgtacactattagtgggaacataaattagtacaaccagtatgaataacagtttgcaggttcctcaaaatctaaaacttggggtaccatatgatctagcagtaccactgctgggcatatacccaaaagaaacaaaatcaggccaggtgcagtggctcatgcctctaatcccagcactttgggaggctgagacagttggatcacctgaggtcaggaattcgagaccagcctggccaacatggtgaaaccccatctctactaaaaatacaaatattagtctggcatggtagtgggcacctgtaatcccagctacttgggaagttggggcagaagaatcgcttgaacctaggaggcggaggttgcactgagccgagattgcaccattgcacttcagcctgggcaacaagagtgaaactctgtctcaaaaaaaaaaaggaaagaaaagaaaaagaaaaagaaaaagatcagtatattgaagagatatatgcactcccatgtttgttgcagcactgttcacaatagccaaaaaattggaaacaacctaagcatccatcaacaaaagaatggatacagaaaatgtggtacactgccgatcattatgttaagtgaaataagccaggcacagaaagacagacatcaaatattgtcacttgttagtggtatctaaaaatcaaaacaattgaactcatggagatagagagtagaaggatggttaccagaggctcggaatggtagtggcaatgagggtgagggttctggaggggagatattcttgttcattcatggaattttactcattcataggaagaatgaataagacctactatttgctagcacaacaaggtgactataataatatacttgtacatttttaaataactaaaaatacagttggattctttgtaacacaaaggaaaaattgagggaatagataccattctgcatgatgtgattattactcattgcacacctgtatcaaaatatctcatgtacctcataaatatctacacctactatgtatccaaaaaaatttaaaaataaaatggccaagatgtacatgaaaaaatggtcaacatcactaatcatcagtaaaattcaaagtaatagtgagatactatttcacctcagttagaatggctcttatcaaaacaccaggggtttggtcttggttctgctgctcactgcacagaaagccaataagtattgccagggaagatggctttaattgggtgctgcagccaagtccaaattcatctccctgatcaaattagagatttacatagtagggaagaaatatgtaactatgtgtgggaaaacaggaactcaggaggggtaaagaagcaatcatgggctgggtgtggtggctcacgcttgtaatcccagcactttgggaggcagaggtgggtgaatcatccaaaggtcaggagttgaagaccagcctggccatcatggagaaaccctgtctctactagaaatacaaaaattagccaggcttggtggtggatgcctgtagtcccagctactcaagagattggggcaggagaatcacttgaacccaggaaggggaggttgcagtgagctgagatcgcaccattgcactccagcatggatgatagagattctgtctgaaaaataaaacaaaacaaagcaaacaaacaaaaaaacaaataaattaaagaagcaatcgtgatgaatgagagaatgaattattgtctgaatgtgatgatctggtgagtttcagttttttgataccttctgagaggcctgggaatcctttcctgaggaaggaactcagataaaatgaatgtaagtgtcaagctttaacaccagaagggtcaatttctatgtttatcaaaaacaaacaaatgaaaacaaaactgtccatgggactcttggattggcttcatggctatgaatacaaaaaaaaaaaaagtgaatgctgatgagaatgtaaagaaaggggaactcttttgcactgttaatgggaatgtaaattagtacaaccattatggaaaacagtaaggggatgtctcaaaaaactaaaaatagaactaccatgtgagcctgcaatcccattactgggtgtatatccaaaggaaatgaaactttatgttgaagagatttataccatcgcttgtttattgtagcattattaacaatagccaatatatgaaatcaacgtaaaagcctatctactgattaatggatttaaaaatgtgatatatatacaaaacaaaatattcttcagccatatgaaacaatgaaattctgtcatttgcagcgacgtggatgaagctggagggcattgttaagtgaaataagccaggcagtgagacacaaatgatctcaactcacgtgggatcaacaaagttgatttcatagaagttaagtagaatagtgattactagagttttgaggtgagggtactgtattagtccattttcatgttgctgttaaagacatacccaagactgggaagagaaagagttttaattggacttacagttccacatggctggggaggcctcagaatcatggcaggaggcaaaaggcacttcttacatggcagcagagagagaaaatgaggaagaaacaaaagtggaagcccctgataaacccatcagatctcaggagacttattcactatcacgagaatagcatgggaaagaccagcctccatgattcaattacctttccctgggtccctcccacaacatgtgggaattctgggagatacaattcaagttgagatctgagtagggacacagccaaaccacatcattccacccctggtccctcccaaatctcatgtcttcacatttcaaaaccaatcatgccttcccaacagtcccccaaagtcttaactcatttcagcattaactcagaagtccacagcccaaagtttcatttgagacaaggcaagtcacttctgcctatgagcctgtaaaatcaaaagcaagctagttacttcctagatacaatggaggtacaggcattgggtaaatacagccattccaaatgggagaaattggccaaaacaaaggggttacagggcccatgtaagtttgaaatccagcagggcagtcacattttaaagctccaaaatgatctctttgaccccaggtctcacatccaggtcacactgttgcaagaggtgggctcccatggtcttgggcagctccacccttatggctttgcagggtatagcctccctcctggctactttcatgggctggcattgagtgcctgtggcttttccaggtgcatggtacaagctgttggtggatctaccattctggggtctggaggacggtggacctcttctcatagctccactaggcagtgccccagtagggactctgtgtacgggctctgaccccacatttcccttccacactgtcctagcagaggttccctaaccctgcagcaaactttttcctgagcatccagtgtttccatacatcttttgaaatctaagtggagggtcccaaacctcaattattgacttctgtgcacctgcatgctcagcaccacatggaagctgccaagacttggtgcttccaccctctgaagccacagcccgagctctatgttggcccctttcagccatggctagagcagctggggcacagggcaccatgtccctaggctgcacacagcacagtgaccctgggcgcagtccatgaaaccactttttcttcccggggctccagacctgtgatgggaggggctgccgtgaaggtctctgacatggcctggagacattctgtcatggcttggggattaacattaggcttcttactaatgcaaatttctgcagtcagcttcaatttctcttcaaaaaatgggtttttcttttctactgcatcatcaggctgcaaattttctgaacttttatgatctgtttcccttttaaaacagaatgcttttaacagcagtcaagtcacctttggaatggtttgctgcttagaaatttcttccactagatacccccaaatcatctctctcaagttcaaaattccacaaatctctagggcagggacaaaatgccaccagtctctttgctaaaacataacaaaagtcatctttgctccagttcccaacacatttctcatctccatccaagatcacctcaacctggaccttattgttcatatcactatcagcatttttgtcaaagccattcaacaagtctctaggaggttccaaactttcccacattttcctgtcttcttctgagctttccaaactgttccaatctctgctggttctaaagttgcttccacattttcaggtatctttcagcaataccccactcctggtaccaatttactgtattagtccgtttacacactgctgatgaagacatacctgagactgggaagaaaaagaggtttaattggacttacagttccacatggctggggaggcctcagaatcatggcagaaggcgaaaggcaattcttacatggcggtggcaagagaaaatgaggaagaagcaaaagtagaaacccctgataaacccattagacctcatgagacttattcactatcatgagaatagcacaggaaagaccagcccccattattcaattacctccccactgggtccctcccacaacacatgagaattctgagagatacaattcaagttgagatttgggtgggacacagccaaaccatatcaggtaccaagatacattggtaaacgagtacaatgttacaattagataggaagttatagtgttctactacactgtagggtgactatagaaaataaaaatgtatatttcaagatagctggaagagaagactatgaattttaccaccacaaagaagtgataaacatttaaagtgataggtacagtaattaccctgatttaatcattttattcaacgtttacatgcaatggagaatcacactgtaccccataaacatgtacaattattgtgtatagattataaataataaaaatgaataatacaaaaaaagaatacttaattttctgggtccctaggacatttgacatagtttggagtgagcctaagagcaacatctgtcagagttccaaaaggtaaatttcagacctgctctctgttatggagggtggaaaagctgctaagagataactagagttgcaccaccaaaaatgacaaggctaccaagtctgtggtccaaggaccttacccttagagctattcaaataccgatgagctggtaggtctgagaagaggaacagtacgtaaggcaaacatttaccaattgctatgattaaatataccaagtttatgaaaacctaaggtaagtgaaatattctcatggctctgggccagtgtgagtttgggacattctataaaatagcatttctacttttcctgacatctaccctgaaattgtagaaagaagtggaggggtgaagaaatatttgaagatggagtagaaatttcttgaaaaaagtgacttttgcttttagatctgaagagagagataggtgctacaagtatgaaggtgctgcaaaaagaaaatattttgctccctggaaaaaaactttcctgttactcagaactccatacaaactgtgtcaaaagccagtgacgattttggtcccttaatttttttctgaaattactctggaaaactcatcacttacctctacagtgttaaatttatgaattcctattcctcttttttttttgctttttaaattgatatttgattttctttttttaacttactcctttcatttctaaaatgtttttatctgttttgatttttagccctatgtctaatctctccaagagttttttctcactttgctttattaccatccacttatttgtttattaatgtttactcactcttgacttctatctcttttcacttcataccagtagttcataactaagtgtgtagattattctacttggagagattttccaaatactcattgcatagcaccaattctaaagattcttattcagtaggacatttctctgataacatcagttattctttgggtacaaatatttgtattgactaatgattcaaatatacaaatataaagctcaatattttaaccgaattcttatgcctaatgaacttgagagtaggttcatgatgaactgaacacagatgaccaattctccatgagtattttatgcaactttatatttttttccttttagattcagtgtgcggatgtgcaggttcattacatgcatacattgtgtaatggtgaggtttgggcttctagtgaacctaccacctaaatagtgaacattgtacccaacaaatagtttttcaaccctcattcacctccactgtccttgcttttggagtctccagtgtctattatttctgtttttgtgttcacatgtacccatggtttaggacccacttataggtaagaacatgcagtatttgattttctatttctgagttatttcactaaggataatggcttcaagctccatccatgttgctgcaaaggacgtgatttcattttttgactgtaaagtattccatggtgtgtgcgtatgtattcagtccaccattgatggacacttaggttgattccatgagcaaattcattttttgaattccagggcaaaggaagaagcctacttaaacagatatagcacacatcatgcaggacatctgtgtggaccaccaaagggaaacctataaacttgcctgcttcaccagaattatagttaagaacaaagacaagtttcggaggatgctcttacccaggataattgagatgagccatcctaacattttagaatttccaacaatttaaaatccatctgatgttggttatcatatatcatcttaggtgggtccaacaattttcctgggcagtagagtctgtcctctatgtgataactagatatccaggcttctttagtcttgtggctccatattctcaccacaagatcccacagttgccaacaaaatggaaggaagtgtgaaaaactcataatctgctcactaactgcctctaaccagcagtgatacaacaagtagtttattctcatggtccattgacccaatctagtcacatagtcctaactgcaaaggaggctggaaaacatcaagataacctatagaatatttggtgagtgctacttccctctcacactgtgaaatagaaactatgaaggttgtaccatctgtgactaggtataggcatgtcgtagttcccatattggaatgaacatcttctaaatcactctgtgacaggactgtgatcatttatttggcaaatgcatcccaactcctttcctccttattgaagtacccttgttatctaggatggatgaaacaagttcctgtagactcagtttgctagttttcaggttggatgtcaaataaatctctgagttacatcaatgttggaacagcgttgtcactgcgctgacaaagactagagccatttttaaagcctggaaattctggaagcaggtatgcatatcaattgattcggaaaagcattcacaaacactaaactaactgggaataaaagaaaaatgccttcatatgataaaagccatagacgaaaaacccgtagttaacataatcgtcaatggtgaaagtttgtaagatttttctctaagatcagaagcaagataaagatgcctgcttttgcataatctgagtggtatgggtggcaccatgggagtgccacttggagatctcccactacaaggagcataaacaataaacggtctgagcagctgcaggctgaaatgcatcagtgcatttttgtgaagtccacacttcccatggtgtgctcccaaccactgatggaaaatgatggagatcctaaggaaggcattcctaggagacctgagattcccctgacagtggatctagcttgaggactctccaacagctttgtgaaaacttcctggcagtgcatgggccttctttaagctgcataaagccaagacagcttccatccagctttctctccttctcttttttacttcagtgtctggcagctttctcaggcttttcatctttctttcctttttttctttttttgcaagggctgtttctcctgataaaattctggaacatttaatactgtcttggtgtctatttctcggaagatccaaactaaaacaagtgataatgagactattataagtatacagggggtaagatgtgaatttgtcttggcttaactaaccctgcaactgacagaggacatgatcctggttgggaggtggggcacagatagtccctgccatgaggtgacagtagaattctaaaaattttttggcaactgagaaaaatgttccaatagagacaaatttgacagatgcaataaagcagacatttaaagtcagtgaagtttggccaggtgcggtgactcactcctgtaatcccagcactttgggaggccgaggtgggcagatcacctgaggccaggagttcgagaacagcctggccaatgtagtgaaacactgtctctactaaaaatacaaaaattagctgggcgtgattgcggccgcctgtattcccagctactcgggaggctgagtcatgagaattgcttgaaaccgggaagtgaaggttgcagtgagccgatatcacaccactgcactccagcctgggtgacagagggaaactctgtttcaaaaataaataaatagataaataaataaaaaagtcagtggctttagctggttgccgctaagtttcattgattattgatgccatgcacaaggataatgagagattgaaggctgttaacaagcaattactggctatgattgagacccagagaatctcagtggtagcttacaaagaggccttaatcagtcatagttagacagcagataggagaatggcaggtgggagttctgtttgctgcagtagcaagctctagagaatctaaacactcagccaaaagagctttgttgtgctaaggtttcaacattgtagggaaaatttggaatcctgagaactggaaagaggacttctggatgtatgcctctgaggatattgactttacaaaacccacttctactgggctcattgggtttgcagaatggcccagttttgcatttccacagggattgtagatgctgcagagcatgttagaatcctgtgtccagggatcaaataacaaacaaatgaacaaacaaacaaaacaaagaacaatcactgtactgttaaggaaaattgactctaatcagcaggatgaggtaagggtgttttacccaatggaggcagcagagagtataggtggaacccaaatgatctatttgggattattgcactgtaactatgaatggacatgtgcaaccctggcatgagaaaagtatgacgattcatggtgcaagcacttcacgataaaggcttgattacacattcgttaaggcatggagccaggccatgtgagacctgagcaggagggttgttcagaatgtgcagtaggtattaggggctaatttataacaaatagtaagatactattttcccgtaaagtttagatacatctttttttaaaaaccctttatgttacctaaaatcaggaatgtactaaaatgtagatttgttgtataaatccatttttcaatataagattcattaggtctagagttctagatccatgaaacccttgcattttagttttctagtttgttattttgaagctaacaaataagctacaccattataaatttcgagttgagcataagcaattgaatccaagaacttcaagttctgtattaagtacatttgatgtgaaatctaacttgctgcaaaacaaggggttggtggtggaaaatgcaacttctggcatgtgtttttatagatgtaatacatctatgggtctttaaataactttattgagatatgttttacatatcctaaaatttacctacttcaactgtacaattcaatatttttaacaacttgtgctgtggccatcatcataaatcactttaggccattttcatcatcaccccataaaatctctcttgtcaatttacagataatccctgtttccaaccatagccccaggcaacaattaatttatgttctgtctctataaacttgcattttcactacatttcatacaagtggaatcaaaatcccttatttctgcctgagtttttagagttgaacaaggctggagaaaattattctcacataattcattaacatctccacttaattcaggctcactacacttgcattggccttaatgcctctacaattccattagatatgctctttgttaaatttttggtaactttcatgtttctaaatgcaatggttatttctttttatctattattttaggtccgaggggcacatgtgcaggtttggttatgttggtaaatagtgtgccactgatgtttggtgtatgaatgatcccatcatccaggtagtgaacatagtacctgatagtttttcaatcttctcccacttcctgacatccctcctctaatagtccccactttgtgttgtgcccatccttatgtccttgtgtacccaaagttcagttactacttataaatgagaacatgtggtatttggttttctgttcctgcattaattcactaagataatggcctccagctgcatccatgcaaagggcatgatttcatttttcttttatggctgcgtagcattccatggtgcatatgtacacattttctttattcaatccaccattgatgggcacctagattgattccatttctttgctgttgtgattccatgtcattgctatgttgcaatgaacatgtaagtacatgtgtctttttggtagaatgatttatttctctttgggtatatacatagcaatgggattgctgggtcgaatggtaactctcagttctttgaaagatttttaaattgctttccactgtggctgaactaatttaaattcccaacaacagtgtatgagtgttccctattctctggaaccttaccaacatctgttatcttttgacatttgaataataaccattctgactggtgggagatagtatctcattgtggttttgagtagcatttctctaatgattagcgatgttaagcattttttatatatttattggccacatgtatgtcttatttcaagaagcgtctgttcatatcccttgcccaatttaaatggggttattttttgcctgtgaattgtttaggttccttacagattttgtatattacaccattgtcagatgcataatttgtgaatattttctcccattatgtaggttgtttactctttagttactttagctatgcagaagctctttagtttaattaggtcccacttgccaatttttggtttttgctgcaattgcttttgaggacttagtcataaattatttcccaaagctgatgtccacaatagtatttcctaggttttcttctcatatttttgtggttttaggtcctgaatttaatattttaacccatcttgagttaatttttgtatatggcaaatggaaggggaccagtttcaatattgtgcatatgtctagtcagttatctcagcactgtttattgaatagggagtcctttcaccattgtctgttattgttgactttgtcaaatatcagatagtcataggtttgtggctttatttctggatcctctaaccgtttccattggtctacctatctgtttttgtaccagtaccatggtgttttgattactgtagccttgcaatatagtttaaagttgggtactgtgacacttctggctttgttccttttgcttaggattgctttggctattcaggcctttttttttgttccacattaattttagaataatttctttctaattctgtgaaacataacacttgtagtttgacaggaatactactgaatgtgcaagtcattttgggcagtatcgtcattttaacaatattgattattcctatccatgatcatggaaagtttttccatttgtttgtgccatctctgatttctttttgtaatgttttgtagttcttactgtagagaactttgtccattctagttagctgtagtcctagagatatttttttctctttgtgagtattgtaaatgagattgccttcttgattttactctcagcttgaatactattggcatatcaaaatactactgatttttgtacattaattttgtatcctaaaattttacttatgttgtttatctgttctaggagcccttggcggagtctttagggtttaggtacagaatcatgttgcctgcaaagagagatagttgaactttctctatttctatttggatgcctttaatttctttgtcttacctgattgctctggctaggatttctagtactgtgttggataagagtggtgagagtgggcatccctgacttgttccagtaattaaaaggaatgcttccagcttttgccacttcagtatgatgttggctgtgagtttgtcatagatggctcttactattttgaggtattttcctttaatgtgtaatttgttgaaagtttttaacatagaggaatggttgaattttattgaaattcttttctgtgtctattaagatggcaacatgatttttgtttttaattatgtttatgtggtgaatcccctttattgatttgcatatgttgagccaaccttgcatccctggaataaagcctactcaattgtggtgaattaactttttgatttgctggtggattttgtttgctagtattttattgaggagtcttgcatctatgttccttagagatatcggcctgaaattttcttttttgttgtgtctctgccaggttttggtatcagaataatgctggcttcatagaataagttaggaagttgctccacctcctcagttgtctggaataattttgatgggatttgtactgccttgtctttgtatgtctggtagaattcagctgtgaatctgtctggtccaggtctttttctgataggtaggttttttattagtgattcaatttcaaagctcgttattggtgggtgggagtcggggccaagatggctgactagaagcagtggcaatcagaggctctcatcgaaaagatccaaaagagcatgcaaatcctgcactggtaactgaggtatccagatcctgttattaggactgactaggtgactggtatgacccatggagaaaaaggaagaagagtgtggtgcagcagcccatcagagagccatacagggcaggggagcccccactcccagccaagggaggcagcgagtgagcatgatacccagcctgggaaaccatgctctttccatggaaatgtgcaacccatggattggaaaatcccacttgggagcccatgccactggagccttgggtcccaaccatggagccatgcagattatcaacatcttctaggctaggatcagcctaagcctgagttcccatggggaacactgctgtggctgcctgcagtctaagccatctgagctccttgggggaggggtgggagccaacactgtggctgcagtgcgtccctgcaggaactccaactccagtcaggggcttagggacagaactatgatctctctgggcctgagccgccttggggaaaggtggccatatgctccatggaccagcagagttagtcttttctcctgctagatctgaggaatctgggcagcccagatgagtgggttttcccccagcacagcacactctttccaccaagggacagccaaagtgcctcattaaataggccctgcttcccatgccactcaactgggtgagacccccccaacagggattgtcagacaactcatacaagggtgttcctactggcattaggtcagtgcccctcgaggtcagggatcccagagaaaggagcaggtaaccatttttgctgttctccagcctcttcgagtgacatctctaggtatgggagcaaaccagatgaatagggcctgaagtgaaaccccagaaaactgcagcagccttagagaagagagacctgactattgaaagaaacaacaacaacaacaacaacaaaaacaaacacaaaacaacaacagcagcatcatcaacaaaaaacgtctccgcaaaaacctcatccaagtgtcatctgaggacagcctcaaagatcgaaactagacaaattcttgaagatgagaaagaatcaataaaagaacattgaaaaccaaaaggtcagagtggcttgtctcctccagatgatcacagcacctctccagcaaggctccagaactggacagagggtgagatggactaattgacagaagtaggcttcagaaggtgggtaataacaaacttcactgaggtaagcagcatgctctaacccaattcaaagaagctaagaaccttgataaaaggttagaggagctgttaactagaataactagtttagagagaaacataaatggcctgatggagctgaaaaacacagcatgagcacttcatgaagcatacacaggtatcaatagccaaatcaagcaagcagaagaaagaatatcagagatggaagactatattgctgaaataaggcaggtagaaaagattagagaagaatgaaaaggaatgaagaaaaccttcaagaaatatgggactatgtaaaaagaccaagcctacgactgattggagtacctgaaagagacagggataatggaaccaagctggaaaacacactttaaaatattaaccagaagcacttccagcctagcaagaaggccaacattcaaattcaggaaaaacagagaaccccattaagatactctacaagaaaatcaagcccaagacatgtaattatcaggttctccaatgtcaaaatgaaggaaaaaaatattaagggcagccagagagaaaggccaggtcacctacaaagggaagcccatcagactaacagtggatgtctcagcagaaaccttacaagccagaagaaagtggggaccaatattcaacatttttaaagaaaagaattttcaacccagaatttcatatccagccaaactaagcttcgtaagtgaaagagaaataaaatccttttcagacaagcaaatactgagggaattcatcaccacaagatcttccttgcaagaactcctgaaggaggagctaaatatggaaaggaaaaactggtaccagccattgcaaaacacatgaagatataaaaaccaatgatactatgaagaaatgacatcaactagtgtgcaaaataaccagctagcttcatgatgagaggatcaaattcacacataacaatattaaccttaaatgtaaatgagctaaacaccccaattaaaagacagactcaaaaactggataaagagtcaagacccattggtgtgctgtattcaagagacccatctcatgtgcaaagacacacatagggtcaaaataaagagatggaggaatatttaccaagaaaatggagagcagaaaaaagcaggagttgccatcctactctctgacaaaacagactttaaaccaactaagttagaaaaagacaaaaaagggcattacataatggtaaagggatcaattcaacaagaagagctaactaccctaaatatgtatgcacccaatacaggagcacccagattcataaaacaagttcttacagacctgcaaagagacttagactcccatgcaagaatagtgggagattttaacacctcactctcaatattagacagatcaatgagacagaaaattaacaaggatatgcaggagttgaactcagctctgaatcaagtgggcctaatagatatctacagaactctccaccccaaagcaacagaatatacattcttctcagtgccacatgacacttattctaaaatccaccacagaattggaagattctgcaaattcaaagaactgaaattataacagtttctcagatgacagtgcaatcaaattagaacttaggattaagacactcaaaaccacacaactacatgtaagttgaacaacctgttcctgaatgactccaggtgaaataatgaaattaaggcagaaatcaagaagttctttgaaaccaatgagaacaaagagacaatataccagaatcccttggacacagctaaagcagttttaagagggaaatgtataacactaaatgcccacaccagaaagctagaaagatctcaaattgacaccataattaaagaattagagaagcaggagcaaacaaatccaaaggcagcagaagacaagaaataaataagatcagagctgaactgaaggagagagatgaaaaacccttccaaaaaatccatagctccaggagctgttttttttttttgaaaaaattaataaaatagactgctaggtagattaataaagaagaaaagagagaagaatcaaatagacacaataaaaaatgataaagggaatatcactgctgaccccacagaaatacaaactactatcagaaaatactatacactactctattcaaatcaattagaaaatctacaggaaatgaatacattcctggacacatacacccttccaagactaaaccaggaagaagtccagtccctgaatagaccaataacaagttctgaaattgaagcagtaataaatagcctaccaacgaaaaaaagcctggaaccagacagattcaaagccaaattctaccagaggtacaaagaggagctggttaccattccttcagaaatgattccaaacaattggaatcataggtgggactcctccctaattcattttatgaggccagcatcatcttgataccaaaacttgacagagatacaacaaaaaaagaaaattcaggccaatatccctgatgaatattggtgcaaacgtccttgataaaatactggcaaaccgaatccagcagcacatcaaaaagcttatccaccatgatcaagttggcttcctccctgggatgcaaggttggttcaacatatgcaaatcaataaatgtaattcattacataaaccgaaccaatgacaaaaatcccatgattatctcaacagatgcaggaaagaccttcaataaaattcaacatcccttcatgttaaaaactctcaataaactaggtattgatgaaacacacctaaaaataataagagtcatatatgacaaacccacagccaatatcatacttaatgggcaaaagctggaagcattccctctgaaatcctgcatcctattcaacatagtattggaagttctggccagggccatcaagaaagagaaggaaataaaggtattcaaataggaagataggaagtaaaattgtctctgttttcagacaacatgatcctatatttagaaaaccccatcatttcagccccaaaactccttaagctgataagcaacttcagcaaaatctcaggatacaaaatcaatgtgcaaaaatcacaagcattcctatacacaaacaattgaaaagcagagggccaaattatgaatgaactcccattacaactgctacaaagagaataaagtacctaggaatacagctagcaggagatgtgaaggacctcttcaaggaaaactacaaaccgctgctcaaggaaataagagaagacacaaacaaatggaaaaacattccatcctcatggataggaaggatcaatattgtgaaaatggccatactgcccaaagtaatttatagattcaatggtatttccatcaaactaccatttacattcttcacagaattagaaaagctactttaaaattcatatggaaccataaaaaaagcccacatagccaagacaatactaagcaaaaagaacaaagctgaggcatcctgctacctgacttcaaactatactacaaggctgcagtaaccaaaacagcatggtactggtaccaaaacaaacatatagaccaatgtaacagaatagagacctcagaaatgaaaccacacatctataaccgtctgattttctacaaacctggcaaaaaaaagaaggaatggggaaaggagtccctatttattacatggtgctgggaaaattggctagccatatgcagaaaactgaaactggaccccttccttacaccttatacaaaaatatactcaagatggattaaagtcttaaatgtaaaacccaaaaccataagaacccctgaggaaaacctagataatacccttcaggacataggcatgggcaaagattttattctgaaattgccaagaggaattgcaacaaaagataaaattgacaaatagtatctaattaaaccaaagaactgcacagcgaaagaaactatcatcagagcaaaaaggcaatccattgaatgggagaaaatttttgcagtccacccatctgacaaaggtctaatattcagaatttataaggaatttaaacaaatttacgagaaagaaacaatcccatgaaaaagtgcttaaaggatatgaacagacccttctcaaaagaagacatttatgtggccaacaaacatatgaaaaaaagctcaacatcactgatcattagagaaatgcaaatcaaaaccacaatgagatactatctcatgccagtctgaatggcgattattaaaaagtcaagaaacaacagatgctgctgtggctgtggagaaataggaacgcttttacattgttggcgggaatgtaaattagttcaatcattgtggaagactgtgtgacaattcctcaagaatctagaaccagaaataccattttacccagcaattccattactgggtatatacccaaaggaatataatttattgtattataaaaatacatgcacacatatgtttattgcagcactattcacaatagcaaagacatggaaccagcccaaatgcctatcagtgatagactggataaagaaaatgtggtacatatacaatatggaatactatgcagccacaaaaagaatgagatgatgttttttgcagggacatggatgaagctgaaagccatcatccacagcaaactaacacaggaatagaaaaccaatcaccgcatgttctcattcataagtgggagttgaataatgagaacacatggacacagggaggggaacaacacacaccagggtctttgatgggaggtaaaggaagggagagcatcaggacaaatagctaatgtgtgcagggcttaaaacctaggtgatgggttgataggtgcagcataccaccatgtcacacgaatacctatgtagcaaacctgcaccttctatacttgtattctggaccttaaaataaaaacaaaacaaaaacagtaaaaaagaaagaaaaaagctcattattgttctgttgagggtttcaatttcttcctggttcaatcttgggaagttgtgcatttctagtaatttatccatttcttatatattttctggtttgtttccatagaggtgttcataatagtctcttaggatattttgtatttctgtagggttggttgtaaaactacctttgtcatttctgattgcgttatttagatcttctcttttttttctctttgttaacctagctagcaatgtatcaatcatgtttattctttaaagaaccaactctgggtttcaatgattttattttttccctttccctttcccttcccttcccttccctcccctcccctccccctcccccctcccctcccctccccctctcccctcccctcccctcccctcccctccctttcccttcccttcccttcccttccttcccttcacagagtattgctctgttattcaggttggatggagtgcagtggcaagatcttggctcactgcaacctctgcctccctcgttcaagcaattctcatgcctcagcttcctgagtagctgggattacaagcacatatcaccacacctggctaatttttgtatttttagtagagacaaggtttctccagatttgccaggatggtctcaaactcctggcctcaagtaatctgcctgtcttggcctcccaaagtgctggggttacagacctgagcaaccgtaactggactttcattgatttttttttttttttgatgtatgttctcattttcaattttgttcagttctgctctgattttggatactttttttttttctgctagctttgggggcagattgctcttgtttttctagttccttcagctgtgatgttaggttgttaatttgagatctttctaacttctcgatggtagatgtttaacactataaactctctgcttaacattacttaagctgtgtcccaaagataccaagtatgttgtgtttctctcttcatttatttcaaataatttttaaaatttctgcattaattttcttgtttgcccaaaagtcattcaggagcaaattgtttaatttctgtgtaattgtttggttttgagagatcttggtattgatttatatttttattgcttggtatgatttcaatttttgtggattatttgagacttactttatgaccaagcatgtgattgatcttagagtaagttctgtgtgcagatgagaagagtgtatgttctgttgctgttgggtggtgtattctgttgatgtctattcgatccaacggatccagtgctgagtttaagtgcagaacttctttgttagttttctgccttaatattttgtgaaatgctgtcagggggatgttgaagtccctcactattcttgtatggctttctaaacctttttgtagatctagaaaaacttcttttttatgtatctagtgctccaatgtcaggtatgtataaattgagagcagttacatcttcttgctgaatagaagcaatggttatttcttagtctttatttttttcgaccaatcagcagcatttggcatagctgatcagtctctcctgtataaaatatttcctcatttggctacaggataccacaggctttctttaactcttgctaatgtagttactgcttctgttttttttttttccaatacctcctgatctgtctctggaaattagctccatggtgctgtctttgaactttgtttttctagatacattattgcctatctcatctagtcttatggtttattattatatctttaaaaatagctaaaagagatgattttaaatgttcttgagtaaagaaataataaatatttgagttaatggaaatgttaattaacctgatttgatcattccacaatgtatgcatatatcaaaacattacattttaccctatatatagatacagttgtatttgttaaaagtaaaaatagtaacataataattatatattgttaattactcccagtatctatctcggctttatacttcttcagtgaactccagattcaattatttgactacttacttgatagttccacatgaagatacttactagaagtctcatatttaacatgttcctaatggactcctgatcacattcccaataccatctgcattattctagtttttcagaacaaaaccttggagtcattttgccatctttttttgttacttttctttcccctcaaatccagtgaattattaaatctcatgtttctctctttaaagtatatccagaattgggcctcgacccctgctactattctatttaaaaccatcatcatgttgtgtggatgactgtaatagtcttctaactggtctccttacttctgcttatttgccctgaagattattctatgaaaatattggtctgatgctgtcacttatttgttctaactctctgatgatgtctcatttctatgacaccatctgtaactacattcacactcactccaggcacattgtcccctagctgttctttgtataaacaaaggatactttggcctcagggtctctgcattttttcctaactctgtctggaataacatttatgtgaaaatacatgttacttctactttatatctttatttacctattcaatgaaattttccatgtcatccaatttacattttgttaccatcagtctttcacacccaggcttaatttattgttatctaaaatgctagaaaactaagaattttgtcttttgtttactgctgtatcccagtgcctagaagagtgtctgtcagatagtagacactaagtatttgttgagtgaacacatacacagccacacatgctactatctgatacaaaggagtcacagagtctgttccagtgttaagaaagtctgaactctctgatgcaccatttcagtgaatttcaaccaattacttaattgctaagacatagtgaaattaccatcatcaaaaaatgctgttatatgaatcctatacattcatattaattttattgtttataaatgtgtataatattaaattcataactcaaacattatttctatttatctttgataattcttattccagaagtatttgtttcatgcatataataagaaatcagctgtttgtattctgattcttcacattttaaagcaagacttagctgtctttgacatttgtcacatgcttctctcttgagctagacatattactcaagattgatatttttttccatgttgagtatttagttcaaatattttattgcatttatttgaccactacttcaatttgactgtcatagatagaaggtgcatgtgacagtgataaaacccaggcacaagagagtacttgttgggccataggtggaaaagagtacagagagttttcacaacttttttcttcctgtaaatgtatattaataattctgtatgattgacattattgttattagcaaatctttgagagagctgagagaaagagaaagaaagagagaataactgcaatggcaagaattaaatcatgagactggaatattctagaagctaaatgaagaaagtaattcatggagtagacacttaccagctatgccaaatgctgcaaataggatcaacaaaagtgaagattaaaaaacagcctttggcattaaaaaatataaggaccactgatgatctcttaaaagtaaacatttttattgctgttgtagagtcatgaaaggccatgaagtttgtaaggcttaattaattagggtggtcatgaattaagtgagaataattttctccagccttgttcaaatacatggttgcaggcagacaaggggcagttgttataaatatgtattttaaaagatgcaggcagagaaaaggctatttgatttcatttgcatgaaattgtgaaaaaaaaggaaagcaaaccaggaaagagaaagcagagatttattgttgcctggagctgtgggtgagaacagagattaactgaaatgacataaagctcttatttggaaaacaaaatgttctaaaactgatacatggttgatggctgcaaaagtgcataaagttatttaaaaaattgaattttacatgtcagtgaattttatgatatgtaaaatatactaaagtttttaaaaaataaacacatacgatttacacattataaatattaataagtatgcaactagcttaatttctcaccaataaccacttgtataactatattcaatttcacattagacataatatataacttgttctttatttcaatggcttatactcagttggagatttataaatatgtagcttatttctttaaaatgcaaaattctcacagatccaatatacaagacctgatgaatcctaagtggaaaataaatcaataaaacaactatacattttactgcatttgtgaatttaaatatggtacaaaaactttaaaaaggaaaatctaagcttgaagaaaaaataatatcttattgttagaaggtacaaacagatgataagtagaaggaataaattaaatgcttgatagcagagtaggatgactatatttaatgaaatgttacgtaatcaggtgatgggcaccctaaataccctcgcttgataattatatattacacacatggagtgaaatttcaaaaaaaacatgcaccctatacatttgtacaaatataaatataaataaaataaaaatgaaaataaacacaagaagtaaaaatgctttaaaattacaacttgtaaaatcaatattattggtcatttaccttctctgaaatttcatcctcattttaccctaccttctgtggaactggggtatgcaagaatattcctttagaatctgcagttgaaaaatattttttgattttatgttgtttgtatcaacaatcatctcagtcaagcaatgcttattaatcctgagtcaatggtggggtcaaaatataggaaaagttatttatgagtgtccactctccagtgtgatatacactttcacgacattatcaatggcacattgaaaatgactgagatacaaaatatcaaacaaaaaaatcagtcactgcagttccacaggatagtccagttcctcttctgaatcacactggagcccgtttctcctcagattgaaggcagtgcacccccacctctattctccatcatagagtggggagaccctgaaagtcttgctgcatgtgggtagctaagaccctgggccctgagctcagatatctcctctgctaatgtccttggctcacctggcctggtctgagacagtgtgacacatgggaggcaccagcatgggatctgggaaaggggttgtagagggtctcagagatacagggaattgttctccaggaatagtccaaccctcttctgagaaaaggaaaataaattttaggctactatgggcttaggtgggcttgtagccttccatgctcagcaaggaaggcaaagagaaagaacatggctttgccagagtgcaggaagcacagccaaggacaaaggccccctgaggttcatggcagctcttggtcactgggccaaagggccacttcagagtatagtgtgctgtccaaggaccctcgaggtgacaaccgaggttgctttctgcctgagttggctcagcattatggaatccaagggcttgggaagcttcaacagggcagggagaggaaacactagacacaagcacacacaatggagcacaactgctttgttgtggggaagcttaaattgtttaaaccctttagtagtgacgtaaaggcaaataagcatcatttgccctcatagtgaggttcttgaaaatgtctctgcatcacagttttttttttttgtggtaggatttatttattgtggagaaacaggaaaatagaaatattaattatcattactagcaattagtactaacaacttcttatgtaccactgctgacttaaatgtttaatatctttgcaaataaaaacaaatcaagaaaatgggactttatcctgataattccatcaaaaacacttttattcaactatgcatctttttaaaaatactagattagaatcagtggaggaaagggaaagaaaagctttaaaatgcaacctgattgtgttgtgtaaatagtgattctaagcactactgaagaacctgtggagatcagaaaggtagcaaggcgagggcagagaggaaaagtgacaccactgtaaaaggaagagtatgcatctgccttcctgaactttgacaaatatcttaaactgcacatgtccagaactaactcatctttttttttttttttttttttttttttgagatggagtcttgcactgtcacccgggctggggtgcagtggtgtgatctcggctcactgcaacctctgcttcctgggttcaagcaattctcctgcctcagtctcccgagtaactgggattacaggctcccaccaccactcctggcaatttttttgtatttgtagtacagatggggtttcactatgttggccaggctggtcttgaactcctgaccttgtgatccacccaccttggcctcccaatgtgctgggattacaggtgtaagccatagtgcccagccctaactcatcttttatcccatcccttacctaaaaccccagtacaccatgttacagggatgaactgtgttgacagtttgaaaataaaactctagtcaggactaaaactcaggcctactagagactggtacatctgggcaatagaaatcatgagaaagaggtaggacagtgagcatgatggtccaaaattgccctcattgccatgaggttgagataaatctagtagaaccatcccaatttgcattttaaacagccttattaagatataattcacataccacaaaagtcacccacttaaagcataagactaaatgatttttagtatgttcactggtatgtgtgatataagtttcatcttattatgaagaaactctataccctttagccatcaccctcccatacacaagttctttatcccacacctctactccctaaacaaccattaaactaagagctgcccccgttctggacgtatcatacaaataaatacacatgtaaatatctggtgtttgtgactggctttatttactatacataatggtttcaaggatcaaccatgtcgagtaaaagtgtcaatgcttcattcctttttagggctgaataatattccattgtttggatataccgcattttgtttatccattcttcagttgatggacatttggaataggaaaccctggacctctatgatgaggttcctctacctctgtcccaggagcatcttggtttgtgatggagactctgtaggtcctaattggattccaggtgggctggtggatccctaatccatgtgtaatgctctgtgatgtgtagaaatgcacccatcttagcaagagggggaggggaggggagactgaggcaagaaaatcttacccagaaaagcccagcttcagggaagacagagtggcaagtttaggttttcccaaaggacagagaaatattctagaacagtttatacagggccaaggaagcataatacctgatggtacaggtgtctatgacccacagctcagtttgaacaattcatttaaggtaggatttaggctaatgactaatgtgactgtggagctgaccttactcagcaatacctcctctctcaatattccaaaacttagaatgaagaggacaaggggataattaacgattaaaagggggtgggctgcaggtttcctctcttgggatgagagcagtcagcatgccatgggcatctgagagtgggcaggagcagtggacaatggaagtgatatggactgcagaaagggaaacacagggtggaagagggtggttccccagaaaaggcccgccctcaagcctggataccatggccctaaatgagaacaggaattcccgttttcatgcccaaaaagttgccttttggcccaccatgacccctatcttgtactcacataaaccttgaactctagcatccagaagcagacaagcagatgaggaggcaaaacaagcagacgggcagcagaatgacatggcagagaaagagagaagaggaggaaagtctgaacactgagaggagtttggctggggtcagttggagaggagtctggccacttgatggctcaactccaggggaaggtcatcttcccactccgttcccctcttccagctcctcatccatcccacttattgctacctccaccactcaataaaacctttcattcatcctgacagagcaggagcatcacgatcttggacaagcacggtcattttaaagttcaccttgatcaaaaactgcctaaatccaaagggcatcagcctaatgggtaaggtcagcatgaccataaaccacaaataacatctccgactagaaacattccaaacttctccctgaccacagacatatcagccccaagataacctcccctctggctggagagatgtcagcctcaagataacctcctctctgaccagagacattccaaccctgccataaacttctcccctacacagaaacattccaagcttgtgttaagctctctcaccctaaaaaaccaataaagactcttagtccataagagagagcgctcctgaccgaaatcatccagaagcctctctcaggttcattctccaaaatatatctgtctttgactgttgggccactttttgtgtttctttcctctttctttaactcttacacatcctttaagcccatgtgtgacccaattcttctgggcaggagctggaatacagaaagcagtcacattgtccctctgcccttgcgaaaaggcagagggtctactgagctggttaacataagccatatgtgaacggcaaagtggaaagagctttgtaacactggggttgcaggcacccaccccctagacactaccatgggtctggaacccaaagcactcaacctggctcctgcacctccctgtctgagtggtccccctcccattaggggtttgagcagtggtggcattgaataggcaagccacacccctgtcacacctcctgtgaagagatccaggaactctcctgtttcagctggggtcctgtccagaatacaaagaaaggtgagttaaaaagcaaaactgtcagatctgcctcttctccaagactctgccacctctctctttcctgctctgtttctctccggggaggtctagccaccacatgggactggagtaaagccatggggcaacgaaaagctttttttttttttttttttttttttttttgctgaaaggctccaggactgaattccgtaggccaagaccgcagacttcctttggtgtcttttcttctctcagtttaaaatggctcttatctcttcctttataacgtcaaaggctttgctacaggctgcggcaataatattaaatagaatgagcatttggctcagccatcaaagatgcaaatcagaacaaatacttcccatttgttcttaaatgtgccatccccagcctgacagccacaggcacgtgtggcccacagcacatcctctccttactccctcctgtcctgactcaggcacctagaggtgtccacagcatgcacaagagggacaggaaaagactgtggctgccacagggacccagcacagccagctacctgcccattgtgccaaaagaacatttcctccccagccaaggaatttagccaggtctgaaccagaggaagaatacaaggattaaagggacccactttgcactgagcaaggggttcttcctccaggaccttcctctttcgcctcataagctgttttttcttttttacattttctaagagagggttcctacccccagcactctgcttataatagagaaaataatggaagagtgacccctactggctgattactgaaaattcagcagggctcatttgagacaatctaaacagatacagcccctgaaatactttgtctcaaactcgattcgaagcgtcaggctgaagtcttagcaaggaaaatcagatttgagggatccaaagccaggcaacaggcacaatgtaaatgggcaggaccaattcctgccaactaaaccacccccacctcatgaaaggaggccatgttccatggcataatgaggcccagggaactcaaagtttgccaatagttgggaagatggaggcataggtgagagtggataattcctattctctaggccttccctgcttcaagggtgcatggtgcattagcacccatggtggcacctgctaaggttgccagaacttgaggacaaaaagatggaagagaaagggaggatgtttgctttctctctcacaccctgggttttcactgaaagaaagaatagagttgagggatgcctctattccctgtctttcagaacgggcaaccagctctctttaccacccccagcttatactcctctggagtgtattctgaaccactggaactgctttgacactcagaatgtggaggaaaaatgcctcatagccctctgcataaatttttggccaacttatggactggaagaccattcatttcaataccatcaggcagttggaccttttctgtagacatgaggacagatggtgtgaggccccatatgggcaggctttctataccttgaaaggcaatccagacctttgctaacagtgtaggattgatccagccctcctgtttgttgtctcaggaaaggctgcaaggggtgagccaagggaactaaagatacaaatcctagaggcacccccagaagaagagccagctccctccagccctgctcctccaggtccacctcaatctccctatccaacttcagcctctcacttaccccctcctagaaatcctcacctgagacaagccccagtctcactcttgcccttccaacagatgcctcagatgcctggtgaatttgaccccagtaaagtccagatccccttctctctacaggagttaaagcaaattaagggggatcttggcaagttttcagatgaccctgtccaatatatagaggctttccagaatttcatccaagtatttgaactcttctggagagacattgttacttttgaatcagaccctgacagacactgagaagcaggctgctctgcaagcagcagagatttggggatgagctttgtatcacatacagcatcagggaagagggcgaaaattatccaactggaagagagacagtactaatgaattaccctggatgggatcccaatggtgagatgagagactggaagaggagacagtttcaggtttgcataatggagggcgtgtgtaggaccaggaccaagcctctcaattacactaagttatccatgattgaccagggagttgatgaaaatcccactgccttcttggaaaggcttagagaggccttggtaaagcatctctttacctcctgattcagttgtggaacaactaatcctggaggataagtttattattcaggcagcccctgatatcaggaggaagctgcaaaaaacaggccctgggaccagatagtactttacataacctcctgaaagtagccatctcagtcttttataatagagacagggaggcccaggaaagacaggggaaatacaggaaagagacaagggctttaatatccaccaggcaagcccacaaaccccagaattcccagggtgtacctgttaactgctacagatgtggcaagacaagcagaccagcagatgaggggtttgagcggtgggtgaccgaacaggtgagccactcccctgccgcatgtcctgtgagggagatcagtgatctctcttgtttcagaaggctataaagcttatgatgtaacaacttccaaagttacaaagacacaaagccgctcatctcccactaaaggatcatggagggtagaagaatcaatagacacaagcttgtatgcttttagtcatatgatttatttttttctgtgaagttgaaagttttaagttaatggtgagtttcttggtaatatcctttcttcatccgatggctttgattttatcacttggttactgttgcagaggaaatgcagaaaaataaaaatgttaaatcttcattgttaataaaagctgttatttactattcaactattagtagaacacttaattagtataatgagacactgattatactggtgaagtctgtgtctgtgattcaggaagtttataaatctaaatttattttccataaatggattgtaattgctacattaaaagggaatattacaaattgatatttatatttttaatttacatagtctctaaactttacatggataaatgaaaatcatcaacaaagagacagaagaaaaatataaaggaaaaccacaaaaaggaaacagaaaaaaacagcaatataaatatgtgaaaaaataataaagaattactatacatttttctctatgtatctgaggaggaaaagaacttccaaaaaccctctgtgcatttccagtgggttcttaaatacacttgttcaaagacaaactaactcttcactcccctccacttcctcaccccaaaccaaaccagttatttctctactacacaatgtgtcactggtaaaaggtgtcactatccattctgtcagaagagtggaggtttttttagttctctcttttattctaacccataaacgtccatccagtcactactctaacagattgggcctctgtcatacctctgaaaatgtttttgtgcttttcctcctctccaatcctgtcctcatcacacctttcttgtgcattcagcagtctcttaactgcttcactactttccatttgtgactgaatctactttccctattttatcccagtgaaatttgtaaactgcaagacatatagtaccaaatccctttcttaccatcttaaaaagtaccttacctatgttcttagtcatatagaagaatatttaaactccttattgtggcatacaagatacttattttggcttatagttacctacatggattttacatctcagcattcataaacttgcaaattcccacactttgggaggccaaggcaggtggatcatgaggtcaggatatcgagaccatcctggccaacgtggtgaaaccccatctctaccaaaaatgcaaaaattagctgagcatggtggtgtgtgcctgtagtctcagctacttgggaggctgaggcaggagaatcgcttgaacccaggtggcagaggttgcaagtgagccgagatcacaccactgcactccagtctgggcaacagagtgagactccatctcaaggaaaaaaaaaaaaagccaaaattttgtaaataaggaagggtggttttactttttagccttgctattttcctgctgtatatcaatagccatattatttaagcattttttcttacattctgcatccaaactgtcagtacattctgttgtgttaccttcaaaatgtatccataagaccatccttaccacccctggtctgaagcgccatcttttctctcctggattactgcagtagtttctccacatctactcttgccatcatatagactgttttcaacaaagcagctttttaaagggtaagtcacatgcttagaatctgcaccatccagtgattcctccctttcactcaaagtaaaagacagatggcctccaagagtgccaagaccctccatgggtgttacttctctggccttatcacaactgcaaccctcttggtaactctgctccagatagaatgacatccctgatatttctccaacatttctgacttattttagcatcatatcatatatatgttttgaaagctgctgtgaagatatttgcatggataatgccagtatatgcctgtgtgggatagatttgatgtgcagctggaatggaaaagctctatctttatctctgggaaagcctggatgtctggttttgactttttcccaggataaggggagtagtatttatgatgagccatttacaatttaaaataagaaagcttgggccatagcatctctctaattcccaatgcttagtggcagataaggaaacagagacccactgacttaactataaacaaagtcagatatgagggaatggcagctaagtaattagatgaactgttgatctccactcttggttgaagttttgaattttccatttactcccagtgataggcctaacacatcaaatataattatttctttacacatatgaattagaactttgaacaatatatatgaatgtatatttatcccatcttaaagattaaaaaaaaagtatcgttctgcctttgaagaaaggtgcatttaacattttgcctggcatctcatgtgtctcaatcaatgtaaattccattcccaatccccagtcatatatcaggctatatttgttccagattgtggcaatcttaagagtttaaattctgaagtcggattgtcttaagttaaactccactacaatactcactaaaattctattttcctggggaatcaatttatttccttttatccatttcctcatctctaaaatatgggtaacaatacctatgacattttagtaaggatcaatcatcgtaaatgtggagagacaatctgtgtaaatcgcccaatgagaaccttacataaggccagaggagataatgattgtttatgaatattttacaaaaatatttataatctctttaacatcattccttattacaaaaatgttgttcaataaatctctggctaaatattagttaacattaaatatttctaaataagtataaaacataattaacatcaaatatattttcttatctttgttttactatatagtattaatacataggagtcaagatgatgaaatatgggaataatagttttctcatactgaggtattgttaaaagtaaaaaaatactccatgagtattatttcttaacaatttattttacgtcacctttaactctgtgactggctgctgttactaccgctgtcttctgagatagatctgtataaaagagataacattaggaaacactgtaatcttgagcgaaatcaagaaaagtttaaaaagctacatttgcactaattaatcaattaatatgtatcaagtggccaagtgcaagcagagcagtcaatttggaaacaatggacatagacaagaaggggtgatgtcaattataaagacttcgagtgacaaagagattgacctagttcctgatcatctggttcattgctattttgcttcagccctacttcatttcttaccctggcagccctgaaaccacttactgttataaaacttaggctgttgtgaccagattttgtcagttttaatcaatgatcccagttattctttcttttgaattatcaaatccctacatattcataaagcaaattatggtttgatgtggtgttagagttaaaaaaaaaagctgtgcaagtaccttacttataatttcagaaaaacatgagccatattaattatgcacaaaatacaaagtatcctatctgagttctctccctcattctgtaccatctccaatttttcttaccttctacatattctattcacaaaattttcttccctgactatttctgtggacctttttggcacaactggttgtcaatgcaagagaaatggggttccttgggaagtcaacagaacttcctaaacaattgtagaaaacttggctttctatgtgaaaggcaatgaggctttactgaatagctttaattgttcttggccctgtaagaacaggcaggatacttagatgattgaaataaaataaaaacataaagaaataaaaaaattaaaactttgctatatgctgagaacttactcaatatttcttgtctcactctgttgcccaggctggagtgcagtggcatgatctcggctcactgcaacctctggcttctgggttcaagcaattctcctgcctcagcctcccgagtagctgagatagctgggactacaggcacatgccaccacgcccggccgactttttgtattttagtagagacggggtttcaccgtgttgcccaggctggtctcaaactcctgagctcaggcaatctgcccgcctcggcctcccaaagtggcgggattacaggcgtgagcttactcaatatttctaaacattaatccaaaccatcctagagtctcttcttggattctgaattgcactgaattcttcccacaatgaattttaatattaaattaaaaataatacatttacttacctgctgcttactgttcccactttgctccgaaatctcttcattttattccatttaagactaacaatagcaattaaaatgagcaaaggtgaaaaaatgtagaaactgatcaaaagaccattgtttttaggagcagcacgtcgttttggaagcaagggtacacttttttctgaaaacatgagagtacatttttaactatttgaaaaatgatgaaatcataccagaatttgaattatagaaatttagaactcaacacagttaaagaatgaatatatttgaatttaaaagtgtttttagccttctctgactgggccccaaagtgcattatacattgtgtatgtcaactcaatacacttatacatataattgacaatacacagtcattggcaatatgtaatattgtcatgaatgtacttattttattgacagtaaaatttttattcacataaaatacatatttattgacataaatttacttataatcccttcatgtatacttaatatttacttatatgatataatctattttagtgtatcatatttctttttgtgaactgcattaagtacattcacattgatgtgcaaccatcaccaccaccctgcttcagaactttctcattctgcaaaacggaaatattttacccattcaatattaacccaccatttttccctctccccagaggagccaccattattctactttgactccatgaatctgactaacctaggtactaatggaagcagaactcagcaccggcaaccaccattctactttgagtctgagtttgactgctctaggtacctcatagaagcagaattgtataatatttgtcatgttctgactggcttatttcacttaatcataaggttttcagtttatatctacattgtagggtgtgacaggattgttcatttcaagggtgaataatcttccattgtatttctacaccttattatggttatccatttatttgtcaataaacatttgggttttccatgttttggctattgtaaacaatgctgctataagcatgggtatacaaatatctgctcgagtctctgcttttaatttttttgggcatatacgtagatgtggaactcctggataatatgctaattctgtgtttaatatttttagcaaccagcatgatgttttccacaaagactgcattattttacattttcaccagcaatgcaaagagttccaattttttcatatcctggtcaacactcgatatgctttgaatttttctttgtaatagccatcctaataggtacaaattggtatttcattatggtttttacttgtaattccccaaggattagtaatattaatatgtgaaaaacacaactttttctgtgcttactagcccactccacagctttacatttcctcaaagatgtattaaaagtatgcaactactttgcccatttttaatgaaattatttgttttgttgttgttattgacttgtaagagttctttatatattcctaatattaatccctcattatatagattattttcaatatttttgcccattctatggattatcttttcactcttgatagtatcctttgatgcacaacagtttgtaatcatgatggatcctaatttatctgtttttttcatttactgatggtgcttttggagtcatatcaaagaaatcattgccaaattccatgttattacaatttcctattatgtcttctgttttaagggtctataatattagttcttgcatttagattgttgatccattttgagttaattttggtatatggtatcaacaaaggccctacctcattctcttgcatgcaaatacccagatatctcaacatgatacattgaaaagactgaacttcctccagtaaatggtctaggcattcttgaaaatcattagaccatacatgcgaagatttatttctgggatccattttttattcctctggaaaatttcagctttcttatatttttgtccaatgtgatatatcaactgtcaagaaagtacaacaaagtcctggagacttctgtctttctgtcatagcttttgttgaacacatttgagaattcagcctttttttttaactgcttgtaataatatgaggaagactattgatgaaacaaaatattatacaattattaatctgacaaatgcaaagaaacataaagcaacagtttagcctgtaatgattatcttagtctgttcaggctgttgtaacaaaaatatcataaactgggtggcttacaaacaacagaaatgtatgtttcatcgttctggaggcaggcaattccaaaatagaggcactggcagatttattctccgggcctatttcctggttcataataatcttctcgttctaatcttacatagtggaagggatgaaggatctctcttggttttcttttattagaacactaatcccattcaagaaggctctgccttcataacctaattagataccaaaaactccacctccaggtgccatcacattatgaattaggttacatgacaaaaatgttgaggaatgcaaacatttagtctacaaaaatgttgcagttgaccatataaatgaaatatcagactacaaatctttagatgatgatatcctaatttttttcaagtgaagaatcagtgagtcaatgatatatttcaaaagacaaaatggatacatagaattctcatccagtaatcatataataggaaggacttcagcaagcaatatttttcataaatacctgggatttcttggactgtaaataagatctagaataaatagtattccagcttctatggaagatgttcatgaacatttattggatattgttcacaagtggacacagtgaagttaaatatttatgcagagttgattgaatggagtcagtgtaggagtttaaaaactgagtaattattttagatgtttattaaaatgaactgaaaatattttaattatagtacaaacaggataacatcaggaaaactgtgaccatcaaagttgtcttttgaagatgtaaatgcacacacaaaaaaagaatcacaaagtatagtcacctctaacctactagagatgtacttcaaatgttccttgcagtcatagaaaggatatgttctagatccatgtttgacagcaggaactgtattcaaaacacatagaacactttagttatatacccttcaaagactagagtaaatactgagctttctatatttaaaatttttattgaaatttttcataaagctgatttcactacttttatttctacttttatatatttcctgtaatatgttttttatataaaaaatagttttgggcctacaagttataggtaactaataagggttaatttcaggcaaaatagaattcaagagaaagataaacattacagaaataataaaagcaacaatgcaccagaaataaatctaaactacacatacaataatgaagaaacaaactaactgataaaatgaaaaaaagtacataattatgattagaatttttaaaaactcctctcttagtaattgatagaagtaaaaagaaatcagttggtcagttccatgaaaaagcataagctactttaactcatctaatatgaaatagataacattattgtttacatatttattaagaaaatatttatttaagaaaaatctttattttaaaagctccccacagaataaatctccagacccatatgaattcactggacattattactaaatattttttaatgctaattttaagcaatcacttctagaatacagaagaggagtaaacacttcccaattcattttatgatatcagttttagttgacaacaaaacaagacaaaaacaagtacaaggaagagagagagagagagacagagacagagacagagagagaggcaggcaatatctctcaccaacctagacacaaaaatcctcaacagaatattaacaaatcaaatttagtaaagtacaaaaattaataaataatgatgaagaatttattctatactttcaaaattggttcaaaattaaaaatcaatgtaattgatcatatcagtggactacaaggttcatacattcctatcaaccgatactaaaaagcatttgaaaaattaatactgttaataacaaaacatctcaatgaatacatattaaaggaagttcctcaaactaataaatactatctacaagagccctacagctaccatcatacttaatggtgaaatactaaattcttttctgctaaaataattattaaggagagttgtttacaactcttattcagcataggcctggaaagtctaggaagtgcaataaaataataaaagttatacatattggaaaggaagaaagaaagctgttatcttcaaagctatttgaagagggcataatcacttacgtagaaatcccaaagaacttgcaaaaacaaaaaaaaattctcagaaaaccgaattcaattatattgggaaatacaggattgatgtgcaaaaatcaatggtatatttgcatattaacaaggaacaaggggaaataaaaacataaaaaacacccaacatcacctaaaattgctctaaagataatgaaataaaaatgaaataataaatgcataggatatggtaaaaattacaatagcctgatgaaagaaatcaaagtagatttctttgatttctttcatcagactattgaagaatcaaagcagatttctttgatttctttcaaatggagagatatgctgtgttcatagactgaaagacccaataataatgaagatgcaaattcttcctaaattgatttgtaaaaatcacagcaagatttttaaataaagatagatgaactcatgctagtatgtatgcatatagagaaagaagagctctgagaatagttgtagcaattttgaaaaaaaaaaagaattaagtgacaggaattcctttttttcccccaatgttaaagaatgtggtacttgtgtatggaataagacaaatcaatggaaccgaacagagacctagtaaaataccaacaaaaatatgtttaattaatttttgacaaagttgcaaaaacaattcaatagatgagagataccttttctaaaaaattgtgctagaatttttgtagtttcaggtcttggatttaaggccttgatccattttgagttgatttttgtataaggtgagagatgaggacccagttttattctcctaccatgtggcttgccaattatcccagcaccatttgttgagcagggtgtcctctccccactttatgtttttgtttgctttgtcgaagaccagttggctgtaggtatttgggtttatttctgggttctctattctgtttcactggtctatgtgtctatttttatactagtaccatgttatttcagtgactatggccttatagtatagcttgaaatcaggtaatgtgatgcctccagatttgttctttttgcttagtcttgctttggctatgcaggctctcttttggttccatatgaactttaggattattttcggtgaagaatgatggtggtattttgagggaaattgcgttgaatttgtagattgcttttggcagtatggtcattttgacaatattgattctacccatccatgagcatgggatgtatttccatttgtttgtgtcctctatgatctctttcagcagtgttttgtagttttccttgaactccttggttaggtatattcctaagtattttattttattttttgcaggtttgtaaaggacttgagttcttgattttattctcatcttggttgctgttggtgtaaaggagagctactgatctgtgtacattaaaaagaactcattatatgaaaaagatacttgcacacacatgtttataacggcacaacttggaattgcaaaaatgtggaacaaatcccaatgcccatcaatcaatgagtggataaagaaactgtgagataaagaaactgtgagataaagaaactgtgtgatgacatatatatttatgatgaaacactgctcagccattaaaaggaatgaattaatggcatttgcagcaacctggatgggattggagactattattctaagtgaagtaactcaaggatggaaaaccaaacatcgtctgttctcactcataaatgggagctaaactacgaggatgcaaaggcataagaaaaatgcaatggactttggggactcaggggaaaaggatgggaagggggtgaggaataaaagactacaaattgggttcagtgtatactgctcaggtgatgggtgcaccaaaatcttacaaatcaccactgaaaaacttactcacgtaaccaaataccacgtttccccaaaaagctatggaaataaaaaattttaaaaaatatgctagagtaattgaacacccatttatcaaaaatttaactttgatatatatctctcatcctatataaaattactttaaagtgtattatgggcttaaatggaaaccataatgctatactttttaaatcttcaggttctaatactcataaagaggtcatatacttgacaccagaagcacaatccagtacctaaaaaagtgcaccttatcaagtaaaagtcatataaagagaaattttattctgagaaaaaacaaattatagacttggagaaaatgtgtacaaatcacacatccaacaaaatacatgtatttgtaaaacataacatctttcataaacatggcatttttttctttttcccttttcaatttctttcatcagtgtttaataatttttattgtagagatctttcacttcttttagtttattcctaggtagttcatcttatttgtagctattgtaaatggaattgctttcttcatttgtttttcagattgttcactgttggcattttgtattctgcatctttactgaatttatcagttctataatgttaaaatacctgtaccacacaaagcaatttacagcttcaatgcaattgttcacagaaatagaaaaaataatcctaaaacgcatatggaatgacgaaagacccagaatagtcaaagtaatcctgagcaaaaagaacaaaactggaggaatcatgttacctgaccttatactacacaaagctatagtaaccaaaatagcatgatgctggaataaaacggatacacagaaaaattgaacagaataaagaacccacaaatgaatccacgtaattaaagtcaatttattttcaataaaggtgtcaagaacatacactggggaaagaacagtcccttcaataaatagtgctgggaaaagtagatagccatatgcagaagaatgatgctagatccctatctcttgccatatacaaaaatcaaataaaaatggattaaagacttaaatctaagaccctaaactgtaaaacaactagaacaaaacactgggtaacctctccaggacattgatttgggcacagatttcttgagtaagacctcagaagctcaggcaatcacagcaaaaattgacaaataggatcacatcaagctaagaagcttctacatagaaaaggaaacaatcaaccaagtgaagggacaacctacagaaccaaagaaaatatttgcaaactacccatctgacaagggattaataaccagaatatgtaaggagctcaaacaactcaataaaaaattaattttaaaatgggcaaaagatcttttagacatttctcaaaagaagacatacgaacggcaaacagctatatgaaaagggactcaacatcactgatcatcagagaaatgcaactaaaaactacaatgaaatattatcttatccctgttaaaatggcttttatccaaaagataggcaataatgtgagaatgtcgagaaaggggagcacttggtacacactgttggtgggaatgtaaattagtacagccactatagagaacagtatggagattcctcaaaaaaactaaaatagaattaccacaagatccagcaatcccactgctgagtatatatctaaaagaaaggaaatcagtgtatcgaagagatatctgctctcctgtgtttatttaaagcagcattattcacagtagccaagatttggaatcaacctaagtgtccatcagtggatgaatggataaaaaaatgtggtacatatacacaaccgactgctattcagccataaaaaggataaaatcctgtcatttgcaacaacatgaatggaatggaggctattatgttaagtgaaataagccaggcacagaaagacagatggtgcctgtctgttttaattcatatgtgggagctaaaaacaacaaaaaaattgaactcatagagagtggaatcatggttgccagagcctgggaagggtagtggggatggggggataaaaagggaatggttaaggttacaaaaatacagtcagaagtaataaggtctggtgttcagtagcacaatagagagactatagttaacattgatttattgtgtattttaaaataacggaaagagtgtgattagaatgtttctaatacaaataaataataaaggcttgagatgatggataccccaattaccatgatctgatcattacacattgcatgtctaacaaaacagcacatgtaccccatgaacatatacaactattatgtacccataataatgaaaaataaaaattaaaaaacataatatctctcaaaactgaacatttaaaaaacacaaacaatccaatgagtaaatggtaaaatgtatgaacagacttttcactaaatagaatatacaaccgaataagcatattaaggatgttcaaaatcattatccgtgaggaggtgcaaatgagatattaataaacagctaatggaatgattaaaattcaagaaaaaacagtggtacaatcagatgttggtgagggtgcaaaaacgtggtaattcatatattgttggtgggactgtcaaacagtacagccattctgaaaaaatatttagcagttgcttttaaaattataagtagtttacaatatgtctcagctatttcagtcttgtgcatatatcccagacaattaaaatattattttcacatagaatcttccacatgaatgttcatctcagttattcataataactaaaactggaaaccacccaaatgtccttcagtggatcaaaggctaaaaaattatggcatatccatacaaatgaaaactagtcatcaataaaaaggaattaagtattggtacatgcaagaacttggatccagttcagggaaattatgctaaagaaaaaaatccagttgcacaaatataaaaaccatatgattttgtttatataacattcataaaaccatgtaattagagagacagagaaccatttaatggttggaaggagagttagagatgagggaaaagaaaaatatctatctacaaaggggtaatgttagacaaccatgtagtgatgatacagctatgcattgtcattgtgatagtagtacataaatctaaactgtgataaaattgcatagaacaaacacacacacaaacacacagacacacaaatgagtgtaaatatactagagaaatctgattaaggtctctgtattttaccaatgtccatttcccagttttgacattgtaggacagatttgcaacattttaacattggtgaaggatgagtgtaggttgatttattcttcttttaatttacttatgtatatatttatttcaactacttttttcatcctaaattaactgaaactactttcttcagtatcatctactaataaagtaccccaaattctaagttgtgggaagaaggaaactcattctaacaacctcttggcatatattttttcttgatcttcagtgtctttaactcctttgctctaagttgccatattaagatattcatacatctagttatatgccacttcagcatatttgacatatgaatccattcctcaagcatttattcaggtatacaattctaatagtaaaataaaggtttagtaaaaacaaatatatttattcaggacttttcatcaaatcaatttaaaaatgttcagtgccacagactactcatatgctgtaggcatgaaaaatttaatgatttttctctttcaatattacagttacctttaaagattgaatttgattgtgaattgggatatcacaataggtgacatccttggaattcacagactatataataaaactgcaacgttttctataatttaagtatacttacatagaaaactctgctgtataaatagaaatattctgggaaccctgcttaaagtgaaggggaggccttttaaaatgttttctaggtgagaactaaaactatacagaaaattttggttggcagaaagattcagagctgtctggctctagatccaatttagtagccactagtcacagtagtcatttaaatttaaattaaataaggtaaaatacagttgaaatttcagttccttagtttcactatccacatgttgggtgtttgatagttatacaggatggcaaagatgtagaccatttctatgagaacagaaagctgcattgaaacacagatctagagactaacctactgtaagccaaaatccatcattgatacttcctcctggtgatgacattgctggctcacaatctggaggagcataaccaggatcacattgacaatggaaatgttcattgcaaatctaaaaccaaaacaaacaaaaaaagcatttatgtacaaccaaaaattcactgccttatatgtgattgttagtcaatgtaaattttaaaaatattaccatttaatataaattttaaatttaatatgaaaaataattttaaaaataaaaggcagtataataaatgtccatgcaatatattttcaaacatcatagaggtatcttcttgtttgtctcttacatttctaaataaagtgaataccattcttgatacaatttaaatgctttttattagaagggcgtacagattatgatgctagaaactatagaatggtgggagtaaaaatttattataaattgtgttggatttaaaaaaatagttgtgatgagggccaaattttatttaaaaaaatagggggggaaagccaaaattttaagatgcttgctcaatcagatacagacacaaaaaatttatatagaaagctagaaaaaatgtataaatgtgatctggcagacgaatggaaaaagggccagtagagaattcagaaataaatgcatacaaaattgattacgaaagtaaattaaaattaagaaagaaaagaaactgtaaataatagatgtgtaagtaattttgaggaaaaattgatgtaagccacacaggcaggccactttttcctgaattactataaaaaatatgaatcatcaatatggcagaagacactgaccacaaagagacaaatgcatgcttagaatgacttataaagtttacaacatttctataagccagtagataagtttacaatagatgagcaaacagaaatgcaagtggcagatatgaccatatatacttaggaactgtattattaattagcaaataaatgcaaattaataatggacttagcatgttaaaagagactaaaaagattaatacaactaatctggccagaatatgaggaaatgcacattttcacacatgataggtgggagaaaaaactggtataatgtttcttgacgacagcataatacttaggaaaattcaaattgtgcatatattcagcccaaattttatttgctaataatttaaggaagcatatcaatgtgcaaaggtaaatttacaatcatatctgttgtaccactatttgtaataagctaaaatttaacattaattgaaaggccatcagtgaatggcattttgaatatagtatggatgatccatatagtgaaataagttgaagctgttgaggaatgaaacagatcttaatggattgaaaactctgatctcataaatcaatgtacataacagtgtgtgaatgttcatattgtataagtacacatacgctcaattataaacaatatgtatgtatatgcataaaagcataagtagagtccttaataaatccatttctaaaatttaataatcttaatctaatatcataataatggattctgtttcatggtgcattttttacaaagtgtaaaacttatttgctcatgaagcccataacaatctgattatatgcataaataatatgtatgtataaatagtggatctactttccttatttaatgacaattttcaaaaagaaattttcacatctactacttgtgaactttattattatcatagaacatgttattgacatagattaaaataattatactgagaaaaatagtaactgttacataccccattctgtccacaatttgtagtatattttgttatatttagttcactaaaatttctgcattctcgggagtgacatacctaaaatgttatgaagcaaacagcaacaaaaatactaaatgtaaagtcaagagataaggaatcatattcatacaaatattatatgcacaggagatatacagaacagatgaatctgaatttcatagcattttaataaaaacccataggaacaattctaaatggtatgttattaataagaaatattacaaatgagatattttcagaaagcagaaatatacatttttattacacactggtacaagaaaaaagtagccagcttgtactagcaatttttaatttataggacctcttttaacactttttatgcacctttcttttatttactcatatagacccttagaaggagatatttttgggctcattttgtatttgagtagtagggtggctgtgtcaaatggtgggtagtactttgagaaatctccatactgtttctcaaagaggttgtactaatttacattcccaacatcagtgtataaactttcctttttctccacattcttgacatctattgttttttgactttttaataatagacattctgacttgtgtaagacggtatctcgttaaggttttactctgatagttggtgatgttgggcatttttcctatgttttttggccgcttgtatgtcttattttgagaagtgtctgttcatgtcctttgctcacttgttagtggggttacttggttatttttgtcgctgttgtgttgtttgagttccttgcagattcggatattagtcctttgttggatttataatttgcaaatatttttcccattctgtagattatctgtttactctgttgtttcctttgctgtgcagaagctttttagtttaattaagtcccatttatctacttttgttttcatagtgtttgcttttgaggacttggtcacgtattctttgcctgggccaatgtccaaaagagttttttgtaggttttcttctagggttatagtttcatatcttatatttaggtctttaatccaccttgagttagtttttgtatatactgagaggtatgggtccagtgtcattcttctgcatatgctacccagttttcccagcaccttttcgaagatggtcctttctccaatgtatgttcttgctggctttattgaagatcagtttgatgtaaatatgtggatttctgggatctcttttctgttccattgatctatgtgtctatttttataattatatcttgctgttttggttaccattggattgtagtgtaacttaaagctaagtaatgtgatgcttccagcattgttctttttggttaggattactttgactaatcaagctgttttcgtgtcatataaatttcacattttcttatttctgtgaaaaatgacattggtattttgataaggattgcattgaatctgtagattgttttgagaagtatggtcattttgatgatattgattctcccaatccatgagcacaggatgttttcccatttgtttgcatcatctataatttattttatttatttaattcagtgttttgtagttcttgtagagatccttctcctccttggttaaatatattcctagctatttaattttattttttggtagctattgtaaatgagactgtcttcttgattttgtccttggctagatcattattggtatatagaaacactactagtatctgtctattaattttgtatcatgaaactttattaaacttatttatcaaatctaagagtttttttggtggagtcattagggttttctagacaaaaactcaatcatcaggaataatttgacttcctcttttccagtctggatgactttattattttctcttgccttattgttatggtgaggacttccagtactatgctaagtaagagtggtaaaagtgggcatccttgccttgctttagttcttacaggaaatgctttcaatttttccttgttaagtataatgttggctgtatgttggctgtatggttgttgtagattgcctttatgatgttgaagaatgttccttgtatgctgagtttattgcgaatttttatccgaagagatgctgaaatttatccaatgatttctctgcatcagttgagattatcatatggtttttatctttcattctgttgatgtgatggatcaaatttttgatttgcatgtgttgaaccatctttggatccctgggatgaatcccacataatcacgatgtattatgtttttgatgtgctgttggatttgatttgctaggattttcttgaggacttttgcgtctgtgtcttccagagatattggtctttacttttttttatgccgttgtttggctttggtatcagatgatactcgccttgtagaatgagttagagagaatttcctcctccttgatttttaacaattgtttcaaaaagattggtattattctaattattagttattctatttattagttagtctaattattagttattctattccggaggtagaattgggcagtgaatccacatggtcctagccttttttgttgttgttgggataatttttactactgattcaatctcactagtcattattggtctccttgggagttgtatttcttcctggttcaatcttggtaggttttatgttttcaggaatttatctatttcctctaggttttctagcttgtgagcataaagttgttcataatagtctctaataatcttttgtatttctgtggtgagttataatgcctgcttttttatttctcattttgtttgtttagatcttctatcttttcttcttgtttagtctagctggtagtgatagtgacaggggccagagaaatcctaggcagaagagggtgggtccctggcaaagccccaccatcaagccgaaaagcctgagaccgcagcccaaagtgagaactcataaccctgttttcccgctcgaatgctgcctttccctaaacatccatggcccaccccaccccctcaacctttgcctatgaagacccccagactcagccggcagagaggagaagcagctggatactggggactacagccggacattggagagaagtggcttgacttcagagggacagcttgacagtgtaacttggaggagagtccagctggagatggccggacttgaggggaagattatctgctcgtcccctttccagctcccctttccactgagagccactttccctggcaataaaatctctcgcatttaccatccttcaattcgtttgagcgacctcattcttttctggatgccagacaagagctcaggagccacgagtgtggatacaaaaggctgccacactggccctttgccctcgctggcagaggacagctgcgggcccactgagctgttaacacttaagccatctgcagactgcagagctaaaagagcactgaaacatgtcctctggagcttcaggggtcgcaggcaccccccttagatgctgctgtggggcccgcagggagtttgtttctgccagcacccaaaagcacttgctccggctcctttacccgctcacctgcacgctccctcctgcgaggggtggaatgcagcaggtcccagcgagtgaagctcactcctgccagcaccgcagtggctggctggtttctgtgctcgtatactccagttcccgccccgtttgctcctgtgctccctcccgcgaggagttgagcgcaacaagctaagtaaacagggcatccctgtcgtgagtccaacgaaagagttggggaaataccgtggttcagtagtgtatcaattttatctttttgaggaacaaaccttttgtcctgttgatccattgggtttgttttgtttgtttaatctctgtttagtaatgacggacctctcttctcactctgttagttctcatgagagctggtttttttgtttgtttgtttttttcaaggagtctagaactttcctcctctgtctcttgcttcttctctcaccgtgtgatctctgcacataccagttcctcttctctttccaccaagaggaagcagcgtgaagccctcaccagaagcagatcctggcactatgcttcttgttcagtctgcagaactgtgagccaaataaacctatttcctttataagtcacctagcgttagtattccttcatagcaacacaacaactgactaagacacattaaatctcacaagctaaggggcttcgtccctcaagactggccccatatcaggtgcaagtatcaggtaaaccatacttctgacagaccagatataaattaggggttctcatgacaccctccacagggtaacaatgttagaatggctcacagaactcaggaaaatactttacttgtatttaatggtttgttacataagatacaactcaagaacagctacatggatgatacatttatggcaaggtattggaggagaggagaagaatttccatgctttctccagctgcaccaccctcccagcaaattgatatgtttattaacccagaagatcattgaatctctttgtttgagggttttaatagagatcaatttccagccctgcctctcttcttccaaaagtccagtgagtcaggctgaaagttccaaccctctaatcacttggtcatcctgataaccagccctgttataaggccagcaaggggtcccaccctaaatcgcctgatggaaataagcacaatttcaggtgtgactgaaaggtgtttattcattctcaagaacaaaaaacactcccatcacttaggaaattccaagggttttattagaagctgtgtgccaagaatcagaggcagagaccaaatatgttctgtgttatgctatatatattatatatataaaaaagataaaattagtatatcttttatatataaaagataaaattagttaatatatttaagtatttatacttctgtatttatagtaaatattttttcagtttgttttaaatggtctttggaggaatgacgtattactttacaatatagtcagcatcagtatgttcctttgattaattcattacttttatgtgtgaatatcttttcccattctgagataagtatacttttcacttaaatttatctttttattttaaaaatatatttctatatgtaaattatttttataaaaatgtgtggtaattgtatactttttaattagtcaacttatttttcagtgttactagtttgaaaagcctttattaggtatctcaaaattcttaagaaagataaaaattaaaaaaacttaaacactatgttttattgtcatgttttatgtgaaggccacattttagacaaaatatgcttatggaagaagtagtaggagagcaggttaatgagaaaataattgctttacttcaattgtaaccaaaataattttttgtcaatcactacaagactaaatatttgtcttttttgggttttgttttctttaaagttcttgttattcaggttgttctgacattttttttttgcatcattttattcttttttgttcttggtttacacaaatcatcacagatcagatcctggcctaacagggagtcttagattctcaagcaagacgaaacaagtttaaatatcagtagtaaaagtttaataaaaataacagatagtaaaacaagaatttctttaaccagccgaaattctgatcagtgtatcttaagatcatgatattgtaaccaaaatttgtagcattcattataaatgaaaatttaatcatcctctcaatctctctctctctctctgatacacacacttcagacactcacagacaaatccaccatatatcgtatcaataaaaattttatttaccttgtgttggccacatgcagttatatcttctgtataggtctccgattgttttgaaccatttcttgcatgtgcggacaaacatacgtgacctctaaggtaagtatattgtatgtctaagtctgtcattggtactagttctgaatgtatccagtgacaaacaatctttccacaaaggatatcactagcaacataagacagaaaaaagttacccatttgtcacttaggtacacaattaggttaataacaattcaaaagtgaggataattcaaaatattactcagatcataacagcaaagcttttcacagcacacaatgccatattaaatgcaacaaataagtctatctgtatatactagatactgtctctcatttatttcaagtcactctttgcagtacatacacaaaacacaacgcacgcacttggaagatgtatacttttctaaatacgtacaaaaaatcacaacgggaaccacagtttccaaatttgtcattttgaaaattcacttcttctgtacacagaagattagcagacttagcaactgaaaacataagaagtcatagttacttatattaaaatattaaatggtaaaagtgtggtaagtcaatagaaagatatctagacaacaacaaggcccagtcagtgtaatctgctataaatttttgatgtcatctactggctttacaaggagaagcacttactgaaaactacacacatgagaagagaaaaattcatgttatagtgtagaaataattaagaaatcagtcacctgctctcttatctactattctaatagtctactccctttgcaacaaccaccttaagttggactaatgtcctactgttgcatcctgtagttattaggtctattataactcttgacatcattcaaagttgctttgatttgcaattttatttctaaatttgaatgtaaaacaacactttcagggatggctcttgggtgggttactgactttagaatagctacagtttaaatataaacctcaaaaaaaaaaggtaaaacaattacattttccaaataactgtgaacactgtctatccctttctctgcatactcctttaaagcaatagctagtcttattactgcagtattctaaatcagcagctttcacatcaggtacacaaaactcagatgttccattgcaatattctggaaaatcacacatatctacactttttctgcagacatggcctctttcgtggatctgtgagagaaagaaaaaaaaatacatttatttttcaggctcaatccagtttgcctccattaccaagaattgaaatggactaaatcaaacaaggagctccaatggcctatctatactgcatattgagaatgcttgtttgagaattgtcagcttaaaagcaaggatatccaagagatgcatagaataaaaatcctgtttgaaacaaacactcactagagcatgaagccagacctatcttcaattttaacctaagtttgtgtttatttttcttcgcttggacattcttcatccagttacaactgatcaatacataatcagtattaatgtttttatttaaaaattaccggtaggaatatctaagcactcattagaaataggtaataaaggccaggtgtggtggctcacgcctgtaatcccagcactttgggaggctgaggcaggcggatcacctgaggtcaggagttcaagatcagcctggccaacatggtgaaaccccatctatactaaaaatacaaaaattttctgggtgtggtagcatgctcctgtaatcccagctacttgggaggctgaggcaagagaatcacttgaacctgggaggtggaggttgcagtgagctgagactgcaccactgcactccagcctgggcaacaagagtgaaagtccttctcaggaaaaaaaaaaagaaagaaagaaaaagaaataggtaataaaacttaccgtacaagttttattgttacagcatgatccagtgccacattctgcagatctaactagagtacaatctgcaggattacagcattttttatgagtgcatgcctaaaagcaaatacattagatttaaatgttttacatcagattttagtcaaataaatagttttatttattttcgaaataaagtatctctccaacttgattctaatcacaccatgacttttggattctgtatttttacaccacttcatttaaacttaatgtactttccctataagaaaaaaaaagatgacaatgaaaatattcacaatttcattctaaagaaattgatctattaaaaatttagtgcaattttttaaaaaaattatttttgtttataaaaacatgcatgcaagtttttatatttttttacttactataccataagtacttttccatatcatcaagtcctctcaaggggagtggctggaagagtttggaggagcaagatagaaaaagcctacatttggccaggtgcagtggctcacctgtgatcccagcgctttgagaagcaaaggtgggcagattgcttaagctcaggagtttgaaaccagcctgggcaatgtggcgagaccctttctatacccaaaataccaaaaattagccgagcatggtggtgtgtgcctttggttccagctatttgggaggctgaggtgggaggatcgcttgagtcagtcggggtggaggttgcaatgaactgagatcaggctgctacactccagcttgggtgacagagcaagactgtatatcaataaataaatatgaataaaaagcacagattcttgttagggattaaaagacaagaagatgagggaaagttttaaacttcttagagattagataaatgctcatgaccagaatgttgatagaaatatagatagcaaaggtcattctcatgaggttaagatgaaactgaggaataaggttttagaagcaagggccatccttgctataaactggccaagaacttggctgaactgtgaccatgcctgaggggtttgtggaaggccaaacttaagaatgatgaactaggatatctggcagaagaaattttacatagcaaagttctcagaatgttgtgtggttgcttctaatttcttattgtaaactgctagagaaaagaggaatagagcagaacaacttgaaaaactcatagtttgcaatatagtaaggaaggaaagcgcattcacaggagagaaaaccaaggatgtagcacagggacacctttgcttaagagattaacaaagatagaagaaagcggatatggtcaggatcggtgttcctgcccaattctccctacaatgtcaattgtaatccccaatgttggaggtggggtctagtgggaggtggctgaatcataggggtagcttctcatggtttaacaccatcccactgtggagctgttctcatgataaagttctcacaagatttggttgtttaaaagtgtgtatcacctcttccttctctctcatcctcctgctctggccatgtgaaatacgcctacttccccttcaccttctgacatgattgtaagtttcctgaggcctcccccagccatgcttcttgtagagccagcagaacaataaaccaattaaaccttttttctttttttataagttacccagtaccaagtatttctttatagcattgagagaatggactaatacaaaagccaagtgctattcctcaagcaatgaaagaaaggccccaaaggcatttcagataccttcgaggcccagacgcctaggagggctgaatggcttcagaggacaagcccagggcactctccatgagctcactgaccaattccacctcaggatgctgctcctggccctgctgcacaatgccctgcagctaccacggcctcagctgcaacggccataggtacagcttctatcgcagctccagatggtacaagtcattaaccttggtggaatccacatggtgctaattttgcaggcttgcagaaagtaagaactgtggaagcatggcagctcccactcagatttcaaaggatgtccttgaaagcctggaggcctgtcagagacttgttgcaagggcaaagccaccacagagtccccccagagcagtgcctagtggaactgtgagagtggaactatcacagagaccccagaactatacagcagccagcatgcaatgccagcctggtggtgttgggttgattgagcccagccaaaccatagggatggggtgacccaatgccctggagcccactgtacctgtttatagaagatgcaggacatgtcatcaaaggaaattattcaggagtctgaatgtccatcattggctctcttgggtttcagacttgcttgaggcctgttacccatttcttcttgtctatttctccttttcaaaatggggttgtgtatgctgtgcttttaagtaaataacttgtgttgattttacaggttcttaaagtatcccctaacagacatattggcagtcttccccaagggactccttgtggctaaaatgagacacaccagaaaccagaatatcatggctagcaaaatgaaggggtagtcatgtattctggtataattaattctatgccagctgataaccctctcccgcaccttgtggtcctgccacaactccaactggacagaaaactggtcttataaacattctttattgataaacactcaggaacttcaagccagtttcaggcaacttatagagactgcgcacaaactgtctttgtgccctacggtccctttttgacataaagagccaaattccacctcattttagtgataattaaaagtgaagtgaatgtagaacatatgttacatgaatgtttactcactgtacacacgcctgactgccctcatgaatattcatagatttctcccagtcttgctcagtatgtgtgtaaagttgactctgaaagacatatataccacctccctcttcctttctgcagagaatgaacttttggctttcactggaagctatgttccccaatctacagattgcttccgcctctgaaaatgtcttttccttttcttccttcatggatatcaaagtcttttgttaacagttctggcaacatgggatgggatccaaagtggcccctgatttctttcttggcactgccttgaaaaattcctaagttcaattgcatcctggttacactgggcaagaactgggtaagtgctattgaatctgagagttcaggcttttagattgaaatctagggaaatgttttctttaagaaagttctgcccattcatctgtggcctagacctacctgcagtccagcagggatgcctgcactaacgttgcactgggaaggccaccttctttaggtgagtactgtgcgtaacttacccagtaaggaaatggttttggaccaactgctgtcagagactctggaggtttacatgtttaaaaactataggaaaaattcttgttaatatttggtatcctggataaaaataagtcggtatgacttaaagctttcttggtcacaatggggaacttttaacatgcctcaatcagtttatctacatgtgcaataaagaacagaagattccaaacctctcaaaagcagtgtgaggtctttttcagttgctaaaatgaaagctcaaagtgaaatcaaggatccctagttgcctctttaaaagagactaaatcaaaacttaatcaagatcttaaaaaatttgaaaattcttctaaatcggaccctaaatccaaaactaaaaaggacactgtgccttcttgcctttctccttgaactccaccaatgccacccccatatgcattagccccatgctgccagtcacttctctctgagctgcctttctttccttcaccttctattcatgagcaaccccctccagttgctaattctgcaacccctctgatcacaccttttaaagggattgctaactaggcttgcaaattaccttttactgtcctgggacaaagtctcagctttcttctagcgttagtcaaagagttttctaatcctaaaatagactcacttgagtttgaatgccgctttagtttgattataaatgtttaccagccaggacctcctgatgttcactagttgattcaagtcttagtggaaaatgtcttaacccaaggatggatgtgtttagctgactggactaagccccaagatgattttcagcatactaaggaaatagcctttgaagtggtgagaaaaacaattgttgaattgattaaagccatctcagcactctttccttgacaaactaattggaatgccattgactcagaaaaaagacaaatctgtcattgattcctttgactgattcaaaaggctttcttttttctttttctttttttttttttgtttttttttgagacggagtctcgctctgttgcccaggctggagtggagtggtacaatcttggctcactgcaacctccgcctcctgggttcaagtggttctccagtctcagcctcctgggtagctgggattacaggtgaataccaccacacctggctaacttttttggtattttttagtagagaaggggtttcaccatgttggccaggctgctctcaagctcctgacctcaggtgatccacccaccttggcctcccaaagtgctgggattataggtgtgagtgaccgctcccggccgattcaaaaggctttctacaaaattctggtatcaaagatctaactgatgatattataaatcttttttaactcactttccctcaagtaagttaaagcccttagcaccctgcttaagcaatatgatcccaattggccttctaagagaccctatgatatagcttctttggccaatcgcttctctaaaatcctagaaaagaaaaaagaggctaaagccaccaaggcactagaatggcaagaaagacagataaactcatggccttgcatattcaacaactcataaagtctctcccagatcagcaaactccatttaatagttagaaattagtttcgtcagttgcaagaggtataatttgctttttctggcatttgaaatgagactgtaaaaaatataaatgagggcttcagaaggacaccaataaggtaaagaaacccccttctgcagaaacaataagagaaatacttattgatcagaactaggggtacttcagggaaacatgggggatttttcctctcctttcagtcagttgattgggagaggtttatcttaaaaattaacaacagaatagtccaagccctaatagatactgcatctgtgcttaaccttgactccttttaaaatccaaccacccagagtgaccaagctattcaaatggctgagtcactaaccaatctaagactatcttcaagtctgaactagtttcttaccaactagggcctcttactggcattgcagcttttcacttctccattttgccacaatacacctaataggaagggactttcttgaaaaacaccaagcttgtttttcttttacattgttttaaaagtttccttgcctgaggcttcagcctctgacctcagccatgtattccccttattagtctccagtcatccagttgatcctggacatccaactctaaagtaactgtttgaaaccctttgggaataaatcaatacgaatgtcagcccgatccagtcagcaccacccatttctacacaaatagatcctaacaaacctctactgaacataaaataatatcccctccaccatgaggctttagctggtatacaacctattgtcagtaatttcattttcaagggacttattagtccatttataccagtccctgtaacataccccttctacctgtttctaagctaatagaaagggatggagacttgcccaggatcttagagctattcataacattttattcccttgcatcctgttgtgcctgttccacataccctcttatccaatatacattctaacatccaatatttttccgctgttgatcactatagtacttttttcaccaacccggttgacctcaagagtccatttctttttgccttcacatggaagggccatcagttcacctgaacagtgcaccctgaaggatgcactgaaagccctatctacttttcccagatcttgcaggctgacttaaaagacataaccttctcgatacgaacagacatttctcaaaagaagacatttatgcggccaccaaacatatgaaaaaaagctcatcatcactggtcattagagaaatgcaaatcaaaaccacattaagataccatctcacaccagttagaatggtgatcattagaaagtcaggaaacaacagatgctggagaggatgtggagaaataggaatgcttttacactgttggtgggagtgtaaattagttcaaccattgtggaagacagtgtggcgattcctcaaggatctagaactagaaataccatttgacccagagatcccattactaggtatatacccaaaggattataaattattctactataaagccacatgcatatgtatgtttattgcagcattgttcacaatagcaaagacttggaaccaacccaaatgcccaccagtagatagactggatagactggataaagaaaatgtggcatatataccccatggaatactaaacagccataaaaaaaggaggagttcatgtcctttgcagggaaatggatgaagctggaaaccatcattctcagcaaactaacacaggaacagaaaaccaaacactgcatgttctcactcataagtgggagttgaacaatgagaacacatggacacagggaggggaatattacacaccagggcctgttggggagatgggggactagggtagggatagcattaggagaaatacctaatgtagatgatgggttgatgggtgcagcaaaccaccatggcatatgtatacctatgtaacaaacctgcatgttctgtaaatgtatcccagaacttaaagtataatttttttaaaaaagacataaccttctcacatagctcaactctactgcaatacattggtgatttgcttttatgttctcccttatgaaatacctgtctcactgacactctccatttacttcaccagctatgtcttaagggccataaagattctaaagataaactacagtgttgctgacaattaaacctcttggacatctgctgaccccttgggactcaacatcaaccctttctgccttcaaggcatatttttcttccccattcccactatgaaaagacaaaacttagggcctttctaggactcatggactattgcagagcttagaacactaatttttctttactagcacaacctttatataccctgattaaggcctcttctcctgacctccttacctggactaccgatggtgaacaggactttaagtctctgaaagataagctgtcctttgcccaatacacccctcaatttgggacactatttatgacctccctttttcccctttttgttcatgagcaagagggagtttgaactgaaccacatgggggtaataatttacccaattggttactagattgccaaactggattgtgtctatccggggataccaccatgtttaaaggcagttgccacaatcactgtccttataaaagccaccgagaaaatagtaatgggatttcctctcactgtttatgctcctcactcagttaaagcccttctcacttctcgccaaatccagtatctttcagccagtcgattgactgcctatgaaatacttctctttcccaacctattttccattgtaatctccttaactctgcccctcttttgtcttcaccagaagattctctatgactgcattacctttacactcttctttcaccccatatgaatttaaaggaaatgcccttacccaatcctgattttgtctggtagattgatgggccttctttcagagaccctactggcttctattaagctaggtttgcagttgtttccctgacagaaactattgaatcaggccttctgcccaacaggcagaattccatgctcttacccgagtttgcctgttggccaaagataaaactgcaaacatttacacagatagcagatacgctttttgggttgctcatgactttggaattctccggaaacagaggatttctaacctcttctggactgctcatcagaaacagagaccacattttgtcatttcttgatgccattcaagttcctaggactctggccatgattaaaattcaaggcaattcctttagacataccgaaaatagcaaagacaaacatctagctgagagtgcagctaagtctgcagccttaaacaataccccccttctgttatgcctgtcttaatccaggctccatccttacatcctgtttcttctaaaaatctcttgaaacaacatctcaaaaaaggtgctcagaacttgaaaaggaaaattagacaaaacaaggctgtacctataatcccagatcccaactatgggctaaacctaacagacattcagtccttctagaaaatttaccaagggtcacttttacttttatatataaccccaccattagagttctgaccaaaggatccaatggtgtaaacagtgctgttggggattgcttcttaagctaatatattaggcaaaattcacccttatacaatgcagggaagtccttaagggctaccctaggcaaagtcccaatgcgaaaagggcctttctaaaactggactactgattttatccaattttccctttctcagtgatacaaatatgttcttgtcatgatagatatgtagttttactgggggaaagctttcccctgaagacaagccacagtgatgccagtagccaaagtacttcatgagaaaattatctctacctatggagtttccaccaagttccacagtgatcagggaactcattttactggacaagtattaaaatgagttgctaatgtttggcctattctaagacatttcagcggtgtttaccacaccgaatcttttgggcttgtggaatgaaccaagagaatattcaactcaattggctaaaattacaagcagcttcaatctgccctggcccaaagctcttcctctgggtttggtaattgtgaagtccatccccaccagaattgcttttccccttttgaggtggtcacaggtcaatccatatatttaaccgaagaaatattttcccctgcttagatacaaggcgatctcctgacctactgccaagtcctggaggacttgttaatgctctaaagactaacagctggttgtgaatccctttacagtcatcaatcaggagatgaaccccaatatcataatgtccagcctaaagactttatatattagaagagatattgctgaatgactccctccaatcccactagaaaggtccatttcaagtacgcttaattaacccatttgctgctaaggtacaggtcattactcctaggtacacatatcttacctaaaaacaacaccagactctgctgagaactggacttcagcatcaatatctgacactaagctcaggttgactaaagcctcaatgccaagacaagaaaaggatgacaactgaggtagactgccctctcacaaaactccaagcctatatggtctggatgaatcaatgtttatatttaccttataatagtcattgttcatatcacttcaggagttttcacgattgttactatccaatgtaaaatagaacacttatctttgccttacttattctaaactaacatgccgagcctttatgattcctttataactgtttccattattataacattagcaatcttgtctatcctggatatcttatgccatccatgctgggatagttctgtgtattccaatacttagacacccataagcctttgcaaaactataagactttttgtctggctaaactctttgttccagagctttgtgaatggttgtgttgattagtccagttcaaaataaattttactctattctttataactgtccctttgtctcactgcatagagtgacatgataacactttggctaagctgtcctgaagtgttgttacaaatagaaacctatcagatggttagattcaccaataacttcccacattcattcatggtaaacatgtgacattgacaatacttgtcactgacttctcatgtatccttaacatcaccacttatctggatcaactgctttccctgttgtctctgagtccaattgcctcaagactcaaatattaccacctcttggtttaatttgtcccatgttattgatgttagaaacccattctataccagtggacctcctcgatctttaaactaatggatagataaatatagtctaaactgagtaaagaaaggtatgtccctactattcaaatgattcatgattcaattcaatactgtcaacatgaataaattcattagtgaacacacccttaagggcatcgcttgtgccttcaccaggctttgtgtttatatgggacatagggtctgatctgcctggatagggatggtcacaccattgcctcaacagcttacacataaaaggttcaggcttgcttatgaaaagacccccgttctgtctttattataaaactaaaaggtctatgctaacaggatgtaaagataatataggtaaaaacatcctagaactattacttctaagtgcttgggtttatgttactggagatataattcaaaaacctatccactaccattggttagatagctgatgacactgcagaaagccttacagcgcaacaaaaagtttctggactcccttggtcaagtaatactaaataatagaattgccttaaattgtctcctagccaaacagagaagagtctatgcagtagcccatgtaactgcttacacttacatcaacacctcagataaggtagaggttcccataaaaagaatttccaaacaagctaaatcgttatgagatatgcaaactactgatcctctccatctatttagtaggcttcctgtcagactggaaaattctttttgagctgacattcaagtgcttgttgtaatcacagtcttcatcatagtttcttcctaatagttaaattacttgatatatatatatgtctgtgtgtgtgtgtatatatatatatatatatgtctgtgtgtgtatatatatatatatatgtctgtgtgtgtatatatatatatatatatgtctgtgtgtatatatatatatgcaactgctgtaagtctactgttaaaaccagaattatggcagcataaggtgttcaactgatagataaagtaaacctataaacctagctacagtctcatccctacagtgccgttctggtgcaggaatgtgtatatgtacgaagacagctgtgctagttaaaaacaagtgttacaatctcccataaatagagagttttaactgtaaccctaatgcctatgacttccctgtgtaactggagtctgttaagtatttcactgaaaggtaccagccacaagcttgtttacttagcctctgtaaaacattttaataatcttcctgccagattgcagttttctcccacctccaacaaaatatttttgacctgtctacccttttcccctgcctggcctaagttatacaattagctgtaagtctctctgccacatgggtcccttcaagggacttgatacactcaggacaggtagccatgccaccctggcactaatatgggacatggtgtaaattggtcatcaaggctgcctacagcaggtttcaactaacagggaaaacaatgaatatatattccaacagacaggcaaaatggactccctgtggctaaaatgagatttagcaaaaaacagaatctcatcactagcaggatggagtatcagtcacatatcccagtgttattaattgccataagttttctctccagtaactaagcagaaataaatccctgaaaagcatttctgaaacaactacagctggaaaatttcccaactgaccctgacaggctgctaatgctagtcaacacccccaacgcccccgacgcctgtgccttgcagtcctgccataactccaactggacagaggactggtcctttattgataaacagccacaaatctcaagccagttttaagcagtttacagagactatgcacagattatctttgtgtccgattggttctttttgatataaaaagccaaattctgccttattttaatgctaaaaccctaccctaaagtgaacactgaatgcatgttacatatattttcacccactgtgcaggcacttgactgcttaatatgcaggtaatttcccccaaccctgcttaatatgcaggtaaggctgactctgtaagatatgtgtcaattcccccttccttctgcagaacaagcacttttgattttcccagaaagggcatttcccaagctgtggatttcttctccctctaaagtaaagtatcctttctttcctctgtggacctcacagtcttttgttcatagatcatagatgagactttagcccacacatcagtggataggagatgttttaagatggcataaggtatacaagaaacaaactgccaaactacctagggatgagcccagctatttggtttggttttgtgtgatgagcaaggagaaagggtaaagtggttgctacagacactggttatctgatcatgtggccatgaaacaagagcagctatggcaggtggataatgaacaccttagaccctggggagtcaagagtagaaggagaaaaaattaaactctcagctctcatctgtgggacatttgggctggccctatcaactcacaatgctttggtgatcatcttgttccaggctatcacaactgctcttaacctaagtactgggtgcccctcttaaggaaacttttcttaagaaaaccttaacctgagacctttctctcttttttttaaaggatcttattttttatttctatagatttagggggtacaagtgcagttttggtcacgtctgggcttttagtgtacccatcacccaaatagagtacttgtacccaaaaggtgttttcttgtcccttacgctcctcccaccctcccacctttctaagtctccagtgcctactgttccactctccatgtccctctgtacatgatttgttgatgttacaggtaggcagccactacccaagataaagttctgcacactaatatagtttcctttagccacatcttgttatatatggatgtctccattactgtcaaggaaaagaaagactcttatgtattttgctcaagcctatagccacccctctgaattatatggcttgctggacctgtcaactcagtaatcctcctggcaaaaaccagtagctattactatgaacacttcagaaatagatttcctcccacaggaaataataacttgctcccactacaaaatgatgctgaggaaaaagaatcagacataaataaatggaggtgtatacctcaaatatatctaaagattcgatgcaatatctttcaggagatgagtctactttatttttggtaccaattgaaaaaaagtcagaaatttacaataaaattcaaagggcccaaaatacccaagataactatgaaccagaaaaacagtgtgaggaatatacaatacaatatctcagaagttaataagaaatgtgtatttatcctgtgtccaagtgttctcattgttcaattcccacctatgagtgagaacatgcggtgtttggttttctgtccttgcgatagtttgcttagaataatggtgaacatcacacaccagggcctgttgtggggttggcggagaggggagggatagcattaggagatatacctaatgtaaatgacgagttaatggatgcagcacaccaacatggcacatgtatacatatgtaacaaacctgcacgttgtgcacatgtaccctagaacttaaagtataataaaaaaaagaaatgtgtatttattaagatagtgtactattggtacaagaggagcaaaagcagaaacatgcacaaatgttcacttgattgatgatcaaggttatgattcagtgtaataaagaaaggacagtcttcaaataaattgtgaatgtttaattttatatctttatgtgtatatgtgtgtgtatacacacacacacataaactacaaactgattgcagatctaaatgaaaatgataaaaagtatgccaaatatcttgagaaaaacagagcaacacacattaagtcctatgtgttatctgtaagtatttgctgcatggcaaatacttagaggcttaaaacgatgggtcatttattattttatgttttctttgggtcaggaatgaaggtgtggcttagatggccaattatggcttaagatctcccacacagtattgttaagatgaagctctcctggttctgagtgctgtttaattcatgaatcatactgcacttcaataaacagctatatttctctaaagtttttcttttcacaaatggaagatatctttaaaaaaagaaccaaatggaaatttcaaagatgtcaaatattgcaatgaaaaattcactggatctcttaataaaaggaaatattagtggtcttgaaatacaatagtcaaatatatccatatgaaagcatggagtgaaaactgaaggaaaaaaaaagagcttccatgaaagaaagcaaaacttttaccactcaaacaaaaacatattatgaagctgaaataatgcagttttcaatggaaacacgttaatgtttcaagtagtgaaattgtttacataaaaattatattgaagaaaatgtaagaatatgaaagacatttaacatatattaatcagcataagaatatataaataaatagaaaggaaaagggtggggcatggtgactcacgtttgtaatcccagcaccttgagaggctgaggcaggtggataacctgaggtccgaagtttgagactagcctggccaacatggtgaaatcctgtctctattaaaaatacaaaaattagctgggtgtggtggcaggtacctgtaatcccagctactccagaggctgaggtaggagaatcgcttgaacccgggagaaggaggttgtagtgagctgagatcacgccactgcactcaagcctgggtgacaagagtgaaactccaactccaaaaaaaaaaaaaaaggaaaaaatacttaatagatgaaaatacaaatcaaataaacctttcaaaggaaagaacagccatttcacagcaaagaaaacttatagggttagtcaaactatgaagatacaatcaattttactagcaattaaggcaagtctaattgaaaccacaaagagataatattttatacaaatacactggcaaaaatgacggagtctggcaataccatgtgctaaatcgggtataaaataaacaacctgttatacagtaaacagtcattggatgtgttaattagcacatttatttttgaaataaatttcccattgctaaggcatgatccacccacttgataacccagaaattctacatctaagtatgtagccagaagactcttatgtacatcaagagttaagtacaagacataataaaactcttcagaatgggaggggggaaaaacctacaaacactccaactgctcataaatagaaaaaaatcagtaattgtatatttccatacataatggattattacacaaaaagtgaataaatgagctacgtcacacaaaattacatggatatttttagtaacgtaggggatgaagaaaacagtcccagaagattgtgcgatattttttaaatggtctaaaattcaaagctgataaaaactatggtcaaattataaaatgatactgttaaattaaaaatatggatagaatttgctttttggacagagaaaagggtgaaaaattaggaataattgggccatggatgtatcattattgcatcatgtatattatcataaatgacaatgaaccaaagactataattagtctaattctttggaagcaagttaacataaatgaagttgctacagatgcaaggactaaaattaggaggtaagaaaataaatgaaaacacacatttaataacttagccaaccaatgtagccactttggtggaatttaagggatgattagatgataatgatattattgatgctactgatgtgtatggtactaaaagtgatattgctactaatgtttctaaaatgataaaaatctgttttttaaattgatgtcacacttacccagggtttagactctaaacgtttcaaatttaggatgagtcagttattgcatgccccatatctccctatcttatatttgacaaaatagtaaatatattttttcaaatttcccccttatacatatcatatctatatctatagatgccataaaaaaaaaacacaaaacataatgaaagaacaaatctctggataacctgtaagctttgccactaacctctttatagccacaatcacactgctctgtaggttccaaaattccattgccacaagttgaagattttcggtaagtcatttttgaaactgttttatcctgaaaacatttaagttcaggctgcagaactatccgtttaaatccatccatgctgcaactgctaaaaaacttcataccatgggatcatctaaaattaaattgtacttcttagataaatggactaaaagaatcaaagtaatactcctcaacaaaatgctatgaattctgaactacttcacttagagaagagccaaaaggagaagagaatgcttttatttttaatacaggtgataagcaaaaaatgaattatttgctattgtaatttgatatgatagacactgagagagtaaagaaagttaaaatggtaacacactcaataatatttggtacacaataagctccatttgagtatatcctattattgtcaacattaagaaataaaatttggttgattgtgttaatgaaaaatcataattacttgttctttgttaaaattaatcaaaaaagttatcccaatactgaggtatataaattgtacaaattctagattccttttattttgttttattttttgtatttctatacatttaagtatactacttaatgtgtaattttgggtaattttgtaataatctcaaacttaaataatgcaaatatggcccaaaaaaataaattttgttttctgaaacagttaagaggccggcaatgtgttctgtgaacactacatacatctatgtagttcttacatagaaatgggttattctacatcagcaccctagacccttcaaaatcataaaataatgacttattattaatatctaatgctcggactccattcggattttcccaaacatcacaatcctagcattttatagcaaaataatccagttcagaatcaagcattgcaaaattctcatgtctccttagttctcatgtctccttagtttagttgcttttcaaacttcttactacctaagtactatttcacttcatgacactgaacagtttttcaaccaatgcaactagactgctgtaaggtaatcattagcatccacttttcctctaaataatatcactgaatgtagaactattaagcacatttcctacaacattctatactttctttaatgtcttaagcacatttgtatctaaaacaatttcttaaattatattgcaagaggttctacatcaaggaatactagaaatatttcttaagagaaaacatagagctgataaaaacaactccttacatcgcatcaggattcattatgcatgtagttcctggacagtaacaattgtagatatcatcatatgtcaatcccagattaattccaagcaactgtgccataacaactgaaaaggcctctgcagtgattttctttggatactaaatagaaacaaacaaacaaaaacccagatttattgcctaagatattttttcactcctttgatcttgtcaaacgtttctagccatactatataaatacaaatgcaaattttaaaaactgctatttatttacttagaaataaattatttctaactacttagaaataaaaataggtacaattttttattccttttgagtgacaatatttttaatcaaaatgacattgacctaaaataagaataattcaatcatatatttttatgacatactattgaatttaattccagcaaatttcagaaaacgttctgagaagtaggaggattattttagtaactacaatatttctcaagagaacacttggaaaagatacacagattttggagagttgaacaggcaatcagttttgacctcagaaataatttgagaagagtcaattttttaaagtagaataatataacatcttacaagtagcatttctacaaacttccagaaactttgtcattatctctatatttttcctatttctgaaaatcatatagtgaaaatattaccacatatagtcttctaataagggtttctctcaccacaaatttaagggttttccacatcttattgtggcttaatagcttattatttaaatcactgggtagtattccattgtatggatgttctaaagtttgctcatccattcacctgttaaaggctatctaagttacttccaatctgtggcaattatgaataaagctaaaaacacttatgtgaaattttttggtggataaaagtttttaactcatttaggtaaataaatggatggtttaccataaggaggatgattgctggaccatatggcaagggtaagttgagtattgtaagaaactgtaaaactgttatccacagtggctatatcattcgcatttctgtcaacaataaatgagagttcctgttggtctcacagaatttggtgctttccatgtatgatgttgaccgtgactggtaagctactttcttgtgtttttcctgatctaagtagtaatgtgttatttactcaaaatatgttgtttcctgttttttttttttgtagatgctctctttaagttaaataagttcccctgtatttttagtttgctgagagtgtttattataaatagtctaggatttggtttttctgaatctactactagaatcatataatttttcttttttagcctattaatataatggaggacattattttatattcatgataaaccagccatgcatatctgggataaattacatatatatgtacattattattatatatatgtatgttacatatatatatatacacacacacacaaggagatagaaactaaaaaataatttaaaaaatctgtaactggattgggggggatggagcaagatggcggaatagaaagtgccactgatcatctctcctcctgcccctgactcccaccaacgacaccaatttgagaactattgacacaaaaaaagtgcctttataagaacaaaaaaatcaggtgaacacattacagtacctggtttgtttatttatttacgtttttgagacagagtctcacttttgtcactcagggctggagtgcaatggcacgatcttggctcaccgcaacctctgccttctggatttaagcgattctcctgcctcagcctcctgagtagctgggattacaggcatgcaccactacgctggctaacttttttgtaattttagtagaaatgaggtttcatcatgttggccaggctggtcttgaactcctgacctcaggtgatccacccacctcggcctcccaaagtgctgggattacagacgtgagccaccatgcccagctctggttttaatttcacatagctgaaagaggtactgaagtagaaaaaccactgacaccaaccctcgtcaatcctgtggcaacagtggcatggtgcagagagcatttctttgtgctggggagaggagaacgcagcaattgtgaggcattgaactcagtgctgcacttttatagcagaaaacaaaactgggccaaactcagctgatgcccacctacggagggagtattcaaaccagccctagccagagaggaatcgctgatctcagtggttggaacttgagttcctaccagcctcaccaccatgggctaaagtgctctagggccctaaataaaacttgaaaggcagtctaggccacaagaactgcaattctaggtgaatcctagtgctgaactgggcccagagccagtagactgggggcacatggcctattgagataccagctggtgtgactaagggagtgctggcatcacctcatccctaaccccaggctgcagagctcatagctccaaaagagaccccttccctctgcttgagaaggggaaaggaaagactggggaaggctttgttttgcatgttggatgcccgctcagccacagcaggatagggcaccagtcagagtcctgaggccccctttttaggccttagctcctggatatcatttccagaaggaacccactgccttgaagggatggactcagtcctgaaaaacgtcatcacctgctaactgaagaggccttgagacctgaataaccaacagtgatacccagggagtgtgccatgggccttgagtgagcatgtgagatttgctagctttgggtgagacttcatacactctcagctgtggtggcaacagggcaaggctccttcgcttgagaaaagtggagggaaaagtaaaggggactttgtcttgcacgttaggtagcatctcagccacagggcagcagagcaccaagcaggctctctgggtccctgattccaggacttggctcttgggaagcatttctggacctgacctaggctagaggagagtccaatgccctgaagggtgagtcccaggtcaggcagcattcaccaccagctgactgaagagcccttgggcattaagggaacattagcagtagtctggcagtgctctccacgggcctgtgttggtgatggcaatgaggtgaggctcctcacccagtttgtccaaacatgacaaataatatgctcctgaataaccagtgagtcaatgaagaaattaaaatggatattgaaaaatttctttaaacaaataataatggaaaaatgacataccaaaacctgtgggatatagcaaaagctgtacgaagagggaaatgtataactataagtatgcacaccaaaaaagaagtaaaacttcaagtaaacaacctaatatgtgtcttaacgaaccagaaaagcaagagcaaaccaaacccataattagtagaagaaaagaaatactaaagattagagcagaaacaaatgaaattgaaatgaagaaaataatacaaaagatcaaagaaacaaaacgttggtcttttgaaaagttaaactaaattgacagacctttagccagactaagaaaaaaaaaaagagagatccaaataaataaaatcagagatgaaaaaggagacattaccactgatactacagaaattcaaatgatcattggtggctactgtgagcaactatatgccaataaaatgaaaatctagaagaaagggacaaattcctagaaacatacaacctaccaagattgaaccatgaagaaatccaaatcctgaacagaccagtagcaagtaacaggtcgaagctataattaaaatgtcttcctggagcgaaaaggccaggacttgatcgctgcactgctgaattctaccaaatatttaagaagaactaataccaatcttaaacaattctgaaaaacagagtagaaaggaatattaccaaactcattctatgaggctagtactaccttgataccaaaaccaaacaaagacacatcaaaaaaagaaaactacaggccaatatctctgatgaatattgacacaaaatttctcaacaaaatactagcaaaccagattcaacagtacattaaaaagatcattcttcatggccaagtgtggtttatccctgggatgcaaggatggttcaacacatgcaaatcaatcaatgtgatacatcatatcaatggaaatcaaggacaaaaaccatgtgattatttcaattgatgttgaaaaagcctttgatcaacttcaacatctctttgtgctaaaaatactcaaaagctggtatagaagatgcaggtctcaaaatgataaaagccatatatgacagacgcacagttagtatcatactcactgaggaaaaactgaaagcctttcctctatgatctggaatatgaaaaggacacccagtttctccacagttactcaacatagtactggaagtcctagctagagcaatcagacaagaaataaagggcatccaaattgaaaaatgaaaagtcaaattatccatgtttgaagatgatataatcttatatttgaaaaaacctaaagattccatgaaaaaactattagaattgataaacaaattcagtaaatttgtaggatacaaaatctacaaacaaaaatcagtagcatttctatgtaccaacagaaaatctggaaaagaaaattttaaatgtaatagcatttccaatagccaccaataaaattaaatacctagaaattaaccaaaaaagtgaaagatctcagtaatggaaactataaagtataaaacattgatgtaagaaattgaagaggaaacaaaaaaatgaaaaagtattccatgtttatggattggaagaatcaatattgctaaaatgcccatactgcccaaaacaatctacaaactcaatgcaaacccgatcaaaatccaatgacatgattcacagaaatagaaaaaaaaaatctgacaatatatatggaaccacaaaagtcccagaagagccaaaggcaaaataacaaaattgggggaattacattacctgactacaaattatgctacatagctacagtaaccaaaatagcatggtactggcataaaagcagatatttagaccaatggaacagaatagagaacccagaaacaaatccacacagctacagtaaactcatttttgacaaagtttccaagaacatacactgtggagaagacagtctcttcagtaaatggtgctgggaaaactggatatccataggcagaaaaatcaaactggactcctatctctcaccatatacaaaattcaaataaaaatgaattaaagtcttaaatctaaaacctcaaactatttaactactaaaaaagttagagaaattagagaaatacataaaaggatgagtccgtccatggattaaactattaacgggctatcataagaatgagactggtggctttataagaagaggaagagtgacctgagctggcatgctcagctcccttgccatgtgatgccctgtgtcaccttgcagcatcctcatcagccacaagcgctcaccagatgtggcccctttaccttagactttgcaacctccacaactgtaaggaataaatttctgtaaaattacacagtttaaggtattctgtaataggcaacagaaaatcgattaagacagtatttatccaaaagtaataaaatcagaatatcaaggagatgtatgcacttccatgttcattgcagcactatatacagtagccaagatatggaaataacctagacatcctttgtcaggtgacagggtaaagaaaatgtggtatatacttacaattaagtacatttcagccatcaaaacaatggaaattctgtcacatgctacaacatagattaacattgaagagattatgttcagtgaaattaaccaatcacagaaagaaaatactgtatgactacacttatatgaggaatctgaagttgtcgaattgatggaaacagaaagttaaatggtggtttccaggtggttaatgggtatagagtttcagttttttaagaaaaaatgttccagagatttgtttcacaacaatgggaatatacttaacactactaaagtgtacacttgaaaatggctagagttatacattttatgttacctgttttcactcccagtaagaaacctcttgtaaaattacatttgatttccaaaatctaaaaatacaattttcaaagatttatcaaaacagtgtgagagattaccagagcaattcctgttgcaaactttggatcgcatgccattccgtgatatgttgctcccacataagtagaatggttcctataactgaataatgaaatttttcttgtggatatgtgtatttaaaaatagcaataacttactcatattttatgagttggatttctatataaaggtatgctttctccaaaacacagaaattacatataatgtcttatgctttcagtcattaagatttgggtatcccctatagttcatataaagttaagtcctaaaagttgtttaacattatctaatacacagctcaaaacctagcagtgcatgattctttcaaaaaattaatcatcactggaaggatataattaattccatgatataaaagtcaaaagtgtttattgctgtaatttgtatgtagtaaaccaaccccaaaagtgtgaagaaaggtaggactgaaagagatagagaaagataaaatatgcatcagatttacgaagagaaagagaggtagggtgtagaaaccatccttacatatttatatcttaatattgctctgtaatcctagacactctttattccaatacattgataaatatgttccacatattgcttaaggtctttaaaattgtgtttttgatttttgcacatgaaataatcaagttggtaaaataaaagtatataaagacttttgaaagatacaaaacaagtaggtaaatagctacatcttaggtcagtacagaaataccagaaggaaaccacatggagaataaagtggtctattttagttatttattaatatttcatactgtaacaagcattttatgcaattattgcattcaataaattaacttatatttatgtaatgttaaagtgatggtttcaattatttactagtgagaaggtctttacaaacagagaggtatcatgtttttatcacaagactttccatttttcagctcgttacatttctataagtaaacagtctactatgggctaccatgatttaattagtgtcttacatggttattagaatcttaatattttgcagtttgccaacacagtcttcagatagctttttaataattattgttatataaaatttatatataattatgatagctaagataatttgataaaacctttctaaatatgaataaagtacttacattaataagtatgtcatatcatgagacctttgaaacaaaaatttttgtttccaaggcaaaaatcgctgtagtatttcatcagcatgaccacttgttgaaatcttattttgatctgaccagatctccaaggaagacagcataactgtcatattaagctgggaaaacatctgagaacagaaattacgtgttttacaattttgggtaaccataaatatgacactacttctcaatatctaatgataatatatttaatttactatttttgaagataaagtcgttggtggataaaattagtggttgggctacatttacatttttactttttgttaaaatgtaaatgctatatatatgtacataagcacaaataattttacgtcattaattgctatattgcttactaaaatataaaatataaatactcacagtgttgataagaccaaagatttggaaaactttctcaactgcaactgccaccgtggagcccatataagcatactgaaagacaaattttgtttcttaatcgctagtaaaaacaactaactaccacattttaagtggatttaaatataaatgtaaaaataattcagtggtcaattgaagaggcactaaatagaattaagatatatcacagtttaccaagttttacacatcggcctagtattttataaattaatcaatgatattaaaatgaggtaattgtgattatcttcctctttacagataaagaaattcaaagtcaaagtgttaaggtatgaagagtgaataacctactggttagcccggtgtggtggcaggtgcctgtaatccaagtagctagctttaaaaaaaaattaattaattaattaatttaaaattttaatttgcatatagttgttttttattgtctttgtcatttagttactgtttaatctgttgatattttgtgattatatatcaattgtttatcaaaatatcaattttgtgactatatatcaattacatatcagtatatcagttttgtgtttatatatcaataatcacaagatgtcaacagaccaaacactagatggcaaagacaatgaaaaaaacaactatatgcaaattaaaaatgtaaaggacccataaaatataagtacatagaaatattaataatcaaaggatgaaaacacatcatctagcatcaggaaaatactagaaaagaaaaaatatgttatgtgataattatattaactaacataatacattgataagaataaaacttaaaggcaaaaaatggacatgcttatcacaacatattaataaaataattcatcagagagatggagacttttaaatttgcttataactaaaaacatggctgcaaaatatataaaacaagatttaacacaattaaaaatagaaattgactatcatactgagatattttaaataggtctcttaataacacataaattaagaagacaaattaataggaaagatactcaagactttaaaaacccaaagcaatgttggataaaatatacatacatagaagcttatatacaacaatgagaatatgtattttttttcaaatacaaatgaaagttttatgcacattgattcatattaaccaatattaggccatagaacacagctttgaataagaaacagagtgtcacttaaatcacattatctgaacacaatgcaactaagttacagtggacttgataaaaatattttaacaatgttatttttagtgaaatggatacctctgttgtggttatatgagataatagtcttattctaggtaaatacacactaaagaatgtaagagaaaagcttcatgatgagcttcacaacttactttcaaatttaaatgaagagtgcacaagtgataatgggatacaatattaataaatgtgagaaaagagaataagggccctctttgtattattttattcttgtaacttttctaaaagtttcaaattatttccaaaagaaatgtttaaaaagtgcagatgaaataaagacaatttcagatgaaaagaaactgaagagaatccagcaggctaaagagaaatatcatacattaagtaacctactacaaggtatgaaaagctctgcaagtgaaaaatgtatgtgtgtgtgtgtgtgtgtgtgtgtgtgtgtgtgtatatatatatattcatatatatgaatatttatgtatattcatatatatgaaatacacatctatgaatatatgaatatatatgaatatttatgaccatatatgaatatatgaatatttatgaacatatatacatatattcatatatatgaatatttatgaacatatatacatatattcatatatatgaatatatgaacatatattcatatattcatatatatgaacatatattcatatatgaatatatatgaatatttatgaatatatattcatatatatgaacatatattcatatatgaatatatatgaatatttatgaatatatattcatatatatgaaacacttcatttccttaatttctttttaaaataattgaatattgaatttttaaaaatctatttttcagtttataacacatggagaggtaaaatctttaaaaacagattcataatgacttaccagggttaaatgaaattttactgctctgaggctcttacattattaatgaagtggtataacattaattctagatcatgataagtaaagaatactaatcagaatccctagggaaaccgctaaggttggagactggaaagagaggcatagcaaaaaaaaaaaaaaaaaaaaaaaatagagggaaaaataaaggttaaatataaccccttgatccaagggtaggaaagaagaaacaaataagcaaataattgatggtatgtaagaacactaatagtaaagtattatttaaccaacatccatagttatcaattcttttgagaaaaaactaaacattctataattcttcctatttttaagatacagaacttctaccggagatggtaagcaactataaaacataaagtaatcttctgagggataatatttaataacaaagatttccaactgagtaataaaacaactcacttaaaaatagaaatacattgaagaatttcaatcaacaattggagtagatctaaaagtatctgcagctagatatgctacaatagattagagtgtagtggaacccttccatatgaagttatacattattgggaaaattgatatcgatttagaaatcaatatataaatattgatcccccatgtcactgtaaaggcaagtgaaaacatttctttatctcctgctagactgagacacacagtctagaaatcaatataaaaatattgatcccccatgtcactgtaaaggcaagtgaaatcatttatctcctgctagactgagacacaatgcagatatattaaaatatatctgcattgaaaacgttgttttttattcatattctctctgaatttcaacaaaagcaaagatataataaacatactgatattgcataccatggctttatccataatgatttgtattttcagagttcttttcgatagcatggcacctgaatttatctgtgaaatagaggacatgaattaaataacacattttcaaaatttttacattgcagttgtcatgtgcaatacacatgcacacacactcacaggtgagatatggaatatccatccatttagctacccatctatctatatgcagatggatgatagatattcagacacagatacacgaatatagatataagtaataacacaagaggatgatgggtacacccttagcaggtaggattccaaatacaaattttacaagaaaatcagaagcattttattttatgttattgatcattagaattggcaaaaagtcactgaaatgaaaaatcccatatttccttccccttttaacattcctatatactctgtagcacaccactacctcaccaatttttttttttttttttttttttttttttttgagacagagtgtcgttctctcgcccagtctggagtgcagtggcgcgatttcggctcactgcaagctccgcctcccgggttcaagccattctcctgcctcagcctcctgagtagctgggactacaggggcccgccaccacgcccagctaattttttgtatttttagtagagaagggatttcaccgtgttagccaggatggtctcgatccctcaccaatcttcaaggtaaactaacatccgtaaacatttcccctaatgttgccttcattttcttattatttttgtacttttacttctttatgttaactttattggggtttacattcaataaaatgtgtccattttaagtataaacttattagcgagtaatgtatacaccatcacaatttataaattggtatttagaacaattggaagaattacatcaaaatattaagagcactatctttaaacaatgaggtttcacacaatttatacaatttctagtgtattatcttgcccccttttcacttttacattttctatcaaaataacacttttaaataaaaaaacgcatgtgcaaaaaaacttataaagcaatttgattaaattggtaataattttattagtaagatgcaaaatcaatataaaaataactatatgtctataaaaatccctgcaattaaggaaacatgttatgatgctttagaattatgtgtgtttataacgattacattttctaaatatctgaataaacaaatatatgttttaaacgtcctacaactgaactttttaatataaatatcagtttaaatttattctccaaatgtgtcaaatttcaaaatttcactgtgaataactttatcaacagtaagaccaatgaagaactcataaatgagaatactcacgtctgatttgacaagaatcctgtaggactgatctatatattgagccacaggataattttcttgaaaggaggaatgaccaatagcatcatttttaattcgataaactacatgcttatatgtaggtgaagattccaatggttcaataccataactgatattatctaactgcagtaatcctctggatattcaaatacaaaaaaggaataaaaatgttactgataaatttgaatacattttatgctagtgagagtttttttctgaatacattttatgcttgcccacctgggatagagaaaaagagaatagaaaaatagatcaacaaaacaggtaaaaaagaaaagtatttaagaaaataaagtttatattcctctatatttattctacccttcaagaagtttctggaaattaaaggctcacataaaatctcaatgtacatatctggaatacgccattacctgagtccagaacaggtgcgtagtgccacaactgattttggaatgtctgcagcatatccttggtaaaagcaatgaccctaaaaaggaatatagaaagatatattcataaatgatttggaaacaaagtcctagcttttatctttacttcctatatattgtcaagcattcatatttaaccattatcataatagtatttatcaggtattgaatctccatatcaatctacaatctctttctctaagttcttttctgctatgttattagctcgtaaacattttcatcagtaacatacactttttctcaaaatgaggcataatctctattcccacttgctgacactggcaggccaaatctacccctagtagcagttatcagagcccaggtggaccaatcaatcctacccaaacacacatttacagcaatgtgcctgttacactcacaccatcaagactaacaaactcaggcagggaaatccatatcctgctccatgtcaagcaacagcagcagtcacctgcacttgcagtggtgccagcaggacctgaatctataagcccctcacaaagaggtagaaggcaatccaggtcccaacctctctccagcagtagagagtaatccagactcaatagcttctggctgtgcacccagcaggagaaaatgatcttcatgagttacttcccatttctccctactataagtagaaaaagatcattcagataggagctatcttcaaccagggtcactggcagagatagaatcaagcacactgaaatctagtagcagagaaaagacaggagaaatgttctccatcctatggatctttccttacccacctcaaccggaaacactacctggcccagggaagtacgatttacacctctagcttaaacgcttaagaggcagcagaaggtccaatgcagccagaacaatgaaacacaacacaataatattgtaaagaaaaaaatgttattggaacagtggactccaataaaacaaagctcaaactgaatgactgtcttctaaaatagaatattaaaataagatcaagagtcttgactaaatgtcaaggatataatcaaaataattcattataacaaggaccaggaatatcccaacaagaatgagaaaagaaaatcaactgatgacatgataagtcataggatatcaaaaaatatttgaaagaagtaataaaaattgcattaatgaataatgacaaattctcttgaaataaatgaaataacagaaaatcttaggaaataaatagaagccaaaaagggaacaaatgaaaatattataactgaaatatataataaacaaacaagtgaaacactgaataagctctatagtctggagtacagatgacagtggataggatcaccaggtttaaggagaatggatcacatatacccaacctgcaaaatagaggacaagtggctgaaaaatatatgatgtttcaaaaacttgtaaaacaatagcagaagacctataatttatactttaaaaagaaaaaaatggggtttaaataatatttaaaatattagtactgaaattttggtcagccagattgtgaaacaggaatcccgggacgcttcttctcccacaagcataccaattcagcaacattatatggaaaaattacctttgtgagtaatcagaaactaatatagagacatatacgctgggaggatgcaaaactagactcactaaagctcgtagagagacttggatcactctcttgccaggaaacccaaagatatctacacctagacctattttaatcaaacattaaaagatcaaaaacaaagagaattttgtaaactacaaaagaatagcaacttgtcgcatacaaaggaaactccataggactatgagcagactttttttttttttttaaggagaaaccttgctggccacaagagagtgggatgaaatatttttttaaagtgctgaaagaaaaaaaaaagccaaaaagaatgctatacaaatcattatggatttcttataaaatctataagaaactcacttgagacttaagcacacatataggatgaaggtaaagagatggaaaaataaattccatgcaaatggtaagcaaaaggggcagagatttgtatacttatatcaaagaaaatagattttgacacataaatcatcataagagaaaaaatgacattttataataataaaagggtcaatatctgaagaagatagattacttataaatatgtgcacactcaatattagaacatataaataaataaatctgaaggaagaaatagacaccaatactataataataggagactttaataccttattttaaataatgaatagaacatccaaagagaagattaataagaaaacagaagatttgaatattactataaaccaaatagttctaacaaacatataaaggatttcattgaacagcggaagaatatactttcttctaaagtacacttggatcttttccagacagatcacatattaggttaaaaaacaaatctaaaaattttaaaaagattgaaatcataacaagcgtcttttctgaacgcaatagaatgaagctaaaaataaatagtataaggcaaactaaaatattaacaaatattgaaattaacacactattgaataactattggctgaaagaattggctgaagaaattagaaactattggctgaagaaattagaaaataccttgaaataagtgaaagcataaaaataaaagtaaacaaaaaatattaaaacaaacggatgcaggaaaagcaatactacgagaaaagttcgtagcaatgtatgcctacattaaaaaaaaggcatatctcacatatgtttacctgaagaaactagaaaaacaacgataaaactaagtcccaaattagcagagaaaatttaaaaaacaaagattagaacagaaataaaccaaataaaaatagaaaaaccaatatagaaacaaagaagttcattttttgaaacaaaattgacaaacttagctatgctaagaaaatagaaaggatgcgaataaataaaatcagaaataaaacagagacattacaactaatgccacagaaacagaaaaagatcatgtaagagactagtatgaacaattttctgtcagcaaactggataatccaaaagaaattgataaatttctagaaacatacaaacagccaagattgaatcataacgaagtagaaaatttaaaaggactcacaactagaatgaatattagatcagtaatcaaaacctaccaacaaagaaaagagcaggatcagagaactttactgttgaactctatcaaatatttaaagaataattaatgccagaacaaccattcttaaactcttgcaaaaaactgaaagaggaaacacttccaaacttattctatgaggccagacaccacagccacataaatcattacaggaaaagaaaacgacaagccaatatcactgatgcacatagatggaaaaaaatctcaaaaacatctgaactcaacagcgtattaaaagtgtcctacactatgacaaggtgggatttatctccggaatataacagtggttcaacataagaaaatcaattaatgtggtacaccatattatataataaataatacaacttacaggatgaaattaatagatgcagaaaaagcaaatctcagcttcctttataggaccttatacatacattattatgagcctaatacaaaaatcaaacaaagccagtacaaaacaaaacttgcagatcagtatctctcatgaatactgaggagagaaacctcaagataataagtcatgtgtaaaaggaattataattatacatgtcaggacttggttgtaattttttaggtatgcaaaactatttcaagatttaaaaataaatcaattcgatccaacatgccaaaaggccaaaaaagaaaagaaaaacttgtaatcctatcaactgatgcagaaaaagcattttctgtaactaaatagccattaatgaacaaaaagaacaacataaacttttagcaggctagaaatagagaattttctcaacttaatacagagactataaaaaaacctaaagccaaaattattttttcacaatgaaagactgaatatgttttccatgaaattgggaataatcgaagaatgccctcactacggttattcaacatggtcctggacattttagcaaattacagtgaggcaaagcaaagaaatgaaaagcagacttacatactggttgaaaatgaagaaggaaaattgtctatatttgttaaagacgtgtctatgtaggaagtctcaaggcatctattaaaaagcccttctagaactaatatgtgaatttagcaagattgtagaatagtagatgaaacctgaaaaatggattgcatcactagaaaagaacaatatacaggtggaaactaaaattaaaacacaatatcatttacaattgttccaataaaatgaaatacttaggtataaacctaaaaaatgtataggatctgaaagctgaaataacaaaaacactagtgaaagatatacgtaaaagaccaaataaatagagagacttactgtgtttgtggattggaaaagttaacatagtaaagacatcagttctccccaaattgatctacagatttaacacaatttctatcacaatcctagcaagttttttttttttatttgcacatggagtagctttatctaaatcttacatgaaaaagcaaaatatctagaacagaatagcttaaaaagtttaaaaaagaataataaagtgggaaaaaccactgtagttaacaatccagaaatatatccacactagatccatggatttttttttgacaaagtagttaaaagagcgattcaaagcagaaatatagccttttaaaaatatagtgttgtaactaatatacatctagtcaaaagactgaactttgatccaaattccacaccttatacaaaattacctcaaaatagataaagaattaaatgtaaagtataaacttaaaaaaaacccagaaagtcttcagaaactactgctatgtagcgtccgtaggtttgacatgaaaacaaccaatcacaacaagaaattgttgataaattagtcttcatcaaaaataaaactttttgaccagtggcagaccatttgaaaagtaagacaaatcggccgggcttggtggcttacgcctgtaatcccagcactttgggaggctgaggtgggtggaacatgaggtcaggagatcgagaccatcctggctaacacggtgaaaccccatctctactaaaaatacaaaaaattagctgggcgtggtggcgggcgcctgtagtcccaagctactcaggaggctgaggcaggagaatggcggaatggcgtgaacctgggaggtggagcttgcagtgagccgagatcgccccgctgccctccagcctgggcgacagagcaagactccgtatcaaaaaaaaaaaaaaaaagaaaagtaagacaaatcacagacagggccaaaatatttgcaatgcacatgtttgacaaaggtcatattcaaaatatagaaaacttaaaaatcaacagtaatcagcaaccttaaactccaaactctcagatttctgcttggttccacgtctggatgctatggtccagactatctacagtagggggcaaacttaaacatgaaattcacctcctgtgcttacattctctcaggtacaaaattcctaatgggcctattgtcacatatctcaaaacgggtgcctcacgtatttttctttttctgacttctaattgtaatttggtagggagggaaaatcctttaccagttaccataccgtagatttcatcatctctcagttccaatatagcaatagagtgtgaccagtcattgcctttcacttcctcccagtcacgtgaataaatgtcttacagagtaataaataccttacagggtgtaataaatatcttacagggtaaagtgaattttctcacataatttcaaacctttcttgactctttaatgtctttcagcctgtaatcccagcactttaggaggctaaggcaggcagattacttgaacccaggagctcgagaccagcctagggaacatggtgaaacccccactccactaaaaatacaaaaattatctgggtgtggtgttggtacctacagtcccagctacttgggaggctgaggtgggaggatcacccgagtctgggaggcagaggctgcagtgagccaagattgcactggggtgacagaatgagccctcatctcaaaaaaaaaaaaaaaaaaaaaaaaaaaaaaaaaaaaaaagaaaagaaaagaaaaagaaaaagaaaaagcttttctgatataactcaaattctgcggtttcacatgtggacctattaaggtttggtacactgtctactttctcgcattctcactctcaccagttccctggagtctttctgtacggtaatgtctacgattttctccactgcccaggccctctcatatatcaattgaaacttctcagtgtgtcttagctccttcagacaccttttttcccctaaaactcctactaatactttcagacatacaaagtttaaatgtcctttttggagaaatgattcctaagttcccaattttcaaaaaagtagttgttctattcaatatgctttcatagtaattgccacattatatttaattttgtaatctgttttctcaataattatgtgggccataaagcattcatttcctcctcaacaatggcaccttaaccacataaaaaatgtaaatttacttggcagaaaccaaaacttacctttgaaaatgaagaatctgcatacaatgttcctgatttgttgtataaatacaccaggaaatgtgggtgtaaaaatgacctaattcaatcaaaataatgacacttcattgtaattatgtcattaattaaaaaataacttccagaataataaaattaaacaaaatttactttcaatacaaacatctaaaaatgaaatggacttatctctatattaacttgctgctttttgatagcatattgtgaatataagaaagaataataaccagtataatcagaaaaatgtgtggatgctttaatgaatttaaaataatcatctagggccaggtgcagtggctcacacctgttatcccagcactttggaaggccaaacctggaggattgctcgagctcagtagttcaagtccagctggggcaacatatggagacccctcatctctactaaaaataaaaataaaaataaattggtgggtcatggtggcatgtgcctgtagttttagctatttgggaagccaaggtgagaggatggcttgagctcaagaaatctaggctgcagtgagttatgattgcaccactgcactccagcctaggtgactgagtaagaccctgtctcaaaaataaaataaaataaaataaaatataaaataaaataaaataaaataaaataaatgaaatgaaatgaaataaaaaaataaaaaaataaaataaaataaataaataaaataaaatcaaataaaataaaatggccgggtgcagtggctcatgcctgtaatcctagcattttaggagaccgaggcaggcagatcacaaggtctagagattgaggccatcctggccaacatggtgaaaccccgactctactaaaaatacaaaaattatctgggagtggtggtgcgtgcctgtaatcccagctacttgggaggctgaggcaggagaatcacttaaacccaggaggtggatgttgcagtaagccaagatcatgccactgcactccagcttggtgacagagcgagactctgtctcaaaaaaaaataaataaataaaaataaataaataaaatcactgacagacacagatttatgtacagtaataagtaggtctgccagatttcaaaaggggttttcttttagattcaactgtaattttatggctcatataccttagttagtatttgttaacaagtaacaatagattttatatatttacattagttttcatggtgttatactttggtaaaaacaaccccaaaattcttagtgtcataaaacagcaatgagtgtccttcgcaagtttactaaagattcggctccatcctgccttccttctggaacctaggaaaaggcatagcccctccctgaaacagtctcaaaatgacaacctgaaattaatcactaaaatgaatcacagagaagatatacaatgttaaataaatctaatattcagtctcttatttaagctcaatttagggtagtgattgtaaaaatttaagacactaaaaataatgaatgaaaaaaatggtaacttactgtttttcaagcaggaagtgtatggtttcccctcaattttgatggaataagtggcctgtagcaaaatattcagagagaaagtaattggtagagattctaacttcttaaatgttgcagttccttgaaacatatattcattcatatgaatgtaggttatatcctgcatgtatcaaaattggaatgtataacagaattaattgtaatttaaataaacacaaggagtctaaatttcaaaactcagatcattaatcattagcatgtattattatgagatttgaagtcaaaatggggattatgtttagaaatgctgagaaacagttgaaaaaacttgaattttgttatctttgttctattttgcagctctcagcacaaataaattgaaaataaaataatgcagcacaggttcccagttaagaataaaataattattgcccagctgccagaggtactacccacaggcaatcctcatctccttacccactttggctattgccttagctcaaaagagtcatcttatacaaagtcacaactttctgggacagcccacatttaattagaagcccctccatttaatggaggtttcttgtttcagatagatttagtatggtcttccaaaaagattaaatgtggtgatatcttcatgataaattgatatttgtatcaataataaaagtccctttcatttccagaatggtttaaggcaattttatttttttcaactttattgagctacgactgaaaaacaagttttattatttatttaaagtgtatataagatgtgtatgatgttttaacatacatatacattgtgaaatgattaaaacaatcaaattactgtatccatcacctcacatagttaccattttatcatttgtggtgagacatttgagatctattcttagcaaatgttaagtaaacaaaacattattattaactatagtgaccatgatgtgcattagatcttctgaatttattaatcttataactcaaagttataactcaaagttataagattatataagaaattaataaattttaaacatatttgaccaatatcttctcttttcattcacacttccaacccctggtgactaccatctaatttctgttactatatgtttgactttttttaagatactacatataagtgagataatgcagtatttgtctttgtgtgtctggcttatttcacttagcataatgtcctccaggtacaaccaggttgttacaaatgatggatggcaggatttccttctttttacaaactgaatactttctgttgtttgtctatttatcgatcaactgatcgatcatctatcaatctacattttctttatccatatacccagagattaatgccatactcttttgattatgatagatatataatttacttttaatatattgtatatatttaaagtatacaacataagtttttgatagtcttatcttgatatagaaatagataagtgatttttgcaatcaagcaaattaaaatatacatcattctaatatagttactttcttttatattttccttgttgttgttttggtggtaagagtacctaaaatctacttattggcaaattaccagtataaaacatcatattgttaactgcagttcttctcttgcacattagatttcttagatgttttcatcctatataactacaactctgtacctttttacctatattttcacatttgcccctgcactctcctcctcacattgagtccctggtaaccattgtttactccaagcttctatatatgaaaatttttgaaattccacatataggtaagatcaggcagaatttttcattctgtgtctagcttatgtcacatagcataatgtcctttaccttatttcatgttatcacaatggtagagtctacttcttttttaagacagaataacattctatttcatatataaatatatacataccacaatttatccattcagctgtatatggacattttggttattttcatatcttgactgttgtgaataatgttccaatgaacatgagagtgcaaatatctttatgaggtagtgatttcattgtaatataattggaaatgaagaagtgtgatggtgcatcagggttttttactcagaattgttttaactattttgagtcttttgtggtttcatgagaattttagtttagttttttttttgtttctgtgaaaaatgccatcggaatgtcaatgggcattgcatcattgcattgaatctggaggctgctttgggtaatatgcacattttaacaatattaattcttccaatccatgagtaagggatatctttccatttgtttctgtctttttcaatttttcttatcaatttacagcttgcagttttcagcgtacaaatctctcactaccatagttaaatttattgctaaatattttattctttttaatggtattataaatttttttaaaaatttattcctcagctagtttactgttagtatgtggaaatacagctgatctgttttatgttggtttttggatactgcaactttactgaattcatatctttgttctaaccttttcttcatgtagaatgtttaggattttctatgtataagatcatgtcatctgataatagacaatttcacttggaggcattttattttatcttcctgaataacccttctggtgcaacttccacctatggtgaagtccaaagataatgttagtcttatctcgcaaagaggcaagtttctctcatctaattgtaggggaagggctatccaagaaaagtaaggtcagaaggacttcctaagctaggggctttacgtcagggcctgcacgggcacttcctctctcttggcaaagactgtggtatctcacaggacacttaaggtgacttaggtcttccctgcttaagaccagtggctgccatccaagtcccatctgtgtttggagaaggcaatactccatttggctgtagttggcagctcaggcctggcttgggattttccaagtgtccccatcccttggcctcttcactggaagcaccacatctcctgtcacttgcacactccgccattgacagcatgcaacgatttagttttcctgtgcttgtttcctgagagcaaggcattggcagttctcagatttctttgaataaatgtggggtgttatgtaagaaatgaagccacagatacacttattttattttatttatttcttttattgagacaaagtctcactctgttgcccaggctggagtgcaagggtgctaccttgcctcactgcaaccccgcctctggggttcaagcgattttcctacctcaatctcccgagtagctgagattacagatgcatgccaccacacccagctatttttttttttaagcagagatggggtttcatcatgttggccaggctggtctcaaactcctgagctcaagtgatctgcccacattggtctcccaaattgctgggattagaggcatggccactgtgcccggcctgatctctttacctttttcaagctgttctccccacaccttccctttcttgcttcagaacatgctcacaaaggccccctaagcagtgggtactggagatagcagagtgagcaaggcacagccctgctaggtgcagtgtgggtggcagacaaggatattggagattacaataacccagtctcctggtggaaatgcacaggggatggaccgtgggaatgcacaaaaatgtggcctagcccagccttgagagggttttgcagggggggcttcgtgggcccctgggtgaggatgtgaattccggcttccactgggcctacactgagtggccccggccaggaggggtcaaaagacctacaggaagaaaccgaggcacaaaatacaattttaaagactgagttgaagtgaggactgctgtcggggacgcacttccaagttgtctttgggagtggtccacttggccttcgttacaagcagatgaagttcaatgtttaacagtagtggtgagactgggcaccagtgtagttttcatgatattagaggaaaagctttcagcttttccatattgagtatgatgttagatgtaggcctgtcatttatggcctgtattattttgaagtaaattctttctgtacccaattagttgagaatttttatcataaaagaatgctggattttgtctaaagcattttctttatctattgagatgattatatgatttttatcctttattctgttaatgtggcatatttgtactcatttgcatatgtttaacaatccttgaatcccaggaataaatcccagttgatcatgacatacagtccttttattgtgctgttgaatttggtagtattctattgaggatatttgcatctttgaccagggatattggctcacgtttttattttggagtatctcaatccaactttgatattagagtaatattgtaatactggcttcatgaaataagtttggaagtgctccttcctcttccattttttggaaaactctgagaataattgttatttactctttctaaaaaaaagtatttggtagaaatcaccagtgaagtcatctggtcctggacttttctttgtaggagatttttgattattgattcagtcttacttgttactgatctcctcagattttctgtttttcattattcactcttcgtagattgtttctaggatgctgtccattttttccaggttatgcagtttgttggcataaaattgttcatagcatgatgcttttacttggtgatgtcaattgttatgtctcctcctttatttctggtattgcatatttgagccctctgcttttcctaatattgttaaaggtttattaattttatttatatttttaaaaatataactcttagttttgttactctattctatggttattctactcttttcttttttaccctttgttttcttagaccaattggttgtttaagaaggtgttgtttaatttccacttatttcggagtttcctatttttccctgtttctatttgatggaatgttttatagaggtcttttaggtccatttggtctaaagtgcagtttaagtctaaatgttccttattcattttctgctgtatacatctatccatggttgaaactggggtattgaagtcctctgttaatattatttctcatttcaattctgtttaaatttgctttatacatttagggggctctgtgctgggtgcatatacactttaaattgttgtatcttcttgattaactggcccctttatgattacattatgacttttttgccttttgctacggtttttgacttaaattctatttttgtctcataaaagcatagaaactcctttcctctttggattttgatttccatgcaatatccttttctatcccttcactttcggcccctgcgtgttcttaaagcagaagtgtgtctctctcaagcagcatatctttggatacttttaacccattcagccactctatgtcttttgaatggagagtttatagtccatttacatttagagtaattattgacatgaagacttactattgccattttgattattgttctctggctgttttatatgttgttttgtgcattcttcctctcttgctgtgttcctctgtgatttgatgttatcctgcagtggtatctcttgattattttctctttaatttttgtttatttactatagatttttgcttcatggtttaccatgaggcttacataaacatatagttatatcaggttattttaagatactagaaatttaacttcaatcacatacaaaaactatgcaatattacttctacacatacacataattttatgttatctatgtcaaatttttcatctttttatattttgtattcattaacaaactatggtagtgatagttattttaacacttttgacttttaacctttatgttagagttataagtgattcatacaccactaatacagtattatagtattttgaaattgacttatatttacctttaccagtgggtattacactttcatatgtgctccttttataatttatcctcctttcattttagcttaaataactccttttagcatttcttattaggcaagcctagtggtaataaacttcctcaggctttgtttgtacaggatattttttatccctcatttctgaatgagaggtttgtcaggtaaaatattggttaattatatatattttagttatattcctatgcacttttcaagtgcatgtcaaatttctgtatgtaatttatttatcttgtccatcatgtattgtgtaatatccattatcacttatttcttcttcaccctgtgaaatatatagaagtacatctacaaatttctaaatgcatttttgagttccttgttaagttttattctaattgattgttaccatataactagttttatactaccagtatttgatttttaattttctttctttactatcatcaattttgttgactgttctatatattcttcagaagaatatacattacttacagtggcatagagctaaattacagctggattggcaaagctctatctttagatctggggatccctacacatctggatatttcagattcttgtccaaaacaaaggcagtgagtgatatttataatgggctttcagaactcaaaacgtccctggccaaggaagcctcctcagtgtttgcctaattattttgacaagccctgcttgactatttaaagagtcactgaaagatttcagctgacttctccaaaagccaaaatttctcctgtagttcttgttggtagactcagtatgctttaggaacacagagattgtgtttctaaacagggagctcacagtgaatgtttcttggattcatgtgtaataaactgtagagtctagtgagtcctaaaacatatcagaactggagaaaacaatatattcactcactgggttcatgttctatatatatccactggataaaaatatttttgttgttcaaattttctttatctttatgaatttttttatgatttgtcaaccaacatttgaggaaaacattttaagatctcgctatggaaatggatttgaccatttcttcctctagagctatgaattttcactttctaggtgctgaatgcattttattaaatttatacaacttcagaactgttaaatgttcctagtgagctgaatatttcatcattaaaaaacaatgcttatctctcacagtggtgtgtgtgtgtgtgtgtttgtgtgtgttagtggaaatgagaaaattgaacaaagcctagtgacagttcaaaaagatatatatcactattgtttgttaatgagagtcaaatgtaatgcaacttttctggaagatattctgcaatgtttacaaaaagttgtaatggcttgcccattgatctacataaacaactatcaaagaaattttatgaaactatctacgagttgaaaatttgataaatgttacatccatatgacatatcatgaagtcataaaaatgacagagccatattaattaccataaaagtaaatccaatatttataaataaatgaaaaagtcaatcgcagtcatatataatcgttaaaaatatatgtgtgcatgtgcatgtgtgtttaaatattcatttagtataaatttattatttttagagactggtgtggacattcactgtattcagcattctctgtattacctcaatttaattttacaacatacctactttcctgttctaatcagatgaaagatgacattactttcatttacaaaggatttatatatacatgtataggcatgaagatagtctttatatattatcatgttaaaaacatgttgcttggtaaatattagtatgacctcaactatataataacacagatttaaatgtacatattttctaaaagaacccagtagactgaatatggttcctttgtgttataggaatttggggattcttttcctgaatctctgttttaaaacagttatctaacattcatatattgagaaatgaaaaaaatatcaaagtcttgctgtcattcagaccaaatgactccttagcacggtaaattagaacacaaactaaatttcacaaagggatatgtatgaattgattggggccatgtagtccagaaaaaacaaaacaccataattttaaaaggtgatctcttaattacatgcgtttctgaaacatcaccatcattggtgtttgtctggatcttctgtggtactgtaatttgcagaactggtgtttcagaatctgcatgaggaaaagcatatgtgagcattcccagtgtattcatgtcacagtgtcctttcttatcactctttaagcttccatcacacacacacacacacacacacacacacacacacacacacacacacacacacgagtccagttccaggaagacgctcctccaggcgtgggaggtttaccctagctctgcccaaggacacttcagggtttggtgacttcagccctgcgtgggagaagtgtgggctgctgctcccagaccccatccggcatccccacttcccactgcagcctggggtccgacacttgtaagcagttctggggcccccttcccagcctggcctgcgcttctaggccttgccaaaggcgaaagcggaaaggcggcctcctctcctgcagggctctttacttacgtgggcccgcggaggtcagccggcccaggcctgagaggatcagcaagagagacagcattgcgtagccggcggcccagccacagggatggccgttgtccttggaacggctgcagctcgaggccagggtggtggaggccgagcggagcggaagggccgtggggtccgcggggcgcggcggggacccagctccgtggatcccgaggcgggtggatcctacagccccgcgcgcccacccacagtgggctgcaccggaggaggcacgtgggagcctgcatttctgggtacgtgggctcttttttctaaagagttgacatttacaacgcattcaggggtaacatagggttataaagcacatttctactctagaccttttgctgatgaagccttggcaatatgattgttcaacatcatagccttctgggaagacagttgaattactgtagtgaaggaaaacagaaaaaaaaaaaataagaatcatagtatgtttagcagcagccaattgccaattttagtaatatctacttctagttttctgctcttaagactcaggtgaaaacacaaacagatactaaaaactaaaaaatcaatttcttagaaaactgtctaaggagtttaagtaaaatgcgaaatatggatatatggatgtattttattattttagtacgatttataagtatcaggcaaaaaaatcacacctataaaattacttcataaaaacaatcaaaatccatttatttattgacttttccacacttttgtttcttagaaaagctttatggcttagggagacttaatgaaaagccagacatattttcccccatcaatatggagttcacacaaggaatgataatatagttagttggaaataattttattttatctcttactgtataagtaggtggtttgcctaatttcaattttttttcaatttattatttattgtaacatttgtattgtagtaaaatacacaatataaaaattatgatcttaatgctttttaagcctacttttcagtggaattaaatacatccatattgctgggcaaccatcactatcattcacctccaaaactttggatttcaccaatttttacataaactgacttgtttgtgatttcgtgtattgatttgtgtacccaatacaaaaattgacatacatattgacatacagaactatttcatgaccacaaggaacctatatactacggctatagagtatactgacctaccttactcgtaattcctagtcactggcaaacactaatccagtctccacaatccatctccataatattatttttgatactatatataagaagcattatatagtatctcttgaaatttgttttttcactcatatcattcccttgagatacatcaaatttttttcttgtattaataattcattttgttacttctgagtagtatacataatacaaatgttccacaggttatttaaccattcatccatcaaacaatatttgggtagtttccagtttttaaatttgcaaaaaacattgctatgaatgttcatgtacaagtttttatatataaatcaaattatacattagttagactaagtgagaaaacagtagactgaaataaatgaaaattcgaaataaatgaagagacatcccaactgataccacaaaaatagaaacgatcatgagggaatactatgaacatttatatgccaagaggttggataaagaaggagagatagatactttttcacatgcatacaatctattaagattgaatcatgaaaaatagaaaatctgagcaggccaataatgaataagaagattgaattaataataagaagactcccaccaaataaaagtgcaagactttatagctgaatctaccaaacatctggagaattgataccaatccttcaaaactctcctgagaaattgaagaagaggcaattcttccaaactcactttaatagacaaacattattctgaaaccaaacccagacaagggaatcacaaagaatgaaaacaacaggtagaccgtggtggcacacacctggaatcccagcaattagggaggttgagacgggtggatcacctgaggtcaggagttcgagaccagcctggccaacatggtgaaaccctgtctctacgaaaaatacaaaaattagccgggcatggtggtgggcacctgtagtcccagctacttgggaggctggggcaggagaatcacttgaacccaggaggcggaggttgcagtgagccgagatcgtgccactgaactccagcctagatgacagaccaagactccctcttaaaaaagaaaaaaaaaaaaaaaactacaggccactagtcctataaacatggatgcagaaatcctcaacaaaatactagcaaatcaaatttaacagtatattaaaggggtcgtccactgtgatcaagtgggatttattcctaggatacaaggatggttcacaatacacaaatgaatttatataatataccacactaacagaatgaagtacagaaaccctatgattatttcaaaagttgcatacaaagcatttgaggaaatttattcatccttttgtaaaatactctgatcaaattaagtatagaaggaatgtttctttattcaataaaggctatgtatgacaaacacagggctaacatcataatcaatagtgaaaggttgaaagatattttttctctgagattagaaacaagacaaggatatccacactcttcactttgttccaacataatatcatttctggtcacaactaggcaagaaaaatttaaaaatgcattctaatgggaaaggaagaagtgaaatggactctttgtaaatgacatgatatcatatctaaaattatatgttttatggatataatttatatatattaaaacatataaatatgtatatatttaatatataagtatatataaaattatatataatttataattttaaattaatttaaaattaaagactccaccaaaaaactgatagaactaataaaccaattcagtaaagatgcagaatataaaatcagagtataaatatcagtagtgtttgtatgcattaacaaaaaactgtgcaaaaaaaagggatttaaaaattagcctctttattaaaatacttgggaataaatttaaccaaggatgtgagagatctgtgtgctggaaataataaaacattagtgaaagaaattgaagaagatacaaataattggaaagatattccttgtttatggattggaagaattaatatgttaaaatctcaacgataccctaagcagtctacagatcagtgcaacccctatcaaatttacaagaacattttccacagaatggaaaaaacaatgctaaaatttttatatacaacaaaagacctcaaatcatcaaagaaatcttgagccaaaaggacaaagctgaagatatcacactgcttgtttcaaaatatattacagagctatggtaatcaaaccttcatggttctgtcataaaaacagactgattaaaaaatggaacagaatagatcccagaaataatccccacaaaattttggtcaattgatttttgagaaaggtgccaaaaacatatactggggaaattacagtttcctcaataaattcttttgggaaaacttcatatccacatgcagaaaaatgaaattggatccatatctcataacatatacaaaaataaacaaaaattgcattaacgacataatggtaatatctaaaattgtaaactattaggaaaacacaggggaggagctccacaacattggttggggaatagttttttgagaactgcatcaaactaaaaagctttttcacagcaaagagaaacaacacagtgatgacatattttctgattggcagaaaatattagtaagctataaatctgataagcgacgattatccaaaatatgttggaaacaactcaacagcaagaaaacaacctgatttgggcaaagtatctgagtatagacatttctcagaagaagacacacaagtggccaaaaagtatataaaaatatgcacaaaatcaccaatcatccaagaaatgcaaattaaaatcacaatgagctatcacctcagacatgttaaaataggtattatcaaaaagacaaaagataactagtgacaacaaggatgtggataaaataaaacccttgttcattgttggtggaaatgtaatttagtgcagccattatggaaaacattatggaatttctcaaaaatattaaaacatagctaccatataatccagcaattatacttctgggcatatatccaaagaatttaaaatcagtatattaaagagatatctacaccaattttcatttcagcattacttacaatagccaagattcatcaacagatgaatggataaagaaaatgcccagtatttatttctcctattccattgtccacaatggaatacttttcagccttaacaaaatgagaaaattatgtcatttgcaacaacatggaggaagcttgaggacattatgcttagtgaaataggccaggcacagaaagacaaatattgcattatatcacttatatatgaaatctagaaaagtcaaacttagaattagggaacagaatgatggttaccagagtttggaggtaaagaagtggagagattttagtcagagggtacaaagtttcagttagacagatggaatgaggttttgaggtctatcatacagtatgctgaatatagttaataataatgtaattcatatttcaaaaatgctattagagtagattgcaatttttcacaccacaaaaataattatgtgaggtgatgaatatgtaatttatcttaagtattccataatgtatgcatatataaaaacatcatattgtacccataaataaatatatttattttatttaaaaattaattacaaacacccaatctgtaatgtgaaagtcacttttaaggaagtagagaaaaaagtaaattaagaaagcaatgatacaaaaccaatgggaaagaaaatctaatgacatgtgatggttaatttcatgtgtcaattttggtaggccatgttgctcagatatttggtcaaacattattcttggtgtttctatgagagtgctttaaatgtggttcacgctggcggactttgagtaaagtggattgtcctccataatgtgggttggcctcatcccatctgttgaatactggagagaatgaaaagactgaccttcctccaacaggaacttcagcatcaggtccttttgcgttttcagcctgatagcctctggacctcaattgtagcatcaactcttcctctctccatcctgctggccaactctgctgattttgaacacgtcagcctctgtaatcatataagccaattccttatgatagacagctttctatttatataaacctcctattgattctgtttctctggagaaccctgactaatatagtaagaaaaactaacaatggcagttcaagataagtgaaattatcatgaataaagtagcatgaaaactattccaagttattaaagaatagaagtttattgaaataaaggtgccctgaatgagaaaaaaaatttcaagaaactctgataaaaacttatatcactgaggtataatgaaattaatatattggactttgtaattaaataatgaaaaatcctatgggcatcttggccacaaagaaagtcaataatgaggttaggaaaactgactcgtgttgggctttgacaaaatggagtgcttacaagtgagtcaaataatttctatgaacttagtagaggacatacagtatctcaacaatgttttacacagtcaaattcacattgtagtataaa

SEQ ID NO: 332 - DNA, 28683 bp, Homo sapiens
ggtcaatgagattaagcaaacaaaactgagacctagatctcactcttgaggaagaaggaaaacatatcaacaactaccaaatgttgacttctgccatattgttcaatgccaacagacttaattttttttttcttttttttttttttttttttagatggagtcccactctgttgcccaggctggagtgcagtggcgtgatctcagctcattgcaaccattgcttcctgggttcaagcaattatcctgcctcagcctcacaagtagctgggactacaagtgtgtgccacgacacctggccaaattttgtatttttagtagagacagggttttaccatgttggccaggctggtcatgaactcctgacctcaagtgatccatccgccaaggcctcccaaagtgctgggattataggtgtaagccaccatgtccggccagagactcaatattctaattaatgtggataactgaagtatgttacaaactgaggcaaagtttttgtcaatctacctctaaaaatacttcccacttaaaaaaaattaagttattaaaaaaataaaacttacaattcgtttcttccaaaatctgtatttcgggctcgttaacaacaactccttagtcacaggtgaacagtatagataaaccttcaagctgaaaggaaaaaagaaaaaaactttcagtacaatccaaaatgagccatcttggtgactaagaaatctatttcatcatacatctaataatttcatttgagaccagtctgaccaacatggtgaaaccccatccctaataaaaacacaaatactagcctggcatggttatgaaatctatttcatcatacatctaataattcagaaattacgctggcacaaaatctgttagagtcactctcaacatacctatgcacaccatttcagtgccaccaagagcacaaggtgggggtggaaacacggtgtccctggacctcctccaacagtggtccctcaccattgttacttggaaatacgcgcttgtatgtgatcaggtgtgtctggaaagataccgccacacattacactacctctggaaaaggtgtgttgagaacagaaacttctgctttttactgtataagtctattctttttttttttttttttttttttgagatggagtcttgctctgttacccaggctggagtgcaatggtgtgatctcgtctcactgcaaactccacttcccaggttcaagcgattctcctgcctcagcctcccgagtagctgggattacaagcacgcgccatgatgccggactaatttttgtatttttgtagagatggagtttgaccacgttggccaggctggtctcgaactcctgacctcgggtgatccacccacctcggcctcccaaagtgatgggattacaggcgagagccactgcgcccggcctattctttttttttttttttaatgaacagaaattaatttcataataaactttttttttctttttttttgagatggagtcttgatctgtcactcaggctggagtgcggtggcgcgatctcggctcaaagcaaccttccgcctcccgggttcaagcgattctcctgtcttagcctcttgagtagctgggactacatgcgcaccaccacgcccagctaactttttgtatttttaatagaaatggggtttcaccgtgttggccaggctggtctcgatatcctgacctcaactgatccacccacctcagcctcccaaagtgatgggattacaggcatgagccaccgcgcccagaccataataaacttttaaaacttaacgctatcattttgaggttaggaatatagtctacggtagattgtattttccaaagatggccacacaatgacatacaccatccatacatgctctccttacaaaatagatactaaaattcctccactgactggcggggtctatgttccctccccttgaacctgggcagttttctgtaattaccttcaccatagaatgcggtggaagtaattgcatggcttttgaggttagatctccaggtagtacaacttcctcctagctctctcttaggacatacgctttttaaccctgagtctccatttaacaggtctggccatcctgacagactcacgctaaagagatttttttttttagggggaggggagctcactgtcacccaggctggaatgcaagctatcctcccacatcagcagcctgagcacctgggactacagcacatgccaccacacctggctcatttttcctattttctgcagagatgaggtctccctacgttgcccaggttggtttcaaactcctatgctcaggtcatcctcccacctcagcttcccaaaggcctgggattataagcctaagccactacgcctggcctaaagagacttttagagatagagatgccgcacgcctgtaatcccagcactttgggaagccaaggtgggcagatcacttgaagtcaggagtttgagaccagcctgaccaacatggtgaaaccccatctctactgaaaaataaaaaattagttgggcttagaggcacgtgcctgtagtcctagctgcttgggaggctgagctgggagaattgcttgaacctgggaggcagagattgcagtgagccaacatcacgctactgcactcctgcctgggcagcagagttcgactctgtttcaaacaaacaaacaaacaaacaaacaaacaaaaaaacatgccaaatggttctagcccctagctgtgtgagttttcccagcccaggtatcagacatggataagggagtcttcagatcttaaggggctgacatctgaagactctgctcactgatgtttgatacctgggctgggaaaccattcccattctaccctgtcaatccctgatccacagaaactgagcaataagacatgatcagtgttaagtcactccattttgaagtaatttgttacgcagcagcagatgactgatacataggctctgcaatcagacagacctggctggaatcctggtcctgccacttactggctgtgtgacactgggcaactaatttaacctctctggttcctcagtttcctcatctgtaaaatagaaataatagtaggatctattcaaaaggttatcaagaagctctaatgacaatgtcaggtacaagtgtgcagagccttgcatctgtgtggctcactaatgcattctccacctccagtacaatgcccgacatgtcacaggtgaccaaaaaaaattactgaggccaggagtggtggctcatgcctgtaatcccaacactttgggaggctgaggcaggcagatcacttgaggtcaggagttcgagaccagcctggcgaacatggtaaaacccctctctaccgaaaatacaaaaagtagctgggcgtggtggtgggtgcctgtaatcccagctactccggtggctgaggcaaaagaatcactcgaaaagaagttgcagtgagctgagatcgtgccactgcactccagcctgggcgacagagcaacaccctgtcacaaaagtcaataagtaaatacaaataaagtaataaaaaattattggccaggtgcaaaggctcatgcctataagcccagggctttgggaggccaagatgggagatcacttgaagccaggagtttacaaccagcctgggcaacatggtaagtccccgtctctacaaaaaaaaaaaaaattgttgaacaaaaaatacacagtgccaagatacagtaagtattcaataaacgttagctatcattatcaagaagacagagtattgctatcaattagcagagaagcctgacatccactggcccttttcaaatatgtatcttgagaagggggaatttagatgtaggcaatggctgcaagagaagcatctaacagttcagctttaagaaaaaatccagtattatatgatcctttacaatggaacagccattctctctcatatactcttacagaaataacatggagtgagttactgctgtacctagcagcatagataaatcacacaaatacaaagttaagtaaagtaaaacaaatataaaagggtatatttggggccaggtgccagtggctcacatctataatgccagccctttggaagaatgaggcaggaggatcacctgaggccaggagttcgagatcagcctgggcgacatagcaaaactccatctctgttttttttgttgctgtcgttgttgttgttgttgtttttagagagtgtatttggtaggattatatatatatatatatatatcaagttcacaaacagccaaagctaacccatgatgacaaaagtcagaatagaggttacctttgggaggagggaatgagttgggaggtaagaggggtctgggatattggtactgtcctatttcttaatctgggtgatgcgttcattttgtaaatgactatatgcttggatgtatatacttttctgtacagttgttatctctcaattaaaatgtttgcttaaaaacacaagtagcaaaataaattacctgcactccaaccttcttttcaaggtaggggctcttaatcctttcatgtgatctaaaaacaaaagaacaaaaactcatgaatatgtttttccagaggattccttagcccaagggaaacagtcgtcttctttttcagcttcaagagaaaacccatgaggtttgcttttataagaattgattcacatgggctatgagctctttcttctgcaagtgaagaatcctcctcagaacaggaccggctgcccatttctgagccatccaagtcaatttaaaaggagagtgattctgtgcatcataggccagagtttaaatcactctgggcagccacagaagaatgagaactgcttctagccctccactcttacttcatttcaatccaaccatccttcgagccaagctctatgggacccattcactttctgccacttaaatcagtctatctagaaattcaagttcgtggtcatggagtctgctgggaaatcactcaggttcagagtaagtgtttcgtcatcttctcagcctactgtgatggattgaaaggggaatattactatccacaaagacttgctccacagcgctccacattaacagacacagacaacagaaaggtagcaattagaccgactattacattaagtatatcatgcattccaatatattctgaatctttagcaagtaaaggcccagacaacaatgatcaaacagctctaaattgtttaactaaaccagttggacatggtggctcttgcctgtaatcccaacactttgggaggccgacgtaggcggatcacctgaggtcagaagttcaagaccaaccttgccaacatggtaaaaccccatctctactaaaaatacaaaaattagccatgaatagtagcacacccctataatcccagctactcgggtggctgaggcaggacaatcacttgaacatgggaggtagaggttgcagtgagccaaggccataacactgcacttcggcctgggcgacagagtgagacttcatctcaaaaacaaacaaacggctgggcgcggtggctcatgcctgtaaccccagcactttgggaggccgaggcaggcggatcacctgaggttgggagttcgagaccagcctgaccaatacggagataccctgtctccactaaaaatataaaattagctggggctggtggcgcatggctgtaatcccagctacttgggaggctgagataggagaattgcttgaaccccgaaggcagaggttgcggtgagctgagattgtaccattgcactccagcctgggcaactagagtgaaactccatctcaaaaataaataataaccaaaaaaaaaaaaaaaaaaacaagaacaataaattgcttagctaaaccaaaccaattctaattaccacgagcaccaccacacacacacacaagcaccccctcaatttatatgtcgtgtggccatcattagacccagtgaaagcagagcagtcaccacatgtcacttggcagcccttgattgtatatatgcctccaggagagtccacctgtctcccactgggtaaattccctcaagggatatctggtccagtcttttagggcctatgggtatatccctgggcagcattctccgtaattggagtttccaaagagtttgcgccatggcaaagaggaggctgaatgcagactctgcatcctgctcccacactgactaagcaggcagcaccctgcatggtgcatcatggtcccccatcctcaccaccctgaggccccttccagctggtagtcacaagaactggatgggtttgctttgtgtggctggaactgcacccaggtctgcttttccagggaggttttccttttccttggcaaccatcataaattgtcccctctaggggatttccccaaccctgggccactatctcaggtctcaggggtcggggggccctctcatctttcagaacttactgatgatgcttagtaaagcccaccctgcacacagcattggcttccagatggcccacaaataagcatcaggtgggtccatagcctactccgaattatatcaaaatgtgatgtggggctgggtgtggtagctcacacctgtcatcccagcactttgggaggctgaggtgagtggatcacctgcacccaggagttcgataccagcctgggcaacatggggaaatcctgtctctctataaaaaatagaaaaattagccaggcatgatggtgcatgtctgtaatcccaactactcaggtgggagtacttgctgaggtgggaggattggttgagtccaggaggtgaaggctgcagtgagccgagatcgcaccactgcactccagcctgggtgacagagcaaaaccctgtctcaaaaaaaaaaaaaaaaaaaaaaaaaaaaaaaaggaagtgatgtggatgggtttccatgcattttttctagcaaaagagtccatacagtttctcatgtttgagctgctatcacaagataccatagataccatagttggccttcacaccagcgctgtaaggaaaggtagtgttttggttgccttcaacaccaaaaaggtatttctcacagttcaggaagctgggaagatcaagatgcggggcgatttggtttctggagagggcacttttcctaacttacagacagccgccttctcactatgcactcacatggctttcctaggccccgcatgaggacagagcgccctctctcttccttctcttgtaaggaaactaatcctatcagagtaggacaccacggtaggaccccacttaaacttattttcctcctaaaagccccagccccaaatacagtcgctttgggggttagggcttcaacatatgaattttgtggagatagtccatatcataatcaaagaagcctgtgtcccaaaaaggtgaaaagccaacagaaggcaatgtgagaaacctccaaaagcagaagttgtgttttcacccttgatgagtttatgtcctggttgactaagcagatccacatgtggtcagagaacagaaaaagttgttatagactgttcaacagtagggaagagtccatttctggcttaatgcacaaacttatgatgatttcaaattcctttagatttattatttctccaaactcagccatcctaaacacgaagtgcaagtttcggaagtatactttaatcctggctagcccattttgagttcagagactccagtgcggctctacacaaaaagtaaaaataggcatatcctcgtccagcagtggattctcaatgaaaaacaaaaccagaaatgtgtcaggcacagcggctcacacctgtaatcctaacactttgggaggctgaggtgggtggatctacctgaggccaggagttcgagaccagcctggccaacatggtgaaacatcatctctactaaaaacacaaaaattacctgggtgtggtggtgcgtgcctgtaactccagctacttgggaggctgaggcacgagaatcgcttgaacccaggaggcggaggttgcagtgaacagagatcacgccactgcactccagcctggtgatggagactccacctcaaaataataataaaaatacaaacattagctaggcatggtggctgactcctgtagtcccaactacttgagcagagagcatgtgccacactgtactccagcctgggcgacaaagggagaccctgtctccaaaaaaaagaaaaagaagaaggagatgctcaaagacgtgcacgatgcgaatacggcaacgcacgagaagaggtccagattttcccattaaagagaaatcactggtggctttgtggaaaaaaaaagcagagacatttcgcagaagcagtaacttcaacgatttatagtccaagtgattgattccacacacaaaacaacatagctggccttcacaccaaccctgtgaggaaaggctgtgtttggatacctgtaatttactttaaaatactttcctactgcgcaggtacagataggtttgttacgctgattgactccacagggtagtgggagcttcctgctccagcacgctgcaaggccacacagcaggaggcagcaactccagtgattccgtttatcattttctccaattaacactaatggctgggcgaattagcacaatgagcattaaaactgttttccctggtaaaagttagtgacttgttagcacaatagaagtgaaaatgaacaatggttgtcaagttagcggtatttaaactctggaacttagctccaatctctgcttggagcatcagcgacactctaaccttaatccctaaatcggcccagctgtgaaaggatccagctgtgaaatcatagtagcttttcaggttgcctgataccatctagaagggaaacatccctccaacctaaactagaacgaaactttcatattggatacggacagaacacccaaaggccaaggagcttgcacttcgtggagctcttaggcgggctgttccacagttgtgtgtgtgtctgagtctcctgcttgctgaccaatgtttgagggtgtggtcaaatggatctgaaacttgttttcttcatacatggtagcgaggctctgagggaagtactaaccctcgccaatctctgatcatcggccaccagcaaagctaccaagagaaactactagcagtgcttgaccaagccggcccggggcgcaactggcaggcgccgttacgccgcgttgaccacatccgaaaatagatgaagcctttgagaggctgaagagcccgactgggacaaggcgtgtgctggccgccccctcgctggcttcccacaggctgcagctccttgctccagggccggccccctcctgtcctctctccagcccccagcgccccgggagcgggcgacgcgcagccctcactcacctttgtggcagtgggacaggaagtaggcgcgggccctcaggttctccctatcgaagcggtctatggagatagttggatactcggccatctgcccctcgaaagaactcatagcgccgccgatcccagagtccgggaccccaaaaccgcagctgaagccaaggccagccctgaccgcgccgccacttccgggaagccgcgcgctgcctcgccattgggcggccgaacgcagccacgtccaatcagaggagtccggagaccgggggcaaagtcaaggagcatccggtcgggttctaggcgcccgctgcttgggtttaaatcacccgcgcttcgctgcacgcgatgggccctgagccctgcccagtgcaaggctcattcccgcccaacaaacacaggtgttgctctggtaaggcgttgcccatgtctgtggaggtgcagtcgcgggaagggaaatcgaaactcccagagcaggtggccccagccgacgaggtgagtgggctgcggaactgcgcttagaaatcattcttcgttccgcttcctgcttgtctgctgctagcctgaaacccgagctcagttccccgccctctctcttctgttcccaatttctaaccttgtgggattaccgtgagggttgtatgagaaagtttgtatctgactcatggtagattcaggaactattaattccctcttccgtttatataatctacaaactgaataaatcatctctgcgtgatcttggggcaaataagatcccaataatgccttcgctgctggcctctcccctgggcccccacctttttgagctatacttttaggaagttagaatgatgtacttaaaaaaagaaaaatggcaggaaaggtctaaaattttttaacaaccaaagcaactttatgaaaaggtttgttaaaccttttattgtatttcctttattgtattacaataaaccaaataatcaccatgacatttattgtgctccttcctatcaaatctccttagtataattaaacacaaacaacccagaacactttcgctttattttatttatttattcagttggggtctagttctatcgcccaggctggagtgcagtggcgtgatttcggctctctgcaacctccgcctcccgggttcaggcgattctcctgcctcagcctccagagtagctgggactacaggcacgcgccgccacgcctggctcatttttatatttttagcagagacggggtttcaccacgttgaccaggctggtctcgagctcctggcctcatgcgatccgctcgcctcggcctcccaaagtgctgggtgagccattgtacctggctttccaggcctccataacacttgaagtcccactttgtgcacagcactgtgacaaaccttcgggtagcattcaatctatctggcgacaacatgtttgcagaatatggcaaataaatgcttccacagagacgcaaggtaacgtgagaacaaatccaggaacaaagatttctgaccagggaaatcaggaatcagaatgccatcccagcccacctcagtggctcatgcctgtaatcccagcactttggagggctgaggcaggtgatcacctgaggtcaggagttcaggaccagcctggacaacatggtgaaaccccatctctactaaaaatacaaaaatcggccgggcatggtggcacacatctccagctactcgggaggccgaggcaggagaatcacttgaacctgggaggcggaggttgcagtgagcctagatcatgccagttcactccagcctgggcaacagagagagactctgtctcaaaaaaacaaaacaaaacagaatgacatccctagtgaatgtcagcttgtgcctgtagccatgatactcagagttctattcaaatacagatttccatgaaatcttgaggagggggaggaggggtgacatggaaaggtatacacaacataatcactaattgaggtaaaatatcctgctagtatactactggcaacacctttgatggtttgtcttagaacacatgggaacaactgccctggcagggttatggagacctaacaacaaattctgctgtgagtctagtgtccgaagaatctcacggtagagctccaggaaaggcaggtcaagttaatgctcgtgatcttatgtatttgctcacttatttatctcctcctctttccacaatggatacagtacaaacaaagggaaatagagtcaggacaaagagaaagacaggatagaaaataggcaagataggtaagcatagcccagaccaaacctagtgaatcagaaactctgggagagtggggcctggcagtttgcagcttaacacaccttctaggtgattctgatggaccctaaagtttgagaaccactggattcgagtctaaagaacattcagggccagtgtggtggctcatgcctataatcccaacactttgggaggccgacgcaggtggatcacccgaggtcaggagttcgagaccagcctgaccaacatggggaaaccccgtctctactaaaaataaaaaaaaaaatagccaggcatggagtcaggggcctgtaatcccagctactcaggaggctgaggcaggagaattgcttgtacccaggatgcggaaattgcactgagccgagattggaccatggcactccagcctgggcaacaagagcgaaactccatctcgaaagcaaaacaaaacaaaaaaacacaacactcaagaagtctggggcaggaattcaggtaggaagctgctgcaatactgcaggaaatgtgatggtgaagcttaattcattcagcaaatcattcactgaccatctactgtgtatcagacactattttagacactaaagatacagtagtgagcaaagtagacaaaaaatgtggcccatcctggtggctcctgcctgtaatctcagcactttgggaggccaaggcaggtggatcacttgaggccaggagttaaagaccaacatgacaaaaccccagctctactaaagatgcaaaaagaattagccgggtgtggtggtacacctacaataacaactacttgggagctgaggcacaagaatcacttgaacctggaggcagagattgcagtgagccaagatggcaccactgcactccagtctagacgacaaaagagaccctgtctcaaaaaaataaaactaaaaaagcagacaaaaatccctgtggacgtgggagtgtaccttctaatgcaagtaattactgtctaccatttatgtagttccagatgttatcagtgttttatactcattatttcatcctcacatcctacctgcccatcagataggtacactttctgtcctcatttgccagttgaggatacggaggttaagtagcttgtccagggtcatgttgatagtaagtagagctcagatttaaatccaagaaggccaccacacttttagacactgtgctctctgacaacacactgctagccaccgtgccatgctgcctccacagcatcggaagggcagtgatgaaatatactgattcaaaatatatccctttagcacctactgtgtgctaggcagtgttaggccagtgtggctgcagcagaatgatccggggctacagaggaaggagggagggtgttgtgagcaaatcttacagggctttgctcaccatgtatagcctctggttttcactctccataagatgggaagccattgcagggttgtgagcagaggactgacataatttgacttaggtttttttgttttgttttctttgagacggagtctccctctatgcccaggctggagtgcagtgacgcaatctcggctcactgccacctccacctccacctccacctcctgggttcaagcgattctcctgcctcagcctcccgagtagctgggactacaggtgcacgccaccactcccagctagttcttttgtatttttagtagagaaagggtttcaccatattggccaggctggtctcgaactcctgacctcgtgatctgcccacctcagcctcccaaagtgctgggattacaggtgtgagccaccgcgcccggccttgacttaggttttaaacagattgcattgactgttgtgttgacaacagactacagagggggcatagagagctgttgggaacggttgtaattaccagaaaaaagaaaaattatgatggcttgagtagaagctataaagtcagcaggttgcattgatggatatggaaagagagggctctaggccacatctactaaaagacatgaagaaggagcagggtttttgtttttgttttggcagggaggtgtttggggaggttgttttgtacaatcaagtggatgttgaatatacattgatatacaaatctaaagttcagagaaagaccgggctgaagagagaaatttgggagttgtaagtaaatagttttttgtttttagttttactaagtattgcctttgttttagtatgactcgtttatttagaagtttatataatttaatttgtgatatgtcttgtgtttttgttttgtttggggcaggtgcccgaggcccttgtcatcttcattgactccagctcatggcttgtatttaacaacgagctcagaaaaattcctaaaaatttaattactgagtctccagagctctaatgagctggctccagcacacaattgctcctttctttcattcaacaatttgacaagtcctgatggctctacattcaaaacatgtaaattggccgggcgcggtggctcacgcctgtaatcccagctctttgggaggccgaggcgggtggatgacgaggtcaggagatcgagatcatcctggctaacacggtgaaaccccgtctctactaaaaatacaaaaaattagccaggcgtggtggtgggtgcctgtagtcccagctactcgggaggctgaggcaggagaatggcgtgaacccgggaggcggagcttgcagtgagccgagatagcaccactgcactccagcctgggcgacggagcgagactccgtctaaaaaaaaacaaaaacaaaaaaacaaaaaaccgtatatcttgaatctgatcacttttcgcttagatagtactgtaatatagtaatagataatgctagaaaaaataattaaagctatagatatcatctattgtaggtttactgattgtcaggcactatggcgactctctggaatggttcattcctcgcaaatgaatagataggagatatctactatcaggaactacaaacacagtctccgtgctgtgatccgctttcacagggaattttgtctgggattcaagtagcggcaagtaaccctttttcgccctccatctctgctcaggggtgagccctggcagcgctcctacctgggacctacattggcttagtaagatgggccggcgcccaccccagccctcgcgcatgcgcataaaagcccactcccgggggcggggcctgagctagctgggcggggcctgaaggagccgggagctcctgcagcttcatcgcgttactaagagacgcgagggtcgcgaagggcacaacacttggcctctcgctggccctgctcgcggatcccgagtagagaacgcaagcacccacgcccgcctgcaagctcccgggcgcccccggcctctcctgctcggcggaacgaggataacccagtagagccggacccaggggtgggtggatgcgtcgctggaggcgagggccctgcccgccaacccctgcgccccggccgtagccccaccccggaagttcttgccccgccttctcggctccgcagttctctgctgtctcctgaggtttgccagggagatcccgtggttttcatgtctcttccgtgatttttagggaagagggtcactatttggcccttccagaatctcagggtccggttctcccggaagtttccgggccgccccggaccccattggctttaggggccgcgtctccgagggctccgatttgggccctagattttggaatactgtgttttgtccgtcccagccttcaccaggcggatttcatctcccacacagttagtgatttatggcagaaaggaagctggagggatggggactgcaggttagctgtgagggccggaagggagcggttttgtgctgcacacaggcaggtcagcactcccagagcagggaccgccgggcgtgctttcggaaccgcttttgtctttcaaatgaacgcccagcgacagcagacgggagttccaggaccttagagaccggctaatgcttctctttaagttaggaaacaggcgcaggcgtgttcatggccttgcctaaggttacgtgctggttacagggctcctcctgctgcctcttaagaacagaaataatctaataggaggaataaaagggactattagggaggctaatgctcttgaagttttaatactactaaaagtaaaagcgcttttcagagtgaaagggaagtgaaaagggaatttgggtggctggctacatcagaagcttctgttccaactttagattgtcagggagttgagatggtgttttttgtttttatttttgttttagttttttgagacggagtctcgctctgtagcccaggctggagtgcagtggcgggatctcggctcactgcaagctccgcctcccgggttcacgccattctcctgcctcagcctcccgagtagctgggaccacaggtgcccgccacgatgcccggctaattttttgtatttttagtagagacggggtttcactttgttggccaggatggtctcgatctcctgacctcgtgatccacccgcctcggtctcccaaagtgctgggattataggagtgagccaccgcgccgagatggtgtgtttttaaaataacgtgcccgaggccgggcgtggtggctcacccctgtaatcccagcactttgggaggctgaggcaggcggatcacctgaggtcgggaattcgagaccagcctgaccaacatgggaaaacctcgtctctactaaaaatacaaaaaaattaaccaggcatggtggcgcatgcctgtaattccagctactcgggaggctgaggcaggagaatcgctttaacctgggaggcggaggttgtggtgagacaagatcacgccatggcgctccagcctgagcaacaagagtgaaactccatctcaaaaaaataataaataaataaataaaataacatgctcctcaatttaactatgggattatgtcccaatacacccatggtaggtcgaaaatgcatttaatgcacctagccaactttaaacgtcctcagaacacttagctcccctgcagttgggcaacatcatctaacacaaagcctattttataataaagtgttgactatgtcatgtaacttactgaatactgaattcaaagtggaaaacagaatggttgcgtgggtactcgaattactgaatgcgtattgcttttgcaccatggtaaagtggagatatgagttgaaccattccacgggaccatctgtatgcatataaaccctaagtatttcatataattcagtttcacaaaccagaaactcaggcattgctgtttcctgtttgtggagctacaacttggtattttagatgtcaaatttatttatttttttgagatggtgtcttgctctgtcacccaggctggagtgcagtggtgcgatcttggctcaccgcaacctccgtctcctgggttcaagtgattctcctgcctcagcctcccgaagtagctgggactacaggcagccgccaccgcatccggctaatttttttttttttttttttttagtagagacaggttttcaccaggttggctaggctggtctcgaacccttgacctcaggtgatccacctgcctcggcctcccaaagtgctgggattacaggcgtgagccaccgcacatggccaaaacgtttatttttatttatttatttttttaacatttttttcttgaggcagggtctcattcttgtctcccaggctggaatgcagtgacttgatcacagctcactgtggcctcaaccttgggggatcaaacaatcctcccaccttagcctccccagtagctgagactacagtcatgggccaccacacccagctaattttattttttgtagagatagggtctcactacgttgcccaggctggtcttgaactcggactcaaaggatcctccctcctcagtctcagaaagagctgggattacaggtgtgagccgctgcatccagccattaaatgtattttttatcaattctttttttggcacaactgccagcaaagaaaccactcagtctgcaagagctaagtactagcagaattagaactgccactgaatttcctagaatcactgaaaaatttaatcaaggaattgtaagttgatctttcctaattttagtttcattttgtgtttttaataaactgaaagtaagggcaaaaaaaaagaatttccaccaccacttatatagcgtagttacagtagtcactagagttcctactatggtgaaatttacattcatattctctttaggtattttgggaaaataaaattttgaaatgcttaataataaccggaggatgtctatttctactgagaaaagtggtgatttcccccaaagtccaattgaatacagcatattttctgctcttctattaaatgtagcatttttatgtatagttgccataattttttgagctgaaagtgacaaaaggttacatagatggcattcaagaaaatacgtttcgaatgaatatgagcaaaaagtcaagcctaaagcaaaaagggcatagataagacaaaaattaagattgtatcactacatgtgcttcatctgtaaaagtcctgtaagtaatacagtcactaaattcatataaaaatatgactaatttggaattttttttttttttctttttttcagacagtctcgctctgtcacccaggctggagtgcagtggcaccatctcggctcactgcaacctccatctcccaggttcaagcagttctctgcctcagcctcctgattagctggaattacaggcatgcgccaccatgcctggctaatttttatatttttagtagacacggggtttcaccatcttggccaggctggtcttgaactcctgacctcgtgatccacccacttcagtctcccagagtgctgggattacaggcgtgagccaccgtcctgtcctgaaagtattttaatacagtgaattcactaacttttttttttctctcttaatttagacagagttttgctcttgttgcccaggctggagtgcaatggcacgatcttggctcactgcaacctctgccccccaggttcaagcaattctcctacctcagcctcctgattagctgggattacaggcatgcgccaccacgcccggctaattttgtatttttagtagcgacgggtttctccatgttggtcaggctagtctcgaactcccgacctcaggtgatccacccacctcggcctcccaaagtgctgggattacaggcgtgagccaccacgcccagcctaacttttttctttaatatttcttagaacctttttcctgtgtaatatatctatattcctgtgtaatgtttcatattatatatatgaatggattcttaggctgtatcacatgtccaactcacctctttgtcatagctggtatattgctattatattgtgcagcagtggagtagtgaacttcccactagaatgaatggcattaaaggacaaaggtttcactgaagcgtggcttatttgttttgccaggtgttccaaattttacataaactcgtataatactgtaaaactggaccgggtgcggtggcttacacctgtaatcacagcactttgggaggccgaggtacacgatcacttgaggccaggagttcaagaccagcctgagaaacatggtgaaacccatctctactaaaaatataaaaatttggcaaggcgtggtggctcacgcctgtaatcccagccttttggggggctgaggcaggcggatcatgagttcaggagatccagaacatcctggctaacacagtgaaaccccgtctctactaaaaatacaaaaaattagctgggcatggtagtgggcgcctgtagtcccagctactcaggaggctgaggcaggagaatagcatgaacctgggaagtggagcttgcagtgagccgagatcgcgcctctgcactccagcctggtgacagagcgagactccgtctcaaaaaaaaaaaaaaaaaaagaatacaatataaacactataatatttagaatgttaagtaatttaacaaaaatctaaataggaagagcattagaacatctttcttgtttttcatagaaaagagtccattggtacttgtgacttagcctcctaacagtcttcattatctttttttaccaaccactaagggaacatttaggctacatctttcatattgaagaaatatttgtctgaaattcagcaagtctgtctattttatttccatttcctatttttcctctattaaatccaagtgaagctaaatttatgtcttgtaaaagcatttattagaagatccttttaaataaaacttttaagtctatgttaattaatcgtatatttagcatgatttttacccagtatgaaggatggatatttctaattaatgtcatgcttattttgagttttcctttatatatatgtatataagagtgtgtgtgtgtgtgtgtgtgtatatatatatatatatatatatacacacacacacacatatatatgtatacttttttttttttttttttttttggagccagagtcttgctctgtcacccaggctggagtgcaacctccacctcctgggtttcaagcgattctcaagcctcagcctcccaagtagctgtgattgcaggcacctgctaccacgcccagttcattttttttttttcctttttgagaaggagtttcgctcatgttgcccaggctaaagtgcaatggtgtgatctcagctcactgcaacctccacctcccaggttcaagtgattgtcatgcctcagcctcccaagtagttgggattacaggcatgtgccaccatgcctggctaattttgtatttttaatagagacggggtttcaccatgttggccaggctggtcttgaactcctgacctcaggtctcctgacttcagtctccccaactgctgggattacaggctcgagccaccatgtccagcctttccctgttatacctttaatgtatttcttgaccttttaaacataatgagcatttgttattgtgattgaaaaaaattcataaaatattaatttatttacaggatctgactttaatgtgtttcagccaatagaaatatattttaatagaagaatgcattcaaggaatcatagtgaaaattctgtacactttatttcagttaaatgactgatatattttgttaataaaataagtagctgagaaaacaagtgtaagattatgcctttgaaaaacttgctatggaagttcggtgaatagacaattacatgaactaaagtcgtatattagactttccaagactattagtgacctcctacactgtttttaaatccatggtctcagtaccacgacagccacacagtgtgcatggaatctgtgttaggccattttctcacattagttcatcaaaagatcaggtactacagtgacctcagtaaatgaattgcagcaattgggatgtctccaagcaattaagaagtgaaaaagaataaaccatcccctcccagaaacaagaaagcgaacagagtgagaagacgggtcttacattccctttttgagagagagagagagagagagagagagagagagagagagaggtgcagctttgaatataagtaatggaatggtggtggatattttgacaatctactgagcatgttttcagaaatgtgcaaactattacctggaactccagtatttgcatacagcttttagaacatcactccgtaactccaactctgactgggattttattgataaagaaaaaaacagttttgtatgtatctttcagggacttggggttttttttgtttgtttcttacagttttatccccacaaaatagagcatgaatccttctcaatcttggaattgtatgtttaaaaactactatatttaatgggattctcaactctaagtataatttttaagtgttagttttatttattctttttttttttttttgagatggagtcttgctctgtcacccagcttggagtgcggtggcacaatctcagctcactgcaacctccacctcctgggttcaagccattctcctggctcagctgccccagtagctgggatgacaggcgtgcaccaccatgcctagctaatttttgtatttttagcagagacggtgtttcaccatgttggccaggctggtctcaaactcctgacctcatgatccacctgcctcagcctcccaaagtgctgggattacaggtgtgagccaccgcacccggccagttttgtttattcttaaagggaatttcaaaattgtcactattacattatccattaatgttgttttaacatctttcagatattattgataataaggcctctgtaaccatggctagttctgacgtaaaaccaaaatcagtaagtcatgccaaaaaatggtcagaagagatagaaaatctgtacagatttcaacaagcaggatatcgggatgaaaccgaatatagacaagtgaaacaagtttctatggtaagatttctgtctctacaaacctcaactcgaaatgtatttctcagatgctgaaaagtattttataaacaaccagagaataactgaaggaaattcgactccaactctctcattttatttgttttcttttatttacttttattttattttttgagacagagtctcattctgtcacccaggctggagtgcagtgacgcaatctcggcacactccacctcccggattcaagggattctcttgcctcagcctcgtgagtagctgggatcacaggcgtgcaccaccacgcctggctaatttttgtatttttgtagagacgggattttgccgtgtttggccaggctggtcttgaactcctgacctcaagtgatccacgcgcctaagccttccagagtgctaggattacaggcaatagccaggacgcccagccagactctctcatcttattaacggggagaggcccagaagaatgatttgcaggcagagtgggagaagaggtggtcgtttagctgggcacattcagaattttctcttttattgagcaactgtgctctgctaaatgaatcttttgcggtagaccacaaaaaaaaagcttttttcctcactcaggtgatttcattatcagataatcagtatgttgggtaactattatttccctcctgttactttttattttaaccatgaattagaaagaggttaaaatcctgtggtttttggggcaattataccttacaaacaaaagtgttagaacaactcgtgactttgatagtatatcccaggctttcctgagagggtagagacctagctttgctttatgaaggctagaccaaagtctagatttggctcccgtttatacagtgtggttcttcttaacttatttattctcttggctactaagatattttttttttttttttttgagacagagtctcactctgtcacccaggctggagtgcactggcgcaatctcggctcagtgcaacctccacctcccgggttcaagtgattcttaagagacgtgtttttacaaattcagttcacccctgaacaacacagggactaggggcttcaatgcttcatgccgtcaaaaatttgtgtataacttttgactccccaaaacaactactagtaacctagtgttaacagaaactcttgcccataaggtgaataattgatcaacccaggaatacactaatatcttgatatattttatgcattcatgacaaaccttttcttaattatttttgatatttatagtctgtgtggtttgcaacttttttcaaatcgttgcaaatctcaaaaaaaatttcaacaaattttttgaaaacaatccatgtatatatggactccccaagttcaaacttgcattggtcaagggtcaactgtattgtaaaatatgacatagtattcataaatatattttaatttttagatttgggattataacagtgtttattaactcagttgtttatttttattttttactaactcatcatttttcagattctaatgtgtagattttgcagatcactataagctcttctttttcttttattctattctttgacctctacttaaaaattcctttaaaagtacataggaggctgggagtggtggctcacgcctgcaatcccagccctttgggaggccgaggtaggcagatcacttgaggtaatgagtttgagaccagcctagccaacatggtgaaaccctgtctctactaaaaatacaaaaattagccgggcatggtggcatgcacctgtagtcccaactacttgggaggctgaggcaggagaatcacttgagcccaggaggcagaggttgcagttagctgagatcacaccattacactacagcctgggcaacaaagcgaaaccccatctcaaataaataaattaattaattaaattaaaattttaaaagtacataggaaaaataatggaggcaatacggaactatcatgttattacctctttaatagacattaatttaatgacattattgtggttaacaatagaatttaaaatactgatcaagtgaagattgattactgtgacttccatgtatctgtcttctcaaccattatactctatccccattgccaaggataattttcattactatatcatctatggcttttaaacagaaaaaacagaagcattatcatttttatgctgtttaaaataagctttgggctgggcgtgttggctcacacctgtaatcccagcagtttgggaggccgaggcaggtggatcatctgaggttgggagtttgagaccagcctgaccaatatggagaaaccctatctctgctaaaaatacaaaacttgccaggcatggtggcacatgcctgtaatcctagctattcgggaggccgaggcaggagaatcacttgaaaccaggaggtggaggttgtagtgagccgagatcacgccattgcactccagcctgggcaacaagagtgaaactccatctcaaataaataaataaataaaataagtttcataccctgccttaagattgggatgcccctaaagatacacaagcctcagactcataggcggccagctgtggtggcttacgcctctaagcccagtgctttgggaggctgagggtgaaggattgcttgaggccaggattttgagaccagtctgggtgacatagtgagaacccatttctacaaaaaactttttttaattagccaggcatggtggagtgtctctgtagtcccagctactgggaggctcaggtgggaggattgcttgagtgcaggagatcgaggctgcagtgacctgtgatcacatcactgcacaccagcctgggtgagagagcaagaccctgtctcaaaaaaaaaaaaagaaaaaaggaaaaaagaaaagaaagttgtcacaagaattaaatgtaatcacatgtttgaagtgcctgacattatagtgctcataatttgttgggctgggcacagtggctcacgcctgtaatcctagcactttgggaggcagaggcgggccgttcacctgcagtcaggagttagagaccagcctggccaacatggtgaaaccctgtctctactaaaaatacacaaaattagccgggcatggtggtgcacacatgtaatcccagctactagggaggctgaggcaggagaatcacttgaacccgggagggggaggttacagtaagctgagatcatgccactgcactccagcctgggcgacagagcgagactcccccacaaaaaatttgttgactgaaggaacagcaagtgtttagtaaatgataccttttattaatctcatcatcttagattctaaaataagtaacaagaacaataaaaccttacacaaatcgaagtatatgttccttaacaaaaagaagcacagggatttagaggaaaacaaaatcacttccttccagggacaatccccagagagggcttagtgtccccagtggcatttgcagtgggtcttcagggacggataggatggtgactgaaggcttgctttgggtgggatgtttctcccagtgtgcagtggtttgaggtttgagagaagctgtttttcattacctggtggtatagtgcttgctgaccttccctcctgaggggaaagtccttgaacttgaggatctcattccattccaccacaggcaagaaagtttcccagatcaaatggaaatgatcaagttgaaagtcaagaagaaaagaaagttcagagatgccaagggacatcaaaaggaaaaatgtctagaagtcaacaagcaaaggagcaacttagctgtcctaaggattgtcccatatcaagtagctcagctccagatgttcggaagaggcattggttgtactgttttctcaccggatcagatggctttcagataatctgctcctggccccaggagggaagagggctgtaatggagtcttgagaacacctcctttccctgccaaaggtattggaagccacacaggcaggtgtggcctcagtggtggaaaggactgctggttttctgtaatgtatgtcagaaggcctgccaaggcttctcagatatgctgttacctattctcgctaattcataagtaaatgagatgacacaaaaaatgaagatgtgttattagaaagtaaaagacatgtggacacagatggtatattcatctcctcttcctactgaaagctgagatttattcatggggaacagaaaaggtgcaggactacctgtatagaaggtgttgaagaacaggatttggagaaagggtgcaggactgcctgtatagatggtgttgaagagcaggatttggttttctacaacctagataatgagtttttggttatgataaagtgcatctcacaaaatctgaaaggaacatatttgacagtggtgaaatacattaacctggccaggaagggataacattgaagaggaagtggagagacagatctccaaattagatcaagccaaatgaaaaagtagataaaccaatatggtatacaagaaggaatggtaggagatgactggggacagtggctcacacctgcaatcccaacactttggaaagccaagacaggaggatcatttgagaccaggagtttgagaccaacctcggcaacatataataataatgataataataataataataataacaacaataaagaatggtagaagaaattaaaaaaaagatttttgacactttgggaagccaaggtaggaggactgctttaggccaggagtttgagaccagcctgggcaacatagtgagaccctgtctctacaaaaaaaaaaaagaaaaatagaaaacttatctgggcatggtggtgcttacctgtagttctaactactcgggaggcagaggctggaggatcccctgagcccaggaggttgaggctgtagtgagctatgatcacaacaccgcactacagcctcggagacagagtgagaccctgtttcaaaaaaaaaaatggatttcaaggtgaacttgaaattggggcagaaggaaatgcatatacacttttggatagttcttgagttgcttgctttattcactgtgtattcatcaacaatcagcaggcagcacttacaaaatggagcctgggcttagccctaatttcctcctgtggtattaattttagaagttagaatgtttaaaatcttttgtaaacataagagaaatgaagtttagattacttggaatgttttgtcttatcttggccacagtattgaaatttaaatctagaaattggagctgggtgcagtggctcaggcctgtaattccagcacttgggaggccgagctgggaggatcacttgactacagcagttccaggacagcttgggcaatgtagcaagactctgtctccaaaataaaacaaaataaaataaacctagaaattgggctctagagaaaagcactgaattagttgtcttttttttttttttccgaggcagggtcttgttctgtcacccaggctggagtgcagtggcgccatctagagtcactgcaacccctgcctccagagttcaatggattcttctgcctcagccccctgagtacctgggattataggcacctaccaccacacccagctaatttttgtatttttagtagaggcattgtttcaccatgttggccaggttggtcttgaactcctgacctcaattgatccacctgcctcagcctcccagagtgctgggattacaggcatgagctactgcactcggcctgaattagttatcttacagcataaggctgcaatgtaagatgtgtcttgtgggtatcatactttaaaagctcaagcattctaaaatctaatcttatactttgtttctgtaagtcatactttttaactatttgatagtaaaatatgagataaaaatcaaccctccattgtaacgtttgtactctggttcttgatgtgcaggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttggtcctgctctttttgtccattttattttattttgagacagagtctcgctctgtcgcccaggctggagtgcagtggtgcaatctcgattcactgcaacctctgcctcccgggttcaagtgattctcatgcctcagcctcccaagtagctagaattacaggtgtgcactaccatacccatctaatttttatatatttaatagagatatgatttcatcacgttggccagggtggtctcaaactcctgacctcaagtgatctgcccgcctcagcctcccaaagtgctggcatttcaggtgtgagccaccacacctggcctctgtccataataactgtggtgtgatcaccattaagtatgggaaaacacctttgaaatc

SEQ ID NO: 333 - DNA, 73104 bp, Homo sapiens
ggtcaatgagattaagcaaacaaaactgagacctagatctcactcttgaggaagaaggaaaacatatcaacaactaccaaatgttgacttctgccatattgttcaatgccaacagacttaattttttttttcttttttttttttttttttttagatggagtcccactctgttgcccaggctggagtgcagtggcgtgatctcagctcattgcaaccattgcttcctgggttcaagcaattatcctgcctcagcctcacaagtagctgggactacaagtgtgtgccacgacacctggccaaattttgtatttttagtagagacagggttttaccatgttggccaggctggtcatgaactcctgacctcaagtgatccatccgccaaggcctcccaaagtgctgggattataggtgtaagccaccatgtccggccagagactcaatattctaattaatgtggataactgaagtatgttacaaactgaggcaaagtttttgtcaatctacctctaaaaatacttcccacttaaaaaaaattaagttattaaaaaaataaaacttacaattcgtttcttccaaaatctgtatttcgggctcgttaacaacaactccttagtcacaggtgaacagtatagataaaccttcaagctgaaaggaaaaaagaaaaaaactttcagtacaatccaaaatgagccatcttggtgactaagaaatctatttcatcatacatctaataatttcatttgagaccagtctgaccaacatggtgaaaccccatccctaataaaaacacaaatactagcctggcatggttatgaaatctatttcatcatacatctaataattcagaaattacgctggcacaaaatctgttagagtcactctcaacatacctatgcacaccatttcagtgccaccaagagcacaaggtgggggtggaaacacggtgtccctggacctcctccaacagtggtccctcaccattgttacttggaaatacgcgcttgtatgtgatcaggtgtgtctggaaagataccgccacacattacactacctctggaaaaggtgtgttgagaacagaaacttctgctttttactgtataagtctattctttttttttttttttttttttttgagatggagtcttgctctgttacccaggctggagtgcaatggtgtgatctcgtctcactgcaaactccacttcccaggttcaagcgattctcctgcctcagcctcccgagtagctgggattacaagcacgcgccatgatgccggactaatttttgtatttttgtagagatggagtttgaccacgttggccaggctggtctcgaactcctgacctcgggtgatccacccacctcggcctcccaaagtgatgggattacaggcgagagccactgcgcccggcctattctttttttttttttttaatgaacagaaattaatttcataataaactttttttttctttttttttgagatggagtcttgatctgtcactcaggctggagtgcggtggcgcgatctcggctcaaagcaaccttccgcctcccgggttcaagcgattctcctgtcttagcctcttgagtagctgggactacatgcgcaccaccacgcccagctaactttttgtatttttaatagaaatggggtttcaccgtgttggccaggctggtctcgatatcctgacctcaactgatccacccacctcagcctcccaaagtgatgggattacaggcatgagccaccgcgcccagaccataataaacttttaaaacttaacgctatcattttgaggttaggaatatagtctacggtagattgtattttccaaagatggccacacaatgacatacaccatccatacatgctctccttacaaaatagatactaaaattcctccactgactggcggggtctatgttccctccccttgaacctgggcagttttctgtaattaccttcaccatagaatgcggtggaagtaattgcatggcttttgaggttagatctccaggtagtacaacttcctcctagctctctcttaggacatacgctttttaaccctgagtctccatttaacaggtctggccatcctgacagactcacgctaaagagatttttttttttagggggaggggagctcactgtcacccaggctggaatgcaagctatcctcccacatcagcagcctgagcacctgggactacagcacatgccaccacacctggctcatttttcctattttctgcagagatgaggtctccctacgttgcccaggttggtttcaaactcctatgctcaggtcatcctcccacctcagcttcccaaaggcctgggattataagcctaagccactacgcctggcctaaagagacttttagagatagagatgccgcacgcctgtaatcccagcactttgggaagccaaggtgggcagatcacttgaagtcaggagtttgagaccagcctgaccaacatggtgaaaccccatctctactgaaaaataaaaaattagttgggcttagaggcacgtgcctgtagtcctagctgcttgggaggctgagctgggagaattgcttgaacctgggaggcagagattgcagtgagccaacatcacgctactgcactcctgcctgggcagcagagttcgactctgtttcaaacaaacaaacaaacaaacaaacaaacaaaaaaacatgccaaatggttctagcccctagctgtgtgagttttcccagcccaggtatcagacatggataagggagtcttcagatcttaaggggctgacatctgaagactctgctcactgatgtttgatacctgggctgggaaaccattcccattctaccctgtcaatccctgatccacagaaactgagcaataagacatgatcagtgttaagtcactccattttgaagtaatttgttacgcagcagcagatgactgatacataggctctgcaatcagacagacctggctggaatcctggtcctgccacttactggctgtgtgacactgggcaactaatttaacctctctggttcctcagtttcctcatctgtaaaatagaaataatagtaggatctattcaaaaggttatcaagaagctctaatgacaatgtcaggtacaagtgtgcagagccttgcatctgtgtggctcactaatgcattctccacctccagtacaatgcccgacatgtcacaggtgaccaaaaaaaattactgaggccaggagtggtggctcatgcctgtaatcccaacactttgggaggctgaggcaggcagatcacttgaggtcaggagttcgagaccagcctggcgaacatggtaaaacccctctctaccgaaaatacaaaaagtagctgggcgtggtggtgggtgcctgtaatcccagctactccggtggctgaggcaaaagaatcactcgaaaagaagttgcagtgagctgagatcgtgccactgcactccagcctgggcgacagagcaacaccctgtcacaaaagtcaataagtaaatacaaataaagtaataaaaaattattggccaggtgcaaaggctcatgcctataagcccagggctttgggaggccaagatgggagatcacttgaagccaggagtttacaaccagcctgggcaacatggtaagtccccgtctctacaaaaaaaaaaaaaattgttgaacaaaaaatacacagtgccaagatacagtaagtattcaataaacgttagctatcattatcaagaagacagagtattgctatcaattagcagagaagcctgacatccactggcccttttcaaatatgtatcttgagaagggggaatttagatgtaggcaatggctgcaagagaagcatctaacagttcagctttaagaaaaaatccagtattatatgatcctttacaatggaacagccattctctctcatatactcttacagaaataacatggagtgagttactgctgtacctagcagcatagataaatcacacaaatacaaagttaagtaaagtaaaacaaatataaaagggtatatttggggccaggtgccagtggctcacatctataatgccagccctttggaagaatgaggcaggaggatcacctgaggccaggagttcgagatcagcctgggcgacatagcaaaactccatctctgttttttttgttgctgtcgttgttgttgttgttgtttttagagagtgtatttggtaggattatatatatatatatatatatcaagttcacaaacagccaaagctaacccatgatgacaaaagtcagaatagaggttacctttgggaggagggaatgagttgggaggtaagaggggtctgggatattggtactgtcctatttcttaatctgggtgatgcgttcattttgtaaatgactatatgcttggatgtatatacttttctgtacagttgttatctctcaattaaaatgtttgcttaaaaacacaagtagcaaaataaattacctgcactccaaccttcttttcaaggtaggggctcttaatcctttcatgtgatctaaaaacaaaagaacaaaaactcatgaatatgtttttccagaggattccttagcccaagggaaacagtcgtcttctttttcagcttcaagagaaaacccatgaggtttgcttttataagaattgattcacatgggctatgagctctttcttctgcaagtgaagaatcctcctcagaacaggaccggctgcccatttctgagccatccaagtcaatttaaaaggagagtgattctgtgcatcataggccagagtttaaatcactctgggcagccacagaagaatgagaactgcttctagccctccactcttacttcatttcaatccaaccatccttcgagccaagctctatgggacccattcactttctgccacttaaatcagtctatctagaaattcaagttcgtggtcatggagtctgctgggaaatcactcaggttcagagtaagtgtttcgtcatcttctcagcctactgtgatggattgaaaggggaatattactatccacaaagacttgctccacagcgctccacattaacagacacagacaacagaaaggtagcaattagaccgactattacattaagtatatcatgcattccaatatattctgaatctttagcaagtaaaggcccagacaacaatgatcaaacagctctaaattgtttaactaaaccagttggacatggtggctcttgcctgtaatcccaacactttgggaggccgacgtaggcggatcacctgaggtcagaagttcaagaccaaccttgccaacatggtaaaaccccatctctactaaaaatacaaaaattagccatgaatagtagcacacccctataatcccagctactcgggtggctgaggcaggacaatcacttgaacatgggaggtagaggttgcagtgagccaaggccataacactgcacttcggcctgggcgacagagtgagacttcatctcaaaaacaaacaaacggctgggcgcggtggctcatgcctgtaaccccagcactttgggaggccgaggcaggcggatcacctgaggttgggagttcgagaccagcctgaccaatacggagataccctgtctccactaaaaatataaaattagctggggctggtggcgcatggctgtaatcccagctacttgggaggctgagataggagaattgcttgaaccccgaaggcagaggttgcggtgagctgagattgtaccattgcactccagcctgggcaactagagtgaaactccatctcaaaaataaataataaccaaaaaaaaaaaaaaaaaaacaagaacaataaattgcttagctaaaccaaaccaattctaattaccacgagcaccaccacacacacacacaagcaccccctcaatttatatgtcgtgtggccatcattagacccagtgaaagcagagcagtcaccacatgtcacttggcagcccttgattgtatatatgcctccaggagagtccacctgtctcccactgggtaaattccctcaagggatatctggtccagtcttttagggcctatgggtatatccctgggcagcattctccgtaattggagtttccaaagagtttgcgccatggcaaagaggaggctgaatgcagactctgcatcctgctcccacactgactaagcaggcagcaccctgcatggtgcatcatggtcccccatcctcaccaccctgaggccccttccagctggtagtcacaagaactggatgggtttgctttgtgtggctggaactgcacccaggtctgcttttccagggaggttttccttttccttggcaaccatcataaattgtcccctctaggggatttccccaaccctgggccactatctcaggtctcaggggtcggggggccctctcatctttcagaacttactgatgatgcttagtaaagcccaccctgcacacagcattggcttccagatggcccacaaataagcatcaggtgggtccatagcctactccgaattatatcaaaatgtgatgtggggctgggtgtggtagctcacacctgtcatcccagcactttgggaggctgaggtgagtggatcacctgcacccaggagttcgataccagcctgggcaacatggggaaatcctgtctctctataaaaaatagaaaaattagccaggcatgatggtgcatgtctgtaatcccaactactcaggtgggagtacttgctgaggtgggaggattggttgagtccaggaggtgaaggctgcagtgagccgagatcgcaccactgcactccagcctgggtgacagagcaaaaccctgtctcaaaaaaaaaaaaaaaaaaaaaaaaaaaaaaaaggaagtgatgtggatgggtttccatgcattttttctagcaaaagagtccatacagtttctcatgtttgagctgctatcacaagataccatagataccatagttggccttcacaccagcgctgtaaggaaaggtagtgttttggttgccttcaacaccaaaaaggtatttctcacagttcaggaagctgggaagatcaagatgcggggcgatttggtttctggagagggcacttttcctaacttacagacagccgccttctcactatgcactcacatggctttcctaggccccgcatgaggacagagcgccctctctcttccttctcttgtaaggaaactaatcctatcagagtaggacaccacggtaggaccccacttaaacttattttcctcctaaaagccccagccccaaatacagtcgctttgggggttagggcttcaacatatgaattttgtggagatagtccatatcataatcaaagaagcctgtgtcccaaaaaggtgaaaagccaacagaaggcaatgtgagaaacctccaaaagcagaagttgtgttttcacccttgatgagtttatgtcctggttgactaagcagatccacatgtggtcagagaacagaaaaagttgttatagactgttcaacagtagggaagagtccatttctggcttaatgcacaaacttatgatgatttcaaattcctttagatttattatttctccaaactcagccatcctaaacacgaagtgcaagtttcggaagtatactttaatcctggctagcccattttgagttcagagactccagtgcggctctacacaaaaagtaaaaataggcatatcctcgtccagcagtggattctcaatgaaaaacaaaaccagaaatgtgtcaggcacagcggctcacacctgtaatcctaacactttgggaggctgaggtgggtggatctacctgaggccaggagttcgagaccagcctggccaacatggtgaaacatcatctctactaaaaacacaaaaattacctgggtgtggtggtgcgtgcctgtaactccagctacttgggaggctgaggcacgagaatcgcttgaacccaggaggcggaggttgcagtgaacagagatcacgccactgcactccagcctggtgatggagactccacctcaaaataataataaaaatacaaacattagctaggcatggtggctgactcctgtagtcccaactacttgagcagagagcatgtgccacactgtactccagcctgggcgacaaagggagaccctgtctccaaaaaaaagaaaaagaagaaggagatgctcaaagacgtgcacgatgcgaatacggcaacgcacgagaagaggtccagattttcccattaaagagaaatcactggtggctttgtggaaaaaaaaagcagagacatttcgcagaagcagtaacttcaacgatttatagtccaagtgattgattccacacacaaaacaacatagctggccttcacaccaaccctgtgaggaaaggctgtgtttggatacctgtaatttactttaaaatactttcctactgcgcaggtacagataggtttgttacgctgattgactccacagggtagtgggagcttcctgctccagcacgctgcaaggccacacagcaggaggcagcaactccagtgattccgtttatcattttctccaattaacactaatggctgggcgaattagcacaatgagcattaaaactgttttccctggtaaaagttagtgacttgttagcacaatagaagtgaaaatgaacaatggttgtcaagttagcggtatttaaactctggaacttagctccaatctctgcttggagcatcagcgacactctaaccttaatccctaaatcggcccagctgtgaaaggatccagctgtgaaatcatagtagcttttcaggttgcctgataccatctagaagggaaacatccctccaacctaaactagaacgaaactttcatattggatacggacagaacacccaaaggccaaggagcttgcacttcgtggagctcttaggcgggctgttccacagttgtgtgtgtgtctgagtctcctgcttgctgaccaatgtttgagggtgtggtcaaatggatctgaaacttgttttcttcatacatggtagcgaggctctgagggaagtactaaccctcgccaatctctgatcatcggccaccagcaaagctaccaagagaaactactagcagtgcttgaccaagccggcccggggcgcaactggcaggcgccgttacgccgcgttgaccacatccgaaaatagatgaagcctttgagaggctgaagagcccgactgggacaaggcgtgtgctggccgccccctcgctggcttcccacaggctgcagctccttgctccagggccggccccctcctgtcctctctccagcccccagcgccccgggagcgggcgacgcgcagccctcactcacctttgtggcagtgggacaggaagtaggcgcgggccctcaggttctccctatcgaagcggtctatggagatagttggatactcggccatctgcccctcgaaagaactcatagcgccgccgatcccagagtccgggaccccaaaaccgcagctgaagccaaggccagccctgaccgcgccgccacttccgggaagccgcgcgctgcctcgccattgggcggccgaacgcagccacgtccaatcagaggagtccggagaccgggggcaaagtcaaggagcatccggtcgggttctaggcgcccgctgcttgggtttaaatcacccgcgcttcgctgcacgcgatgggccctgagccctgcccagtgcaaggctcattcccgcccaacaaacacaggtgttgctctggtaaggcgttgcccatgtctgtggaggtgcagtcgcgggaagggaaatcgaaactcccagagcaggtggccccagccgacgaggtgagtgggctgcggaactgcgcttagaaatcattcttcgttccgcttcctgcttgtctgctgctagcctgaaacccgagctcagttccccgccctctctcttctgttcccaatttctaaccttgtgggattaccgtgagggttgtatgagaaagtttgtatctgactcatggtagattcaggaactattaattccctcttccgtttatataatctacaaactgaataaatcatctctgcgtgatcttggggcaaataagatcccaataatgccttcgctgctggcctctcccctgggcccccacctttttgagctatacttttaggaagttagaatgatgtacttaaaaaaagaaaaatggcaggaaaggtctaaaattttttaacaaccaaagcaactttatgaaaaggtttgttaaaccttttattgtatttcctttattgtattacaataaaccaaataatcaccatgacatttattgtgctccttcctatcaaatctccttagtataattaaacacaaacaacccagaacactttcgctttattttatttatttattcagttggggtctagttctatcgcccaggctggagtgcagtggcgtgatttcggctctctgcaacctccgcctcccgggttcaggcgattctcctgcctcagcctccagagtagctgggactacaggcacgcgccgccacgcctggctcatttttatatttttagcagagacggggtttcaccacgttgaccaggctggtctcgagctcctggcctcatgcgatccgctcgcctcggcctcccaaagtgctgggtgagccattgtacctggctttccaggcctccataacacttgaagtcccactttgtgcacagcactgtgacaaaccttcgggtagcattcaatctatctggcgacaacatgtttgcagaatatggcaaataaatgcttccacagagacgcaaggtaacgtgagaacaaatccaggaacaaagatttctgaccagggaaatcaggaatcagaatgccatcccagcccacctcagtggctcatgcctgtaatcccagcactttggagggctgaggcaggtgatcacctgaggtcaggagttcaggaccagcctggacaacatggtgaaaccccatctctactaaaaatacaaaaatcggccgggcatggtggcacacatctccagctactcgggaggccgaggcaggagaatcacttgaacctgggaggcggaggttgcagtgagcctagatcatgccagttcactccagcctgggcaacagagagagactctgtctcaaaaaaacaaaacaaaacagaatgacatccctagtgaatgtcagcttgtgcctgtagccatgatactcagagttctattcaaatacagatttccatgaaatcttgaggagggggaggaggggtgacatggaaaggtatacacaacataatcactaattgaggtaaaatatcctgctagtatactactggcaacacctttgatggtttgtcttagaacacatgggaacaactgccctggcagggttatggagacctaacaacaaattctgctgtgagtctagtgtccgaagaatctcacggtagagctccaggaaaggcaggtcaagttaatgctcgtgatcttatgtatttgctcacttatttatctcctcctctttccacaatggatacagtacaaacaaagggaaatagagtcaggacaaagagaaagacaggatagaaaataggcaagataggtaagcatagcccagaccaaacctagtgaatcagaaactctgggagagtggggcctggcagtttgcagcttaacacaccttctaggtgattctgatggaccctaaagtttgagaaccactggattcgagtctaaagaacattcagggccagtgtggtggctcatgcctataatcccaacactttgggaggccgacgcaggtggatcacccgaggtcaggagttcgagaccagcctgaccaacatggggaaaccccgtctctactaaaaataaaaaaaaaaatagccaggcatggagtcaggggcctgtaatcccagctactcaggaggctgaggcaggagaattgcttgtacccaggatgcggaaattgcactgagccgagattggaccatggcactccagcctgggcaacaagagcgaaactccatctcgaaagcaaaacaaaacaaaaaaacacaacactcaagaagtctggggcaggaattcaggtaggaagctgctgcaatactgcaggaaatgtgatggtgaagcttaattcattcagcaaatcattcactgaccatctactgtgtatcagacactattttagacactaaagatacagtagtgagcaaagtagacaaaaaatgtggcccatcctggtggctcctgcctgtaatctcagcactttgggaggccaaggcaggtggatcacttgaggccaggagttaaagaccaacatgacaaaaccccagctctactaaagatgcaaaaagaattagccgggtgtggtggtacacctacaataacaactacttgggagctgaggcacaagaatcacttgaacctggaggcagagattgcagtgagccaagatggcaccactgcactccagtctagacgacaaaagagaccctgtctcaaaaaaataaaactaaaaaagcagacaaaaatccctgtggacgtgggagtgtaccttctaatgcaagtaattactgtctaccatttatgtagttccagatgttatcagtgttttatactcattatttcatcctcacatcctacctgcccatcagataggtacactttctgtcctcatttgccagttgaggatacggaggttaagtagcttgtccagggtcatgttgatagtaagtagagctcagatttaaatccaagaaggccaccacacttttagacactgtgctctctgacaacacactgctagccaccgtgccatgctgcctccacagcatcggaagggcagtgatgaaatatactgattcaaaatatatccctttagcacctactgtgtgctaggcagtgttaggccagtgtggctgcagcagaatgatccggggctacagaggaaggagggagggtgttgtgagcaaatcttacagggctttgctcaccatgtatagcctctggttttcactctccataagatgggaagccattgcagggttgtgagcagaggactgacataatttgacttaggtttttttgttttgttttctttgagacggagtctccctctatgcccaggctggagtgcagtgacgcaatctcggctcactgccacctccacctccacctccacctcctgggttcaagcgattctcctgcctcagcctcccgagtagctgggactacaggtgcacgccaccactcccagctagttcttttgtatttttagtagagaaagggtttcaccatattggccaggctggtctcgaactcctgacctcgtgatctgcccacctcagcctcccaaagtgctgggattacaggtgtgagccaccgcgcccggccttgacttaggttttaaacagattgcattgactgttgtgttgacaacagactacagagggggcatagagagctgttgggaacggttgtaattaccagaaaaaagaaaaattatgatggcttgagtagaagctataaagtcagcaggttgcattgatggatatggaaagagagggctctaggccacatctactaaaagacatgaagaaggagcagggtttttgtttttgttttggcagggaggtgtttggggaggttgttttgtacaatcaagtggatgttgaatatacattgatatacaaatctaaagttcagagaaagaccgggctgaagagagaaatttgggagttgtaagtaaatagttttttgtttttagttttactaagtattgcctttgttttagtatgactcgtttatttagaagtttatataatttaatttgtgatatgtcttgtgtttttgttttgtttggggcaggtgcccgaggcccttgtcatcttcattgactccagctcatggcttgtatttaacaacgagctcagaaaaattcctaaaaatttaattactgagtctccagagctctaatgagctggctccagcacacaattgctcctttctttcattcaacaatttgacaagtcctgatggctctacattcaaaacatgtaaattggccgggcgcggtggctcacgcctgtaatcccagctctttgggaggccgaggcgggtggatgacgaggtcaggagatcgagatcatcctggctaacacggtgaaaccccgtctctactaaaaatacaaaaaattagccaggcgtggtggtgggtgcctgtagtcccagctactcgggaggctgaggcaggagaatggcgtgaacccgggaggcggagcttgcagtgagccgagatagcaccactgcactccagcctgggcgacggagcgagactccgtctaaaaaaaaacaaaaacaaaaaaacaaaaaaccgtatatcttgaatctgatcacttttcgcttagatagtactgtaatatagtaatagataatgctagaaaaaataattaaagctatagatatcatctattgtaggtttactgattgtcaggcactatggcgactctctggaatggttcattcctcgcaaatgaatagataggagatatctactatcaggaactacaaacacagtctccgtgctgtgatccgctttcacagggaattttgtctgggattcaagtagcggcaagtaaccctttttcgccctccatctctgctcaggggtgagccctggcagcgctcctacctgggacctacattggcttagtaagatgggccggcgcccaccccagccctcgcgcatgcgcataaaagcccactcccgggggcggggcctgagctagctgggcggggcctgaaggagccgggagctcctgcagcttcatcgcgttactaagagacgcgagggtcgcgaagggcacaacacttggcctctcgctggccctgctcgcggatcccgagtagagaacgcaagcacccacgcccgcctgcaagctcccgggcgcccccggcctctcctgctcggcggaacgaggataacccagtagagccggacccaggggtgggtggatgcgtcgctggaggcgagggccctgcccgccaacccctgcgccccggccgtagccccaccccggaagttcttgccccgccttctcggctccgcagttctctgctgtctcctgaggtttgccagggagatcccgtggttttcatgtctcttccgtgatttttagggaagagggtcactatttggcccttccagaatctcagggtccggttctcccggaagtttccgggccgccccggaccccattggctttaggggccgcgtctccgagggctccgatttgggccctagattttggaatactgtgttttgtccgtcccagccttcaccaggcggatttcatctcccacacagttagtgatttatggcagaaaggaagctggagggatggggactgcaggttagctgtgagggccggaagggagcggttttgtgctgcacacaggcaggtcagcactcccagagcagggaccgccgggcgtgctttcggaaccgcttttgtctttcaaatgaacgcccagcgacagcagacgggagttccaggaccttagagaccggctaatgcttctctttaagttaggaaacaggcgcaggcgtgttcatggccttgcctaaggttacgtgctggttacagggctcctcctgctgcctcttaagaacagaaataatctaataggaggaataaaagggactattagggaggctaatgctcttgaagttttaatactactaaaagtaaaagcgcttttcagagtgaaagggaagtgaaaagggaatttgggtggctggctacatcagaagcttctgttccaactttagattgtcagggagttgagatggtgttttttgtttttatttttgttttagttttttgagacggagtctcgctctgtagcccaggctggagtgcagtggcgggatctcggctcactgcaagctccgcctcccgggttcacgccattctcctgcctcagcctcccgagtagctgggaccacaggtgcccgccacgatgcccggctaattttttgtatttttagtagagacggggtttcactttgttggccaggatggtctcgatctcctgacctcgtgatccacccgcctcggtctcccaaagtgctgggattataggagtgagccaccgcgccgagatggtgtgtttttaaaataacgtgcccgaggccgggcgtggtggctcacccctgtaatcccagcactttgggaggctgaggcaggcggatcacctgaggtcgggaattcgagaccagcctgaccaacatgggaaaacctcgtctctactaaaaatacaaaaaaattaaccaggcatggtggcgcatgcctgtaattccagctactcgggaggctgaggcaggagaatcgctttaacctgggaggcggaggttgtggtgagacaagatcacgccatggcgctccagcctgagcaacaagagtgaaactccatctcaaaaaaataataaataaataaataaaataacatgctcctcaatttaactatgggattatgtcccaatacacccatggtaggtcgaaaatgcatttaatgcacctagccaactttaaacgtcctcagaacacttagctcccctgcagttgggcaacatcatctaacacaaagcctattttataataaagtgttgactatgtcatgtaacttactgaatactgaattcaaagtggaaaacagaatggttgcgtgggtactcgaattactgaatgcgtattgcttttgcaccatggtaaagtggagatatgagttgaaccattccacgggaccatctgtatgcatataaaccctaagtatttcatataattcagtttcacaaaccagaaactcaggcattgctgtttcctgtttgtggagctacaacttggtattttagatgtcaaatttatttatttttttgagatggtgtcttgctctgtcacccaggctggagtgcagtggtgcgatcttggctcaccgcaacctccgtctcctgggttcaagtgattctcctgcctcagcctcccgaagtagctgggactacaggcagccgccaccgcatccggctaatttttttttttttttttttttagtagagacaggttttcaccaggttggctaggctggtctcgaacccttgacctcaggtgatccacctgcctcggcctcccaaagtgctgggattacaggcgtgagccaccgcacatggccaaaacgtttatttttatttatttatttttttaacatttttttcttgaggcagggtctcattcttgtctcccaggctggaatgcagtgacttgatcacagctcactgtggcctcaaccttgggggatcaaacaatcctcccaccttagcctccccagtagctgagactacagtcatgggccaccacacccagctaattttattttttgtagagatagggtctcactacgttgcccaggctggtcttgaactcggactcaaaggatcctccctcctcagtctcagaaagagctgggattacaggtgtgagccgctgcatccagccattaaatgtattttttatcaattctttttttggcacaactgccagcaaagaaaccactcagtctgcaagagctaagtactagcagaattagaactgccactgaatttcctagaatcactgaaaaatttaatcaaggaattgtaagttgatctttcctaattttagtttcattttgtgtttttaataaactgaaagtaagggcaaaaaaaaagaatttccaccaccacttatatagcgtagttacagtagtcactagagttcctactatggtgaaatttacattcatattctctttaggtattttgggaaaataaaattttgaaatgcttaataataaccggaggatgtctatttctactgagaaaagtggtgatttcccccaaagtccaattgaatacagcatattttctgctcttctattaaatgtagcatttttatgtatagttgccataattttttgagctgaaagtgacaaaaggttacatagatggcattcaagaaaatacgtttcgaatgaatatgagcaaaaagtcaagcctaaagcaaaaagggcatagataagacaaaaattaagattgtatcactacatgtgcttcatctgtaaaagtcctgtaagtaatacagtcactaaattcatataaaaatatgactaatttggaattttttttttttttctttttttcagacagtctcgctctgtcacccaggctggagtgcagtggcaccatctcggctcactgcaacctccatctcccaggttcaagcagttctctgcctcagcctcctgattagctggaattacaggcatgcgccaccatgcctggctaatttttatatttttagtagacacggggtttcaccatcttggccaggctggtcttgaactcctgacctcgtgatccacccacttcagtctcccagagtgctgggattacaggcgtgagccaccgtcctgtcctgaaagtattttaatacagtgaattcactaacttttttttttctctcttaatttagacagagttttgctcttgttgcccaggctggagtgcaatggcacgatcttggctcactgcaacctctgccccccaggttcaagcaattctcctacctcagcctcctgattagctgggattacaggcatgcgccaccacgcccggctaattttgtatttttagtagcgacgggtttctccatgttggtcaggctagtctcgaactcccgacctcaggtgatccacccacctcggcctcccaaagtgctgggattacaggcgtgagccaccacgcccagcctaacttttttctttaatatttcttagaacctttttcctgtgtaatatatctatattcctgtgtaatgtttcatattatatatatgaatggattcttaggctgtatcacatgtccaactcacctctttgtcatagctggtatattgctattatattgtgcagcagtggagtagtgaacttcccactagaatgaatggcattaaaggacaaaggtttcactgaagcgtggcttatttgttttgccaggtgttccaaattttacataaactcgtataatactgtaaaactggaccgggtgcggtggcttacacctgtaatcacagcactttgggaggccgaggtacacgatcacttgaggccaggagttcaagaccagcctgagaaacatggtgaaacccatctctactaaaaatataaaaatttggcaaggcgtggtggctcacgcctgtaatcccagccttttggggggctgaggcaggcggatcatgagttcaggagatccagaacatcctggctaacacagtgaaaccccgtctctactaaaaatacaaaaaattagctgggcatggtagtgggcgcctgtagtcccagctactcaggaggctgaggcaggagaatagcatgaacctgggaagtggagcttgcagtgagccgagatcgcgcctctgcactccagcctggtgacagagcgagactccgtctcaaaaaaaaaaaaaaaaaaagaatacaatataaacactataatatttagaatgttaagtaatttaacaaaaatctaaataggaagagcattagaacatctttcttgtttttcatagaaaagagtccattggtacttgtgacttagcctcctaacagtcttcattatctttttttaccaaccactaagggaacatttaggctacatctttcatattgaagaaatatttgtctgaaattcagcaagtctgtctattttatttccatttcctatttttcctctattaaatccaagtgaagctaaatttatgtcttgtaaaagcatttattagaagatccttttaaataaaacttttaagtctatgttaattaatcgtatatttagcatgatttttacccagtatgaaggatggatatttctaattaatgtcatgcttattttgagttttcctttatatatatgtatataagagtgtgtgtgtgtgtgtgtgtgtatatatatatatatatatatatacacacacacacacatatatatgtatacttttttttttttttttttttttggagccagagtcttgctctgtcacccaggctggagtgcaacctccacctcctgggtttcaagcgattctcaagcctcagcctcccaagtagctgtgattgcaggcacctgctaccacgcccagttcattttttttttttcctttttgagaaggagtttcgctcatgttgcccaggctaaagtgcaatggtgtgatctcagctcactgcaacctccacctcccaggttcaagtgattgtcatgcctcagcctcccaagtagttgggattacaggcatgtgccaccatgcctggctaattttgtatttttaatagagacggggtttcaccatgttggccaggctggtcttgaactcctgacctcaggtctcctgacttcagtctccccaactgctgggattacaggctcgagccaccatgtccagcctttccctgttatacctttaatgtatttcttgaccttttaaacataatgagcatttgttattgtgattgaaaaaaattcataaaatattaatttatttacaggatctgactttaatgtgtttcagccaatagaaatatattttaatagaagaatgcattcaaggaatcatagtgaaaattctgtacactttatttcagttaaatgactgatatattttgttaataaaataagtagctgagaaaacaagtgtaagattatgcctttgaaaaacttgctatggaagttcggtgaatagacaattacatgaactaaagtcgtatattagactttccaagactattagtgacctcctacactgtttttaaatccatggtctcagtaccacgacagccacacagtgtgcatggaatctgtgttaggccattttctcacattagttcatcaaaagatcaggtactacagtgacctcagtaaatgaattgcagcaattgggatgtctccaagcaattaagaagtgaaaaagaataaaccatcccctcccagaaacaagaaagcgaacagagtgagaagacgggtcttacattccctttttgagagagagagagagagagagagagagagagagagagagaggtgcagctttgaatataagtaatggaatggtggtggatattttgacaatctactgagcatgttttcagaaatgtgcaaactattacctggaactccagtatttgcatacagcttttagaacatcactccgtaactccaactctgactgggattttattgataaagaaaaaaacagttttgtatgtatctttcagggacttggggttttttttgtttgtttcttacagttttatccccacaaaatagagcatgaatccttctcaatcttggaattgtatgtttaaaaactactatatttaatgggattctcaactctaagtataatttttaagtgttagttttatttattctttttttttttttttgagatggagtcttgctctgtcacccagcttggagtgcggtggcacaatctcagctcactgcaacctccacctcctgggttcaagccattctcctggctcagctgccccagtagctgggatgacaggcgtgcaccaccatgcctagctaatttttgtatttttagcagagacggtgtttcaccatgttggccaggctggtctcaaactcctgacctcatgatccacctgcctcagcctcccaaagtgctgggattacaggtgtgagccaccgcacccggccagttttgtttattcttaaagggaatttcaaaattgtcactattacattatccattaatgttgttttaacatctttcagatattattgataataaggcctctgtaaccatggctagttctgacgtaaaaccaaaatcagtaagtcatgccaaaaaatggtcagaagagatagaaaatctgtacagatttcaacaagcaggatatcgggatgaaaccgaatatagacaagtgaaacaagtttctatggtaagatttctgtctctacaaacctcaactcgaaatgtatttctcagatgctgaaaagtattttataaacaaccagagaataactgaaggaaattcgactccaactctctcattttatttgttttcttttatttacttttattttattttttgagacagagtctcattctgtcacccaggctggagtgcagtgacgcaatctcggcacactccacctcccggattcaagggattctcttgcctcagcctcgtgagtagctgggatcacaggcgtgcaccaccacgcctggctaatttttgtatttttgtagagacgggattttgccgtgtttggccaggctggtcttgaactcctgacctcaagtgatccacgcgcctaagccttccagagtgctaggattacaggcaatagccaggacgcccagccagactctctcatcttattaacggggagaggcccagaagaatgatttgcaggcagagtgggagaagaggtggtcgtttagctgggcacattcagaattttctcttttattgagcaactgtgctctgctaaatgaatcttttgcggtagaccacaaaaaaaaagcttttttcctcactcaggtgatttcattatcagataatcagtatgttgggtaactattatttccctcctgttactttttattttaaccatgaattagaaagaggttaaaatcctgtggtttttggggcaattataccttacaaacaaaagtgttagaacaactcgtgactttgatagtatatcccaggctttcctgagagggtagagacctagctttgctttatgaaggctagaccaaagtctagatttggctcccgtttatacagtgtggttcttcttaacttatttattctcttggctactaagatattttttttttttttttttgagacagagtctcactctgtcacccaggctggagtgcactggcgcaatctcggctcagtgcaacctccacctcccgggttcaagtgattcttaagagacgtgtttttacaaattcagttcacccctgaacaacacagggactaggggcttcaatgcttcatgccgtcaaaaatttgtgtataacttttgactccccaaaacaactactagtaacctagtgttaacagaaactcttgcccataaggtgaataattgatcaacccaggaatacactaatatcttgatatattttatgcattcatgacaaaccttttcttaattatttttgatatttatagtctgtgtggtttgcaacttttttcaaatcgttgcaaatctcaaaaaaaatttcaacaaattttttgaaaacaatccatgtatatatggactccccaagttcaaacttgcattggtcaagggtcaactgtattgtaaaatatgacatagtattcataaatatattttaatttttagatttgggattataacagtgtttattaactcagttgtttatttttattttttactaactcatcatttttcagattctaatgtgtagattttgcagatcactataagctcttctttttcttttattctattctttgacctctacttaaaaattcctttaaaagtacataggaggctgggagtggtggctcacgcctgcaatcccagccctttgggaggccgaggtaggcagatcacttgaggtaatgagtttgagaccagcctagccaacatggtgaaaccctgtctctactaaaaatacaaaaattagccgggcatggtggcatgcacctgtagtcccaactacttgggaggctgaggcaggagaatcacttgagcccaggaggcagaggttgcagttagctgagatcacaccattacactacagcctgggcaacaaagcgaaaccccatctcaaataaataaattaattaattaaattaaaattttaaaagtacataggaaaaataatggaggcaatacggaactatcatgttattacctctttaatagacattaatttaatgacattattgtggttaacaatagaatttaaaatactgatcaagtgaagattgattactgtgacttccatgtatctgtcttctcaaccattatactctatccccattgccaaggataattttcattactatatcatctatggcttttaaacagaaaaaacagaagcattatcatttttatgctgtttaaaataagctttgggctgggcgtgttggctcacacctgtaatcccagcagtttgggaggccgaggcaggtggatcatctgaggttgggagtttgagaccagcctgaccaatatggagaaaccctatctctgctaaaaatacaaaacttgccaggcatggtggcacatgcctgtaatcctagctattcgggaggccgaggcaggagaatcacttgaaaccaggaggtggaggttgtagtgagccgagatcacgccattgcactccagcctgggcaacaagagtgaaactccatctcaaataaataaataaataaaataagtttcataccctgccttaagattgggatgcccctaaagatacacaagcctcagactcataggcggccagctgtggtggcttacgcctctaagcccagtgctttgggaggctgagggtgaaggattgcttgaggccaggattttgagaccagtctgggtgacatagtgagaacccatttctacaaaaaactttttttaattagccaggcatggtggagtgtctctgtagtcccagctactgggaggctcaggtgggaggattgcttgagtgcaggagatcgaggctgcagtgacctgtgatcacatcactgcacaccagcctgggtgagagagcaagaccctgtctcaaaaaaaaaaaaagaaaaaaggaaaaaagaaaagaaagttgtcacaagaattaaatgtaatcacatgtttgaagtgcctgacattatagtgctcataatttgttgggctgggcacagtggctcacgcctgtaatcctagcactttgggaggcagaggcgggccgttcacctgcagtcaggagttagagaccagcctggccaacatggtgaaaccctgtctctactaaaaatacacaaaattagccgggcatggtggtgcacacatgtaatcccagctactagggaggctgaggcaggagaatcacttgaacccgggagggggaggttacagtaagctgagatcatgccactgcactccagcctgggcgacagagcgagactcccccacaaaaaatttgttgactgaaggaacagcaagtgtttagtaaatgataccttttattaatctcatcatcttagattctaaaataagtaacaagaacaataaaaccttacacaaatcgaagtatatgttccttaacaaaaagaagcacagggatttagaggaaaacaaaatcacttccttccagggacaatccccagagagggcttagtgtccccagtggcatttgcagtgggtcttcagggacggataggatggtgactgaaggcttgctttgggtgggatgtttctcccagtgtgcagtggtttgaggtttgagagaagctgtttttcattacctggtggtatagtgcttgctgaccttccctcctgaggggaaagtccttgaacttgaggatctcattccattccaccacaggcaagaaagtttcccagatcaaatggaaatgatcaagttgaaagtcaagaagaaaagaaagttcagagatgccaagggacatcaaaaggaaaaatgtctagaagtcaacaagcaaaggagcaacttagctgtcctaaggattgtcccatatcaagtagctcagctccagatgttcggaagaggcattggttgtactgttttctcaccggatcagatggctttcagataatctgctcctggccccaggagggaagagggctgtaatggagtcttgagaacacctcctttccctgccaaaggtattggaagccacacaggcaggtgtggcctcagtggtggaaaggactgctggttttctgtaatgtatgtcagaaggcctgccaaggcttctcagatatgctgttacctattctcgctaattcataagtaaatgagatgacacaaaaaatgaagatgtgttattagaaagtaaaagacatgtggacacagatggtatattcatctcctcttcctactgaaagctgagatttattcatggggaacagaaaaggtgcaggactacctgtatagaaggtgttgaagaacaggatttggagaaagggtgcaggactgcctgtatagatggtgttgaagagcaggatttggttttctacaacctagataatgagtttttggttatgataaagtgcatctcacaaaatctgaaaggaacatatttgacagtggtgaaatacattaacctggccaggaagggataacattgaagaggaagtggagagacagatctccaaattagatcaagccaaatgaaaaagtagataaaccaatatggtatacaagaaggaatggtaggagatgactggggacagtggctcacacctgcaatcccaacactttggaaagccaagacaggaggatcatttgagaccaggagtttgagaccaacctcggcaacatataataataatgataataataataataataataacaacaataaagaatggtagaagaaattaaaaaaaagatttttgacactttgggaagccaaggtaggaggactgctttaggccaggagtttgagaccagcctgggcaacatagtgagaccctgtctctacaaaaaaaaaaaagaaaaatagaaaacttatctgggcatggtggtgcttacctgtagttctaactactcgggaggcagaggctggaggatcccctgagcccaggaggttgaggctgtagtgagctatgatcacaacaccgcactacagcctcggagacagagtgagaccctgtttcaaaaaaaaaaatggatttcaaggtgaacttgaaattggggcagaaggaaatgcatatacacttttggatagttcttgagttgcttgctttattcactgtgtattcatcaacaatcagcaggcagcacttacaaaatggagcctgggcttagccctaatttcctcctgtggtattaattttagaagttagaatgtttaaaatcttttgtaaacataagagaaatgaagtttagattacttggaatgttttgtcttatcttggccacagtattgaaatttaaatctagaaattggagctgggtgcagtggctcaggcctgtaattccagcacttgggaggccgagctgggaggatcacttgactacagcagttccaggacagcttgggcaatgtagcaagactctgtctccaaaataaaacaaaataaaataaacctagaaattgggctctagagaaaagcactgaattagttgtcttttttttttttttccgaggcagggtcttgttctgtcacccaggctggagtgcagtggcgccatctagagtcactgcaacccctgcctccagagttcaatggattcttctgcctcagccccctgagtacctgggattataggcacctaccaccacacccagctaatttttgtatttttagtagaggcattgtttcaccatgttggccaggttggtcttgaactcctgacctcaattgatccacctgcctcagcctcccagagtgctgggattacaggcatgagctactgcactcggcctgaattagttatcttacagcataaggctgcaatgtaagatgtgtcttgtgggtatcatactttaaaagctcaagcattctaaaatctaatcttatactttgtttctgtaagtcatactttttaactatttgatagtaaaatatgagataaaaatcaaccctccattgtaacgtttgtactctggttcttgatgtgcaggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttggtcctgctctttttgtccattttattttattttgagacagagtctcgctctgtcgcccaggctggagtgcagtggtgcaatctcgattcactgcaacctctgcctcccgggttcaagtgattctcatgcctcagcctcccaagtagctagaattacaggtgtgcactaccatacccatctaatttttatatatttaatagagatatgatttcatcacgttggccagggtggtctcaaactcctgacctcaagtgatctgcccgcctcagcctcccaaagtgctggcatttcaggtgtgagccaccacacctggcctctgtccataataactgtggtgtgatcaccattaagtatgggaaaacacctttgaaatcatcccaatggttagactagtgacatattttcttatagcagatagtcttagtgctccacctatacccattcctggcatttatgtctttactagaacattgctttgagatgccagatatgggtcttgtggcccaaggtctttctcttgcccctggagtcctttgcctcttgctgggcaaactggaagtgtcaaggaataatgccccccatggaagaagtcctccactagtgactgctgggaagtagtgatagaaatctcccagcaggctgggcacagtgacccacacctaaaatcctagcactttgggaggccgaggagggtgaatcatgaggtcaggaaatcaagaccatcctggctagcagggtgaaaccctgtctctactaaaaaatacaaaaaattagctgggagtggtggcggctgcctgtagtcccagctgctcagaaggctgaggcaggagaatggtgtgaacccaggaggcagagcttgcagtgagccaagatcccgccactgcactccagcctgggcgacagagggagactccatctcaaaaaaaaaaaaaaaaagaaaactataaagatctttgcctacttactaatgatgaaaagtatggtcatagaatatggtaatgtacagttgcatgaccttgagctaacaacttaggattgcagcctcaggatttacatttgtaaagtgaagagccagcgctttgacggactaaggccatgggaatcacgtgcttatttcagggctatcgggatcaaagggagtatacatatgataggccttacacagtctctcgtataattgtgctggactttcttctttttccctgaataacctcagagaccttgttaacgtttgtggccttctgagctcccctctttaatccttccaagagagcttccctgtctgggtttagcctttgcatatcctctctttcatgtgggtccatctgggggttggttcctggtaactgggtccttccatactcttgggggttttgacaatcagctggtgcatattcctctagccacttagttgctgcttggagccctctccgcctttcatctctgttaaagaggaacatgagcaaccggtggcaatcagcccaggtggggttgtgggtctggataacagtttggagcaaatcaattagggcttgtggcttttcggtagagggcggtgtattgttttcccagttgagaaggtcggcagaggtgaaggcctggtacccaaaaacacgcctctccactacgtgaccatcctcctctatcccagtataccgctgctctctcaggggcatttggatccccgttttgggtcgtaaaccagctgtcgagggaggggtggaatggcacaatgtgacttaccgcgattaatggtatcaattattaattgagactaataactatcaatattaataactgatcatataattcttaaaatcaatagcgataataatgataattcacattaaagagttatactcacgataacaataaatgattaatattaatgattaatgacacctgatattaataactgatattgatcttattcattagaaaacagtcatattagctcttaataattaatattaatattaataatctgaacactttatgagcaatgatttcttaatattaatatcaatattggtaatagatattcatgttaataataaatgaggatgaattaatactaatagtacacctaaaacctcagtgggtgtacacccacctgtgatattgttcataatgtccaggaagggagagagcatgatattacgttcaatatcgcagtagctgtacacccacccggtgatattgatccgaatctcatctccaggggatggcgtatgacgttactcccaatatagcactgggtgcgcatccacccggtgatgttcctcctcatattcacggaaaaagagaatgctattactcccggtatcacaggaaatgtacaccctttctgtgacattgttcctaatatccggagggggagagggtgatattactcccaatatcgcaggctgtgtacacccaccctctgatattgttcctagtagccaggaagggagaggacgatatgactccccagacagcaggaggtgtacacccatcctgggatattcttcctaatatccatggagaggagaggctgatatgactcccaatatggcagggggtctacatccagtctatgatattgttcttaacattcaaaggtggagaggttaatattactcccaatatcacagaaagtgtacaaacccgtgtactattgttgctattatccagaagaggagaagatgataataccccccataccgcaggaggtgtacacccactctgtgatattttttgtaatgtgcagggcgggggaggataatattcttcttaataacgcagggtgtgtacagcccccctgtgatatgatccttaatattccaagggggagaggataaccctactcccaatagcacagaaagcgtacaccaccccagggatattgttcccatgatccaggagagaagaggatgatgttactttcaatatcgcatgggatggacacgcccccagtgatattggtcctaatttcaacatgggagaggacgatactacacccaatgccgctgggggcagaaacactcccgtgatattgttcttaatatccagggggaagaggatgctattactgcaaatagtacagaggatgtgcacccgtctgtgacatagttggtaatttccagaggcagagaagatattactgacaataacgtcaacacgctgtgaccaccgtggatcctaatatccagggggggaccggggggtgatattactccccgcatcgcggggggcgtccgcccccttgcgacgggaatcgtaatacccaggtggggagagggggttgatattactccccgatttttcctaggatcttttctctactgccatcctgggttcacaccctgggacattattttccatattctagcaagatgccactagtaaagtcaccggggtatacaccctgctgcattattcataatattaattacatattattcatcggggaatattaatcctgatgtcacaggaccgtacacactgtgaagttattcccagtatcctagcgggacattaagaataatgtcacaatgtgtgtataccttgtggtgttattcttattctcctatggggaggttacttttattgtcacacgggctatgttcgctttgatattattcataatatcctagagggatgtcacctcttatgtcacagggtttgtacaccttgtcaaatcactcgtattatcctcataagatgtcactcctcatatcacagagggtgtacactctgtgatattatcgtcctattctagggaaatgtgacttttaatgtcacagagggtgtacaccttgtgaaattattcgttataattttgtgggatgttacccctaatgtcacacggggtggacacacagtgatgttccatgtaatattctatagaaatgttactcgtaattcacaggtcctgtacaccctttcatattcttcataatattccaggaaaacgttactgctaatgtcacagggcgtgtagaccctgtcatgaaattcctaatatcctagcaggagttcactactcatttcacaatgcgtgtacacactttgatattattcgtactgtcctgaagagatgttactactgatgtcccaatgcaggtacattctctgacattattcgttatatccacgggggatgttacttctaatgtcacacggggtgtactccctgtgttctatttcctaatgtcctagcgcaattttacttttaatgacacaggggtgtacacattgagatattattcatgatattgtagaaagatgttactcctaatgtcacaggcgtgtacagcctgtgatagtattcataattacccaggggtctatactcctattggcacagaagataacaccctgtgacactattcgtaatattctagcgagatgatactcccaatgtcacagatggtgtacaccccatgttattattcttactcttctagggtgatgttagtcttaatgtcacaggcctgttccttctgtgatattattgaaaatatgctagcaggatattactactaatgccaaatgcgtgtacacgtgatattattagtaatattcaggggggatgttactcataaagttacagggatgtacaccgtgtgatattgttcccaatattgtagggggatgtcactcctataatgtcacagggggtgtacacccttcgatattatttgtaatcttatagagagatattactttaaatatcccagtgggtgtacacacatggggtacacccactgggatattatttgtaatttcttcaagagatataactcctaatatcacagtgggtgtaccccatgtgggtataccctgtgatattatttgtaatatccatggtaaacattacttctagtaacccacagagggtacaccctgtgatatttttcataatatcatagggagatattcctgctaataacacagtgggtgtacaccatgtgtgtacactctgtgatatgatagctcatatcctagggaggtattccttctaatatcaccgtgagtttacaccctgtgatatcattcgtaatatcctagaaagatgttgctgctaatatcacagagagtgtgcccccagtgacattattcgtaatatcctggggagatgttactcttaatgtcacagggattgtacaccctgttctattattgtaatattctaggggggtgttccttttaaagtcacaggggtgtacaccctgtaatgttattcgtaatatcctaggaagaggttactcctaatatcacatgtgttatcctaggaagaggttactcctaatatcacaccctgtgataccactcgcaatatccacagggaatgttactttgaatgtcacatggggtgtacaccctttgatgttagtcctaagacccagggatatattacttcaaatatcacattgggtgtagacacatggtgtacacattatgtatgaaaacgtactgtgatattattcataatatccttggaaaatgggactgctaatatcacagtgattgtccacactgtgatattattagtaacatcctaggggaatattagtccaaaaccaaaggcgtgtgttccccccatgatattattcgtaatactctagggagatgttactcctaatgtgatatcacaggggtgcacaccctgtgatattattcacagtatatgagagggatattagcactgaagtcacaatgcatgtacaccttgtgatattattcctaatatcctacggggatgttactcatattgtcacaggggttgtgttcgctgcgatagtattcgtagtctcctagacggatgttacacctaatgtcacagggtgtgtacatcttgttatattagccgtgatatcctaaaaagacatgactcctcatgtcacaggggctgtataccctgtgatattattcgtaatatcctagcgagatgtgacttttaatgtcacagagtgtacacaccttttgaaattattcatcacagtttcgtggtatgttacaacttatgtcacacggggtgcacaccaaatgatattacttgtaatattctatagaaatgttactcataaatcacaggtgttctacaccctgtaatgttatgggtcgtattctaggggattgtgacataaattaatgtcacccggcgtgtacaccttgtgatattattcgtaatatcctggtgggatgttactactaatgccacaatacgtgtacaccctctgatattatccgttatatcctcatgggtcattcctcctatgtcacatggggtgtactccctgtgatattattcggaatatctcagggggattttactttaaatatcacaaaggttgtacacgctgtgatattacccgtgatgttctagaaagatgttactcctaatgtcacagggggtgtacaccctgtgatattacacaggctaaccccctgtgacattattcgtaatactttagcgggatgatactcctaaagtcacaggaggtgtacaccctgtgatattattcggaatattccagggggatgttactcctaaagtcacaggtgtgtatgccctgggatagtattcacaatatactagcgggatactactactaatgtcaccatgtgtgtacaccttctgatattattcgtaatatcctgggaggatgttactcccaacgtcacaggggtgtacaccctgtgttattattactaatattctagcgggattttacttttaaaatcacaggggctgtcaaccctgggatcttatttgtaatatcctacgaagatgttacttgtaatgtcacatggggtgtacaccctgggatattatttcaaatatcctaaagagatgttatcttaatgtcatagggtgtgtacaccccttgatattattcctaatatcctgaggagatattactttaaaaatcacagtgggtgtgcacacatggtgtacaccctgtgatattattcacaatatgtgagggaggtataacttttaatatcgcagtgggtgtacacactgtgatactattcgttatatcgtagaagtatattatttctattgtcagaggagtttaacatcctgtgaaattatttgtagtaatccagggggataattaccctaaagtcgcaggctgtgtacaccctgttatgttattcataatattctagggggatgttactcctaatgtcgcaaatgtgtgcacgccgtgatattattcacaatctactagctggatattgttactagtgtcaccatgcctgttcaccttgtgatattattcgtaatatcctaaggggatgttacgcctattgtcacagggggtgtggtttctgtgctataattcggagtatcccagggggatgttactcccaccatacaaattgtgtacaatttgttatattattcgtaatatcctagagtgatgttactccttatgtcacagcggtgtatatcctgcgatgttattcttcgcattctagaaagatgttaacttctaatatcacagagagtgtacaatctgtgaggttattcataatcgtttccagggatgttactcctaatgtcacacgtggtgtacaaacagtgatatcatttgtgatattttatggaaatgttacccctaatatcgcaggggctgtacaccttgtaatcttattcagaatatgaagtaacgtacctgctgtcaggagatctgagcttttttcttggacacattatacccacagtcctccaggtgttggcgtagggcaatccgttctcttggcgcacccgactgacctggggtgtcccagcaaaagctcaacctactggagcaaagcgcagcctatgtctctggttggaaacctctggaggtctcgagccaacgcctcaccgaagatggtgggggagttcttgaacctttggggaagaccggtccaagtgtactgagtagtgacacctgactccggaccttcccactgaaaggcaaagagcttctgcctctcaggggctaatctgataggaaagaaagcgtctttcaggtccaagcaggtgaagcagctgtcctcagctggcagcaaccccaacaatgtggacgggttaggtactgttggatggaaagtcagtgtagcttgacgaagcaagcgcaaatcctgtcccggcctgtagaccttggtctgtggcttgggaacaggcaggaggggagtgttccatggcgaatgacaaggaagtatcattccacaagttcttaggtgcttgagacggacctggataccttgaagagcttctctggtgaccgggtcctgtttttgcctaagcggctgggccccagtcttaactggccaactctggagggttgtcttccgcccgtactcttggccaccgcttagccagagctggtcttctctcttggcctggctcagttcagaaaagtctccattcctcctctcgggggactgtaagggtcataatgactcccgtggtgggtaactttagcagcaaagagctgtgttctgtcaaagagagactggctctcagcttgctgagcaagtcccttcccagcaaggtcaagggacggtctggcatgtacaaaaactgatgaatgacttgatgtcctcctacagtacaagtccgaggcgagcagaaagcttgctttgcggaaacccccgtggctccggtgatgtcaagagtctttttggataagggggcgaccggggcggttactagcgaatgttcagcaccggtatctacaggaaaatcaatgtctctacccccgacagtcattctgaccagaggctctttggggacgcttgagcccggtctccctcagtccaataacccttctgcgaggttgagccgggccccttcctcctagtccagggcctcctgttctgagtcatcttgttttcttttgagctgagggcatttgttcttccaatgtcctatttctttccaataagcacactggttacactgcaaactctgacagccaagctgagtttctttcccagggccccccttcccttgcttctttggggggacccctctgattgctgcagctaacaaacaggtcggcgtttccccgggcctgacctccattctctttgcgcttttcctcgcggcttactgcatccctgtttacaaacacctgcttagctctttctcatcattgtgatgtattcacccctgcaagcccagcctgcttctgcagttttcttctaaggtcttccgcgctttgatggattaaagccatgtgaatcatgcgctgattttcagggttatcgggatcgaggggagtatacatatgataggcctcacacagtctctcgtataattgtgctggactttcttctttttcctgaatgacctcagagaccttgttaacatttgtggccttctgagctcccctcattaatccttccaagagagcttccctgcctcagtttagcctttgcatatcctctctttcatgtgggtccaactggtggtcggttcgtggtacctgggtccttccatactcttgggggttttgataatcagctggtgcatgttcctctagccacttagttgctgcttggaggactctttgcctttcatctctgttaaagaggaacatgagcaactggtggcaatcagcccaggtgtggttgtgggtctggataacagtttggagcaaatcaattagggcttgtggcttttccttctgggacggggtattgttttcccagttgagaaggtcagcagaggtgaagggctggtacacaaaaacagcctctccaccacgtgaccatcctcctctatcccagtataccgctgctctctcaggggcatttggatccccgttttgggtcgtagacgagctgccaagggaggggtggaatgacgcaatgttaccgcaattaataatatcaattgttaattgatactaataattatcaatattaacaactgatcatataattcttaaaatcaatacagataataatgaaaattcatattaaagagttatactcacgataacaataaatgattaatattaacgattaatgatgcctggtattaataagtgatattgatcttattcattagaaaacagtcatattagctcctaataattaatgttaatgttaatctgagcactttttatgagcaattatttcttaatattaatattaatattggtaatagatattcctgttaataataaatgaggaagaattaatatgaatattatgcctaataccccagtgggtgtacacccacctgtgatattgctcctaatgttcagggagggagagagcatgatattacgtttaatatcgcagtagctgtacacccacccggtgatattgatccgaatatcatctccagggggtggcgtatgaagttactcccaagatagcactgggtgtgcatccacccggtgatattcctcctaatattcacggaagaagagaatgctattactcccagtatcgcaggaagtgcacaacccttctgtgacatcgttcctaatatccagagggggagagggtgatattactcgcaatatcgcaggctgtgtacacccaccctctgatattcttcctagcagccaggaagggagaggacgatatgactccccatacagcaggaggtgtacacccatcctgggatattcttcctaatatccatggagaggagaggctgatatgactcccaatatcgcagggggtgtacatccagtctgtgctattgttcttaatattcaaaggtggagaggttgatattactcccaatatcacagaaagtgtacaaacccgtgtactattgctgctattatccagaagaagagaagatgataccacgcccccatcgcaggaggtgtacacccactctgtgatattttttgtaatgtgcagggcgggggaggataatattcttcttaatagcgcagggtgtgtatatccccccagtgatacggtccttaatattccaagggggagaggttgaccctcctcccaatagcacagaaagcgtgcaccaccccagggatattgttcccatgatccaggagagaagaggatgatgttactttcaatatcgcatggggtggacatgcccccagtgatattgttcctaatgtcaacgtgggagaggatgatactacacccaatgctgctgggggtataaacactcccgagatattgttcttaatatccaggggcaagaggatgctattacggcaaagagtgcagaggatgtacacccgtgtatgatatagttggtaatttccagaggcggaaaagatattattgacaataccgtcaacacgctgtgtgaccacggtggatcgtcatatccaggcggggagaggggggtgctattactccccgcatcgtggggggagcccacccccctgcgatgtggatcgtaatatccagggtgggagaggggggtgatattactccccgatttttccgaggagatttcgtctactaccacccttggttgacatcctgggacattattttccattttctagcaacatgccgctactgaagtcaccggggtatacaccctgcgatattattcgtaatattgtaggggaatgttaatcatgttgtcacaggactctacacactgagatgttattcacagtatcctagcgggacattaagaagaatgtcacaatgtgtgtacaccttgtggtcttattcttcttctcctaaggggaggttacttttattgtcacacggggaagtttccctttgatattattcataatatcctagagggatgtcacctcttatgtcacagggtttgtacaccttgtcaaattactcgtatgatccttgtaagatgtcactcctcttatcacagagggtgtacactctgtgatattatcgtcctattctagggaaatgtgacttttaatgtcacagaggttgtacaccttgtgaaattattcgttataattttgtgggatgttacccctgatgtcacacggggtggacacacagtgatggtatgtgcaatattctatagaaatgttactcgtaattcacaggtcctgtacacgcttcaatattcttcataatattccaggaaaacattactgctaatgtcacagggcgtgtagaccctgtcatgaaattcctaatatcctagcgggagttcactactcatttcacaatgcgtgtacaccctttgatattattcgtattgtcttgaagagatgttactactgatgtcccaatgcaggtacattctctgacattattcgttatttcctcgggggatgttacttctaatgtcacacggggtgtacacagagtcacacagtgataggagttgtaatattctagagatatgttactcataaatcactggggccgtacatcctgggatgttattcgtaatattctagggaaatgttgctactatggtcacgggggtatacaccctgtgatatgactcgtcatatcctggcgggatgttactactaatgtcacaatgcctgtacaccctgtgatattatttgtaatatcctaaagggacgttactagtaaggtcacaatgcatgtacaccctctgatatgatcggttatatccttgggggtgttactcctaatgtcatatgggatgtactccatcatattagtcgtaatatccaagggagatgttatttttaatgtcaccgggagtgtatgtcatacgtattcaatgcttgtgatactattcctaatatcctaggggcatgatctccctaatgtcacacggggtgaggcggtgtacatcgtgtgtgtacaccacctgtgatattattcataatagcctaggaggatgtttgtttgaatgtcacaaagagtgtacaaaatgtcacagaaggtgtacaccttgtgacgtgatctgcaataccctaggaggatgttactcctaatatgtcacaggggtgtacatgctttgttattatttgtaatcccctagagagatattaattcaaatatcacagtggatgtacacacatagtgtataccctgtgatagtattcataatatcctagggagatacaactcctgatatcacagtgcgtgtaccccgggtgtgtacacccttgatattagtcttaatatccagggtaaatattactcctcatatcacacagtgtgcacaccctgtgatatttttcatcatactttagggagatattgcttctaatatcacagtgggtgtaccccatgtgtgtatactctgtgacagtatattttatatcctagggaggtattaattctaatatcacagtgggtcttcaccctgtgatataattcttatttcatcttgcagcattttttaaccatgaaatacaacattagctgggcgtgctggcgcatgcctgtaatcccagctactcgggaggtggaggcagaagaatcgcttgaacccaggaggcagaggatctggtgagccaagattgcaccatcacacttcagcctgggcaacaagagcgaaactccatctcaaaacaaaaaacaaaaaaccagcatgatttcaagagcagaaagagaagaccttaaaaaccagcataatgagaaagttaggaagtttcttaccaaaccatctggaattgtgcaagaaattcttgtgaagtaaaattttcatactgtactatcaaacactagaactcacttattccatctttctgtatttcaggacccaattatccacttgtcttcattccccatcccatcccttttcttcgtagcgtctgctaacctcctttatactttccaccttactcagattccttttgtatgtaggtgtatgatggagtctctttctgttgcccaggttggagtacacaggcacaatccgggctcactgcaagctccgcctcctgagttcaagcgcttcttgggcctcggccctgcgaatagctgagactacaggcaggcgtcaccaagcctgactaatagtttgttttttccgtagagacggggtttcaccatgttggccaagcgggtctcgaactcctggactcaagtgatcccagcgactcagcctcccagagttgagaagttgagaggggtcacagacaaaatgagagatttccacattcttgatgatggtgaattgtcacacaatccaaccgtgcagctgggaatccaacaggctaaggaaaaaggacaccaaaacgaagaagacacagaggtgaggattcatgatgactgggtagtgcagagggagacagatggctacaaagccgtcataggccatcacagtcaggagcatgcattctatacatgcaaaaaaggaccaagaaagacatctgtgtcaggcagcccgcatgagagatgactctgctatgcgactgcatgtccacagtcaccttgggaaccgtggccgaagtgaacccgatgtcagcccagcacaggttggagaggaagaagtacatgggggtatggaggggggagtcagagctgacagccaggatgctgagcaggttcctcagaaccatgaccagatacaaggacagggacagggacagggacagcaaagcgaggacaggctgcagttctggatcctctgagagtcccaggaggaggaattctcagacacctgtgagattccgtggctctgtgtgtcttggacaccttgagaaggaaagaggattggaaaataaaaggtaaaaaccagcccttaatgttggatgcaagcaattcacaaggaacatctttacacttgcagaccatacaccaccagcaatgtttctcagttgtgacaattccaaaaatctcagaatttttacgtgatttactttttagctatacgaggctttctgtacatactactttagagaaaatccactgaagaatatcagaagaccaaaacgtcgtatataacaaatccgtgatctccgtaaaatacggcctactcttttcagaaaaaacacaatgcaatgaaaatatccttctctctttcagaaaaagatctcagtctaattgaaagaaattaagaagccgtgaaatacactctactttattctgacaccgtgctacaacttccattgatgtagaatatgtaaaaggacgacacgagagctacgaccccattatctgaaaacgaaatcgaaccttatagttctcaatgggaacaccttttcacatacctgttacttttcatatttattatcatccttcggttttctgacatcacttcttcataaaagtacatgcacacttaaaaatgggagctgtgtttccaaatgaattgaatctctaactcttggcccagcaccatggctcacaactgtaatcccagcactttgggtggccgagtctgatggatcacctgagatcacgagttccagaccagcctggccaacgtggtgaaaccccgtttcgagtgaaaataaaaaaaatttagccaggcgtggtggcgggtaaccccagctactcgggaggctgaagcaggagaatcccttagaacatggaaggcagagattggacaacatgtgataggatttttgatatcctagggagatattgctcctgacagtagagtgggcgtacaccctgtgatattatttgtaatatcctagaaagatattgctcctaatatcacggtggctctacaccctgtgatattaattgtaatatcctacagagatattactcctaataatacagtggacgtacaacctgtgatattattcataatatattacagagatacgactcctgatatcacagtgagtgtacaccatgtttgtacaccctgtgatcttatttgtaacaactttgaaaaatattacagctaatatcaaagtgggtgtacaccctgcgatgttatttgttatctactaggtagatattactcctaatatcacagtgagtgtacaccatgtgtgtacagactgtgaaattatttgtaataccctaggaagatattactcctcatatcacagtgggtgtacactgtgagtgattttttttctattatccagcgggggagaggatgatattgcttcccatatcacagaaggtgtacacccccctgtgatattgttcctaatatccagggaaggagaggatgacattattcgtaatatcactgggggtgtaccacctcccgccgggatattgttcttaatatccggaggtggagagaatgatgttactcccaatataacagggggtgtacaccacccctgtttgtaaacgccccctgtgatattgttccaaatggcctgtgaaagagtaaacatgactcccattatcgcggggggtgttcagccctgatgatattgttttctaacatccagggaaggagagtatgttattactctcaatatcacaggggttgtacaaccttttgtgtttttgtgcccaatatccgggaaaatagaggatgatattactcccaatatcgaagtaattgtacagtacccctgtgatattcttcctaatatccagaaaggaaaagaatgatgttactcccaacagcgtaggaaacgtatacccgcgctgtgctatctttcccagtatccaggtggggagaggatcatattacttccaatgtcgcagggtgtgtacaccccctctgtgatctcgttgctaacatccaggtttggggaggatgacattactgccaatatcgcaggggaagcacactcccccgtgaccttgttagtcatttcctgggtggagaggatgatcttactcccaatatcgcagggggtgtacacacccttgtgaaaatcttcctatattcagagggagagaggatgatattactcccagtaccgcagggggtttccacagctctgtgatactcttcctaatatccacagggagagaggatgatatgactcccaatatcgcagggggtgtacgcaactctgtgatattgttcctaacatccagagtgaaagaggatgatatgactctcaatatcgcagagggtgtacacccctcctgtaatattgttctgaataccctgggagggaggggataaggttacgttgaataacgcagggaatgtacacactccccctctgatacccttcctaatgtccaggggaagagaggaaaacttcactcccaatatcacagaggcagtacaccccacctgtgatgttgttcccaatatgcaaggggggacaggatgatactactctcaatatcacagggctgttcacatccccagtgacattttttcctaatatctaggggacagacaattctatgaccgcaaaggttgcagagtctgtacatcccttcctgatattgttcctaatatccaggggggaagaggatgatatcaaatatgaaagggggtgtacatcccccacccctacgatgttgttcttaataatcatgaggggagacgatgatattactccaaatatcgcagggattgttcacaaccccctgtgatattgtttctgatatccaggggggggagaaaatcatattactgccaatattgtaggtggtgtataccccacctgaaatatggcaccgaatatccaaagagggagaggatggtattcataccaatatcgaagtgtgtgtacacgccccttgtgatatggtttttaatatccagtgggcgggaggatgatattagtcccaacatcccagaggctgtacactacccctgtgatattgtccctaacttccagaggggagagggtggtatcactcccagtatctcagaagttgtacatcccccgtgatattgttcgtcatatccaggcaggcgcaggatgacattccattgaatttcgcgacaggcgtacacgcacagtgtgatattgttcctaatatccaagaagggagaggatgatattactcccaataaagcagtgggtgtacatcacccctgtgttattgtctctaatgtccggggccgggggaggggggcagaggataatattccctcaaatttagcaggtggtttgacgccccttgtggtgttgttttacatatccagcgggaaagacaatagtactgtttttgaaagtccgattcatccgctccacctttccggaactctgaggccggtaggcggcatgcagtttccatgtgatccccaatacctttgccgtcttctgtaccaaggcagccaaaaacacaggcccgttgtctgagccgatccgtaagggcggtcgaaatctaggaatcacatctcgaagaagcacaggggttacttcatgagctttctcagttcatgttggataggcctccacccacccagagcaggtacgcccaagaactagtacatacttgttacctccacacttgggcgtctctgtgaagtccacctggagaccttcaaagggggctgctccataagctcgtatgccgggcggaacggctgcaccttgccccgcatcatgctgtcggcaggtaacacaccgctgcctcacagttttggcaagggctgacaaaggcgagatgtagaaataccggcctaacaacttttccagtgactcctgacctcgatgggtggtttcttgcacagccagtacaactgcagctcctagcagctgtggcacagcttctctcccatgtggtaaccgaatccatccttcctccatcacttgtccttccctctacctggagacagtccttttcttctttagaagaagcaggtccaagatcaggtgcttgagggagcactgatgcccagaagggggcagatgctgcttttcgagcctctgagtcagcgccggaattccccaaacccagcaaggtggaagctcgctggtgtcctctgcaatgcttaactgccaccttgtggggtctccatactgcttctaatcattggaagatttcttgttgatattttctgtcttttcccccagagttcaataggcccttttctttctatcacgctacatgcacttgaagggttaaaaagacataccgagaatcagtgtaaatgttgacagtctcaccctcactgagttctaaggcccgaatgaaagcaatgagttcagctttctgggctgaagtggcctggggcaatgatctggcttcaacaacagtgcccagggttatcactgcataccctgcacctctctctccttgggggttgaagaagctgctcccatccacatatcgttcccagtctactgatgcccaaggctggtcccggaagtcaggtctgctagagtcaattgagtccaacacttctacacaatcaggctcgacagggctctctgatacctgcagcaaggtggcggggtgtagggtgttacaaacttcaatggttatatggggactttcacagagcaaagtttcgtccttggtgagtctggctttcgttagccaatgatgtcctttagtgttcattaaagtcaccacagcacgggaggcctttatgttcaagttttgcccaagagtcagcttatttgcttcttgtactggcagggcagttgctgccaaggccttccaacaggggggccatcctttagaaaccccgtctagttgttgagagaggtaggccaccggcctcggccagggacccacagtttaggatcaaagtccagctgccatcttttctctctctgatgcatacaatggaaaaggctttgtcagatcgggtagccccagggctggggcagccagaagtttttcctttaactcatgaaagacttgctgttgttgggatccgcattccaaaagttcccggtccccgcccccttggtaacctcatacaaaggctggctaattctgcaaactttgggatccacagtctacaaaagcccacagctcctaagaattctcttacctaccttctgcccttaggctccgctagatggcaaatgatctgctttctttctgatcccaggttgcgttccgacccctgtcggatagtcaatcccaagtaacctacctgctgtcggcagatctgagctttcttcttggacaccttttacccacagtcctccaggtgccggtgtagggcatctattcccttggcacacccgactgccgtggggtgtcccagcagaaggtcatcaacctactggagcaacacgcagcctaggtctctgctgggaaacttctggaggtctcgagcccacgcgtccccgaggatggtggggaagttcttgaactcatgggggagaccggtccaagtgtactgagtagtgacacctgactccggatctgcccactgaaaggcaaacagcttctgcctctcaggggctaatctgatagcaaagaaaacgtctttcaggtccaagcaggtgaaccagctgtcctcagctggcggcaaccccaacaatgtggacgggttaggtactgttggatggaaagtcagtgtagcttgatgaagcaagcgcaaatcctgtaccagctggtagtccttggtccgtggcttgggaacaggcaggaggggagtgttccatggagactgacaaggaacaatcattccaaaagttcttaggtgcttgagacggacctggataccttgaagggcttctctggggaccggctcctgtttttgcctcaccggctgggccccagtattaactggcaaatcccggagggttgtcttctgcccgtactcttggccaccgcttagccagtgctggtcttctctcttggctcggctccgttcagaaaagtctccattcctcctcttgggggaccataagggtcataatgactcccgttctgggtaatcttagcaacgaagagccatgctctgtcaaacagatagtggttctcagcttgctgagcaagtcccttcgcgaaaaggtcaagggacagtcaggcatgtaccaaaactgatgaatgactttatgtcctcctacagtacaagtccgaggcgagcagaaagcttgctttgcggaaacccccgtggctccgatgacgtcaacagtctttttggataagggggcgaccggggcagttactagcgaatgttcagcaccgctatctacaagaaagtcaatgtctccacccccgattgtcattctgaccagaggctctttggggacgcttgagcccggtctccctcagtccaataacccttctgccaggttgagcagggccccttcctccttttccggggcctcctgctctgagtcaccttgttttcttttgagctcagggcattttttcttccactgtcctatttctttacaatgagcacactggttacgctgcaaactctgacagccaagctgagtttctttcccagggccccccttcccttgcctctttgcgggggcccctctgattgctgcagctgacaaacaggtaggcgtgtcgccgggcctgacctccattctctttgccgttttccttacggcttactgcatccctgtttacaaacacctggctagatatttctagtaattgggatggattcatcccttcaagcccagcctgtttgtctagttttcttttcatgtcttctgcactttgacggactaaagccatgtgaatcacgcgctgatttcagggctatcgggatcaaagggagtatacctacgataggcctcccacagtctctcgtagaattgtgctggactttcttcttttccctgaatgacctcagagagcttgttaacgtttgtggccttctgagctcccctcattaatccttccaagagagcttccttgtgtcggtttagcctttgcatatcctctcttccatgtgggtccaactgggggtcggttcctggcaactgggtccttccatactcttggggattttgataatcagctggtgcatgttcctctagccacttagttgctgcttggaggactctccgcctttcttcgctgttaaagaggaacatgagcaactggtgccaatcagcccaggtgtggttttgggtctggataacagcttggagcaaatcaattagggcttgtggcttttgggtagagggcggtgtattgtttttccagttgagaaggtcgacgcaggtgaagggctggtacccaaaaacacgcctctccaccacgtgaccatcctcatctatcccagtctaccgctgctctctcaggggcatttgtgtccccgtttagggtcctaaacgagctgccgagggaggggtgcaatgaagcaatgcgacttaccgcaattaataatctcaattattaattgacactgataattatcaatattaaaaacccataatataatttttaaaatcaataccgataataatcataactaatattaaatagttatactaacgataacaatacatgattaatattaatgattaatgacgcctgctactaataactgatattgatcttattcattagaaaacggtaatattagctcctaataattgatattaatattaataatctgaaaacattttattagcaattatttcttaatattaatattaatatcggtcattcatattcatgttaataataaatgaggaataattcatactaatattacgccctaatacctcagtgggtgtacacccacctgcgatattgctcctaatgtccagagagggagagagcatgatattacgttcaaaatcgcagtaggtgtacacccagccggtgatattgatctgaatataatctgcgggggtggagtatgacgttacattcaatatagcactgtgtgtgcatccaccaggtgactttgctcctaatattcacggaagaagagaatgctattactcccaacatcgcaggaagtgtacacccccgtgtgagatggtccttaaaaatattccaaggtagagggggtgatatgactacatatatggcaaagagtggacacccccaaggatattgttcgcatgatcccggagggaagaggataatattactttcaatatcacagaaggtggacaagcccccaatgatattgtttctaatttcaacgtgggagaggaggacatgacacccgatatccaagggagtagaaacacccctgtgatactgttccaaatattcagggaggaagaggatgatatgactcccaatgcacacgagtgtacaacttctgtacaccctcggtgtacacaggtctgtgaaacagttcataatgtgcagaggggaagatgatattactcacaatatgataaacaggctgtgagtccaccgcggatcctaagagccaggggggcaagaggggctggctctttactccccgcatcgcggggggcgcctcgcccccctgcgatgggggtcgtcataccccggagtcgagagggtggtgatatgactcctcgtatcgcggagtgcgcccgcccccctgcaatgtggatcgtcatatccagggtgggagattggggtgatattactccccgcaaggaggggggcgtcggcccccctgcgatgtggttcgtcatatccggtggggagtgggggttgatattactccccttatgtgggcgggcgcccgcccctcggcgatgtggatcttcatatccagggttggagtgggggatgattttactccccgaatcgcgtgggctcccgcccccatgagtcgtggatcgtaatatccacgggggatgggcgggtgatattactccccgcatcgctggtcgcccgcgcccctgcgatgtggctcggaatatctaggcggagagtggggtgcgatattactccccgcatctcggtggcccaccgccctcctgcgatgtggatcgtaatatccagcggggagagcggggtgatattactccctgatttttcctgggatcctttctatgctgccaccctcggttcactccctgggacattatcttccatattctagcaagatgcggctgataaagtcgcaggggtatacacccttcaatattattcgtaattttgtaggggaatgttagacctgatgtcacaggactctgtacactgtgatgttattcccaatattctagctttaccttaatcataatgtcacattgtgtgtacaccttgtggtgttattcttattctcctaaagggaggttgcatttattgtcacacggggtatgttccttttgatattatccataatgtcctagagggatgtcaccccttatgtcacagggtttgtacgccttgtccaattactcttattatcctcataagatgtcactcctcatatcacagagggtgtacactctgtgatatttttgtcatattctagggaaatgttacttttaatgtcacagagggtgcacaccttgtgaaactattctttataattttgtggggtgttacccctaacgtcacacggcgtgttcacacagtgatgctacgtgcaatatgctatggaaatgctgctcgtaattcacaggtcctgtacaccctttcatattcttcgtaatctaggaaaacgttactgctaatgtcacagggcgtgtagatcctgttatcaaattcctaatatcctagcgggagttcactactcatttctcaatgcgtgtacaccctttgatattattcatattgtcttgaagagatgttactactgatgtcccaatgcgggtacattctctgatcttattcgttatatcctcgggggatgttacttctaatgtcacacggggtgtactccctgtgttctatttcataatatcctagggcaatttgacttttaatgacacatggggtgtacacattgtgatattatttgtgatattctagaaagatattactcctaatgtcacagggctgtacagcctgtgatagtattcataatttcccaggggtctatactcctattggcacagacgataacaccctgtgacattatttgtaatattctagcgagatgatactcctcatgtcacaggtggtgtacaccccgtgttagtattcttactattctagggggatgttactcctaacatcacagggaggtacaccctgtgatattactcatagtgtaccagagggatattagcactcatgtcacgatgcatgtacactttgttatattatttgtcatatcctaatgtcacaggaggtgtgttctgtgtgatattcttcctaacatcctagacggatgttgctcctaacgtcacagggtgtgtacatcttgtcaaatcattcacaatatcctaaaactatgttattcctcaggtcacagggggtgttcaccctgtgatatttttcatcatagctttgtgggatgttactcctaaagtcacatggggtgtacacagagtcacacagtgatatgagttgtaacattctatagacatgttactcgtaaatcacaggggctgtacctcctttgatattattcatagtattctaggggaatgttgatactattgtcacggaggtgtacaccctgtgatgtgactcgtcatcccagcgggatgttactactaatgtcacaatgcctgtacaccctgtgatactatttgtaatatcctaaagagatgttactactaaggtcacagtgcatgtacaccctctgatattattcgttatatcctttgggggtgttactcctcatgtcacatggggtgtactccctgtcatattattcgtaatatccaagggggatgttatttttaatgtcaccgggggtgacattacgcattaaaaatgcgtattcaaccccagtgatactattcctaatatcctaggggcatgctcttccgaatgtcacatggggtgtacaccatgtgtgtacacctgctgtgatattattcgtaatatcctagggaattgttactcctgatgacacaggtggtgtacaccttgtgtgtacccctcctgttttattattcataatatcctagggggatgtttcttttaatgtcacaaagagtgtacaaaacgtcacaggaggtgtacacgttgtggcgtgatctgcaataccctagaagaatgttactcctaataagtcacaggcttgtacaagctttgatgttatttataatctcatagagagatattacttcaaatatcacagtggatgtacacacatagtgtataccctgtgacagtattcataatatcctagggagatacaactcctgatatcacagtgcgtgtacccctggtgtgtacacccttgatgttagtcgtaatatccagggtaaatattactcctcatatcacacagtgtgcacaccctgtgatatttttcatcgtactttagggagatattgcttctaatatcacagtgggtgtaccccatgtgtgtatactctgtgacagtatattctatatcctagggaggtattactcctaatatcacagtgggtgttcaccctgtgacttcattcttatttgaccttgctgccttttttaacccacactacaaaaggaatggaacaaataagaagatattgagatgagatcgtgctgccatgtggccgctgcaggacacttttcatatccctgtttctcaggctgtagatgaaggggttcggcatggggatgaccaccgtgtacatcactgaggccactgcagcctttctcggggaagatgacacatctgaaccgaggtagcctccaatgcctgttccataaaatcagcaaacaactgacaggtgagacccacaggtggagaaggccttatacttcccacctgatgatgaaacccttagaatggagaaaacaattttattgtaagagaaaagggtccccgagatgggaagaaaaccaaatatggcggcagggaaatacatgattatgttattggtgaaggtgccacaatatgcaagatggggagttgagaagggtcacagaagaaattaggaatttccacatccttgaagcaggtcctttgtaaggcaatcaagttgtgcagctgggcgtctaaaagactgagaaaaaaaaaagacaacaaaactagaaagccacagaaacatgggttcatgatggctgaatgatatagagggtgacagatggctacaaaccgctcataggctatcacactcaggagcatgtctctcttccatgcctccaaaaatggcaaagagagacatctgagtcaggcagcctgcgtaggagatgactctgctgtgagactggatgtccacaatcatcttggggaccgtggtggaggtgaaaccgatgtcaggcagggacaggttggagaggaagaagtacatggggatgtggaggtgggagtcagggctgacggccaggatgatgagcaggttccccagcaccgtgaccaggcacatggacaggcacagcccagtgaggaccggctgccattctggatcctctgagcttctaggaggaggaatatagagacatctgttagattctgtgggtctgtagagattggacaacttttgcctagaaaagagggttgagaaatcggaaacaagtaaaccgacacccagcatcgtgtctgcattttggatagaagcaattcacaagtcatgttttcagatttcagagcaatccacactcagcaatagtttgcacttctgacaatctcaattgtcttctaatgctttcatcattgatttctgtgtgattcacttcttgttgtacacacctgcctcagagacactagattcaagaatgttccaagaacgagatcatcctatataacaaattcgtcattgctagaaaatacagcctatctttaccgacggaaactatgtaatcaaaccattctcttcactttaagaaaaaggttatcctaattaaaggaaattaagaactcaaatattttattttattcgaatagactgatacaaattcccttgatttagaacatctgtaaacaccgtataactgctgagaccatgccatctggaaatgaaattaaagttgatagttcataagcagagaatagttccacaggccggttggatcctattgatttcatcattctgttttctgacttttcaccttcaagagaggaattgcttcctcaaatctgtgggtcttgttttaaaattcatggaagctgtaactcctgtccttagctttggtggacttagcgttttcatcagaacgtttggccggacgcggtggctcacgcctgtgatcccagcactttgggaggccgaggagggcggatcacgaggtcaggagatcaagaccatccgggccaacatggtgaaaccccgcctctactgaaaatacaaaaacttcgcccagcatggcggtgcgtgcctgtagtcccagcttctcgggaggctgaggcaggagaatggcttgaacctgggaggcagaggctacagtgagcccagatcacaccactgcactccagcctgggcaaaaagagcaaaactctgtctcgaaaaacaatttaaaaaaagtacacgctctgtcacactgacgtcacactgatgacagccaatttttgtgaaccaaggaagtgtcaattcaataattcacatagatgttgactttggctatctcctatgtgccaagcgagatataggctctggggaatcagaaacaaaagagactcacttgttcctctcacaatactcaggacttactgagataaggacaaaagaaaatgtcctgtctggaatgcagggaaaccagaacttcaggtcaggggatatttccgttgaaccgtatggagtttaagctgaaaatattaacgaatgtatctaaaattcactttgccttgactttacgcatccatcacacagagatcacgcagcgggcacccacgatcggtttcatcgtcgctcacttccattggatcaactagaaatcaactcagatgagagtgctgagtctcagaagatggacgtctcaccccttgccatacagataagtagaaagggcggtattgaaaattaatggccagactctaactcctgcataccatacttgatggtctccaaactctcaaaaagttgtggggtttttttgtttttgttcttgtttttttttttttttttttttttttgagacgcagtctctttctcttgcccaggctggagtccagtggagtgatcttggctcactgcaacctccgcatcccaggttcaagctattctcttgcctcagcctgccgaatagctgagattacaggcacccaccactacacccagctcattttgttctctttttaggagagacggggtttcaccatgttggccaggctggtctcgaacacctgatcttgtgattcacctacctcagactcccaaagtgctgggattacaggcgtgagccaccgcgcccagcttccaaaagttttcaacagagctcagaggtcttaaccacaggcacatctgaggagcatttctgaaatggtttccagcttcctcaataggaatggaagccaaaccctgaattgatgactccttggaggaagtcgagagctgtaaggaaagccaggaacaggggcaagggagcgatgcatcccaaatgatcctgtgccaattctttctggaatctttgatgtgatctcagctgccctttccatacttgacacagtgattgcggcacccactggtctagctgtggtctacaaggaacccccaaagggaagggcacagtgagcaggggcatcggcctgactgacaaggattggagggggcaggttggatgcagggtgaggaatggccaaatgtcatgtgtctggccttagactgcctggttcagattgggcttcaccctttttgacttcatgatctggtacaagttatatgaaaatgtgttgctccttttctagtctgtaaaataatcatgaaatgtgcactaataactgggagactacacagatgaaatgaaacaagtagcatagaccacagagctcagagcctgcctttaggaagccctcagtaagggttcatgatgccgtggtgtctgtcatcatcctctttatcctcatcatcaccttcatcatctttttgttgttctcagggaacagtttagagagggactcattccctgcttgcatgggtgagatgtctatgaaaaggacaaccagtgggggagggaagcacaattttgaagaagattcctgagagagaccccccaccacaaccaagaacagaaactccacagtctgctgagctgacagtttgcacattggtctcctcccatctggccatggcactctcccgtttgtcctgaggatgaggaaacaaacaaggctcccgaccgtccctcagcactcactgaactgcccttctcctgtgctgggccatgaccacggagaacaggtccactgtcttccctgcgtggtacacaggggaggctcagactccatcctcaaggatgacaagaagacaggccaagacatgagcctcaggatacaggtgatgggtgtggagcccacaggactgcagcctcacactgcagggctggaggcacagactgagtatttactattctatggcctggggggctcaaggcatagagctccttattagccgaagtcgcccaagttccccaacctctaaagatttcctcataatcatgcaagaagaagaagggaaaagtgagtgtccatagaagttttggggctcttcctctaatcaggagagagcttgtgtaaaattcttcgcctctttcttttctttttcaagatccaagtgctttaattttcatattttattatgggaaaatataccacgtataaatcctaaaaattataaatatagattattgcatatagaatggccagtatgaacattcacaatttccactagttttcagtttagagtttaatcacattaggtacattcacattgtttagcaaccatcactgccatcatctccagaacagttttagctttcaaaatggaaattgcacccattaagcaaactctccattcctctctctcacccacccctgggggccaccattctattttgcaactctatgagtttaactactctagacacttgacagaaggggaatgataccgtgtttcattttctttgtttctttgttttggagacagtctttctctgtcacccaggctggagtgcagtggcatggtctcggctgactgcaacctccacatcgtgggtccaagcgattcttgtgtctcagtctcccatgtagctggggttacaggcgtgcgccaccacgcccagctaatttttgtatttttaatagaaacgaggtttcacaatatggccaggctggtctcgaactcctgacctgaagtgatacgcctgcctcggcctctcaaagtgctgggtttacaggtgcgagccacggaggctggtcatgtttatccttttgggatttatttatttcactagcgataatgtcttcaaggttcatccatgttgcagcctgtgtcagaagtgcctgcctggctttttcggttttttattatttatttatttttttggttgtgttttgttttgtgtttacacggagtctcactctgtcacacaggctggagtgcagtggcacaatctgggctcactgcaacctccgcctcccgggttccagcgattcttgtgcctcagcctcccgagtagctgggagtataggcacgcgccaccacgctcgtctaattttgtgcatattcagtagagacagggtttcaccaagatggccaggctggtcttgaattcctgacctcgggtgatccgcccacctcggtcttccaagatgctgggattacaggcgtgagccaccgcaccagccagaagtgcctgcatttttatggctaaatagtcttccgttgtatgaatgaactgcactgtgctttttcattcatctgcccacgaacccttgggttgcttccacattttggctgttttgagtaactctgctatgaatatgggtgtacaaatctctcttccactcctggcttctaattccttttggtgggtacccacaagtgcaactgcgggaacatctgatcattctgtttctaattttccaggacaggccatactatcttccccattccttcatggttttacactccctccaatcagattcgagcattcctacttctctctagtttcaccaagtcttgttcgtttatcatatccatcctaatatgtggtatcacattcttgctttgatttgcgcttccctatgattagtgattttgaacatcattttaggcgcttattggccattgctatatcttctttcgggacacgtctactcgagtcttctgaccattgttaatggggtgctttgggtttcttgttgtttagttctggctcttctttatatatgatggatattagcctcttttcagagatatgatttgcaaacctttttcctaatccatgggttatcttttcactcagttcacagtgtttgctgatgcgcaaaagtgtctgtcatttagatgtcatccaaggaatctaattttcttttgttgcctatgcttttggtgtcatatcccagaaagcactgcccaatctgatgtcatgaaagtgtggccaatgttttctttgaggcatattattctttcagcacttggggtgaggtctttgatccagtttgtattcatttttgcaccctctgtgacatagggtccaccttcattcttctgcatgtggaaatcaagtttctccaacaccatttcttgaaaaggctgcttttccaccaatggactttcttagcactcatgttagaaatcatttgaacatataggggagaagttatttctgggctcaaaaacaaacaaacaacaacagacaacagataaggatgcagcatggaccgggcgcggttgctcacgcctgtaatcccagcactttgggaggccgaggcgggcagatcacgtgaggtcaggagttcaagaccagcctcacagacacgaagaaacccccctctctactacaaatacaacattagctgggcgtgctggggcatgcctgtaatcccagctgctcgggatatggagccaggagaatcgcttgaacccaggaggcagaggttgcggtgagccaagattgcaccattacactccagcctgggcaacaagagtgaaactctgtctcaaaacaaaacaccaaaaacaaaaaatccagcatgatttcgagagcagaaagataatagctgaaaatccagcataatgagaaagttaggaagcttcttatcaaagcatctggaaatatgcaagaaattcctgtgaactaaaattttcatactgtgctgtcaaacactagaactcacttattccatctttctgtattttgggacccaattatccacttctcttcattccccatcccaccccttttcttcctagcatctgctaaccacctttatactttccaccttcctgagattccttttgtgtgtaggtgtgtgatggagtctctttctgttgcccaggttggagtatacaggcacaatccgggctcactgcaacccccgcctcctgagttcaagcgcttcttgggcctcagccctccaagtagctgagactacaggcacgtgtcaccacgcccagctaattgtttgtgttttcagtagagacgggtttcaccatgttggccaggcagttctccaactcctggcctcaagtgatccgtgtgactcggcctcccacagtgctgggattacaggcctgagccaccacacctggccaagattttcttttttgttcctacatagaagtgaggatgtgaaatatttgtcattctgtgcctggcttatttcacttaatatacagacctgcaatctcatccattttgtctgcaatggagacgattttcttcctttttaggctgaataatacttcattgggtgtgtataccacagttcctcaattgaaacaaatttctaaaaagcaaatatttttaacatgtctcggaatgtgaaacttcagggataccatgcccattttattcttttctatttcccatcttatgtatatgcaagtgtataacaaagcagcaatccaagtgtgtataaatctataatttcaacaaatgtaaaatgaaaatgctaagtggtggctgggcacgatcgctcatgcctgtaatcccagaacattgggaggcggaagcgggcagatcacttgaggtcgggagttcaagaccagcctgaccaatatggagaaacactgtctctactaaaaataccaaaaaaaaaaaaaaaaaaaaaaaaattagccaggcatggtagtgcatgcctgtaatcccagctacttgcaaggctgagacaggagaatcgcttgaataggggaggcagaggttgcagtgagccgagatcgtgccattgcactccagcctgggcaacaagaatgaaactctgcctcaaaaagaaaaaaagaaaaaaaaagaaaaagaaaaaaatggaaaatgctaaatggtaagaaacaacagcataataaacatttgtatggtgttgatggacaatgcatttgaagataatatttgaagaaatcatattacaattaacttctgctcttactcattggagcttgatgcctctaaaaacttcgtcattggaaccacctctggtgctttaaaaaaaaaaaaaatccacatactcacacaggtgcagggaaatcagaatctcaggtattgagacccaggcctcatcatctgtaagctccccaggtgatttgactcaaagccaagattgaggaacggcgacatggatctctacacataacctgcctaaatagattctctagaagcagtttataaagaaattccacatgaactctggaagaggatatgaatttgatgtacagtatgtcctcacttaatatctttgaaagtctcttggaaacttcacctttaagcaaaattaggtatagtgaaaccacttattcctcaccaacattataactacacaactttgaacgcaccaattgtgttggaagacttgctgtacattgtttccatcaagtcaattttcagggaattccaaaatgaagtgaggacttcatgtatataaaaagatggttgtgattccacctggatgacagggttattgctcagaaactaaaggaggccgcctaggtatagaggattctgtcatgaggtttctgctaaacaaaggagcccagaatactcacccattccagttaaaggcataacgaagaaaacaatattcacataggaaatgcggaaaggaataaaagccatcaagccacaaaaataatgtgactaaggggcagcatttgcagatgtagggatttaatgtggttgccctttctcacccacacaaaaaaaggatggaacagatcatgagattccactcttctgctgcgcagcctccacagggtgttttgaatgtccctgtttctcaggctgtagatgaaagggttcagcatgggggtgaccacagcgtacatcactgacgccaccacaccattcctggggggtggtgccacagctgaagtcaggtacatgccaatgcctgttccatcaaataagcaaacaactgctaggtgagagccacaggtggtgaaggctttatacttcccatctgacgatgaaatccttagaatggaggggacaattttatagtaagacaaaaggatccttgaaatgggaagaaaaccaaacatagtactatcaaaatatatgaatatgctattgatgatgctgtcagaacaggcaaggtagagaagttgagatggctcacagacaaaattagagatttccacattcttggagaaggtgaattgtcacacaatccaactgtgcagctgggaatccaacaggctaaggaaaaaggacaccaaaacgaagaagacacagaggtgaggatttatgatgactgggtagtaaagagggcgacagatggctacaaatctgtcataggccatcacagtcaggaacatgtcttctatacatgcaaaaaggaccaagaaagacatctgtgtcaggcagcccgcatgagagatgactctgctatgagactgcatgtccacagtcatcttgggaactatggccaaggtgaaaccgatgtcagcccagcacaggttggagaggaagaagtacatgggggtgtggaggggggagtcagagctgacagccagggtgctgagcaggttcctcagcaccgtgaccagatacatggacagggacagcccagcgaggaccggctgcagttctggatcctctgagagtcccaggaggaggaattctcagatacctgtgagattctgtggctctgtgtgacttggacaccttgggaagaaaagaggattggaaaaagaaaagataaaaaccagcccttaatgctgtgtgtatattttggatgcaagcaaatgaaaaggaacattttcacacttgcggaccgtacactgccagcgatgtttctcagttgtgacaaatccaaaaatctcagaattattacatgatttacttttttgctattgaactctttctgtacatactactttagagaaaatccactagagaatgttaggagaccaaaacgtcatatataacaaatccgtgatctcagtaaaatacggcctactcttttcagaaaaaatacaatgcaatgaaaatgtccttctctcttgaagaaaaagatctcagtctaattgaaagaaattaagaagctgtgaaatacactctgttttattctgacaccgtgctacaaattcctttgatgtagaatatgtaaaaggacgatacaagagctaggaccacattatctaaaaacgaaatcgaaacttagagttcttaatcggaacaccttttcacatgccagttacttttcatatttattatcatcctgaggttttctgacatcatttcttcaaaaaagtacatgcacactcaaatatgggagctgtgtttccaaatgaattgaatatataactcttggccgagtgccatggatcacacctgtaatcccagcactttgggcggccaaggctgatggatcacctgaggtcaggagttccagaccagcctggccaaggtggtgaaaccccgtctccagtgaaaataaaaaaaaaaaaattagctgggcgtggtggggggtaaccctagctactcgggaggctgaagcaggagaatcccttagaacctggaaggcagagattggacaccctgtgataggatttttgatatcctagggagatattgctcctgacagcagagtgggcgtacaccctgtgatattatttgtaatatcctagaaagatattgctcctaatatcacagtgactgtacaccctgtgatattaatagtaatatcctacagagatattactctgaataattcagtgggtgtacaccctgtgatattattcataatatattacagagatatgactcctgatatcacagtgagtgtacaccatgtttgtacaccctgtgatcttatttgtaacaactttgaaaaatattacagctaatatcaaagtgggcatacactctgcaatgttatttgttatccactaggtagaaattactcctaatatcacagtgagtgtacaccatgtgtgtacagactgtgaaattattcataataccctaggaagatattactcctaatatcacagtgggtgtataccctttgatattatttgtaatcacctagggagatacgattcctaatattacagtgggtgtacactccgtgatgttatttgtaatgtcctaggaagatattactcctaatatcaaagtggatgtacaccatgagtgtacactctgtgatataattcatattatcccagagagatatttctcctaatatcacagtgggtgtacactctgtgatattctttgtactatcctagagagatattgctcccagtatcacagtgggtgtacaccctgtgatattattcataatctcctagagagatattacctctaatatcacagtttctctacaccctgtggtattattcatcatatcccagggagatattatccctaacatcacagtgcgtgtacaccatgggtggacaccctgtgatgttattggtaatatcctagggggatattacacttaatgtcacagcgggtgttcaccatgtgtgcacgcactgagatgttacttgtaatatcctggggagaaattacacctagcgttacagtgggggtacaccatgtgtttctattctgtgatgctattcgtaatatcttagaaagttattagtcctagtgccacagtgggtgtataccatgtgtgtccactctgcgatgttattcgtattatcctagggagatagttctcataacatcactgtgggtgtacctcatgtatgtactccctgtggtcttattggttatgccctgggttgatattacacctaatatcaccatgggtgcacaccataggtgtacattctgtgatgttactcataatatcctagggagatatcactcctgatgtcatagtgggtttacagccctgtgatattcttggtagtatccttgggacatattactcctgttatcacagtgggtatacaccctgtgatagtatttgtaatatcctagggagatatcactgtataccctgtggtattatttgtgacatttgagggagctatttctcctaaagtcagagtgggtgtacaccctgtaatattcttcctaatatcacagtggctgtacaccatgagtgatatgtttttctaatatccagtgagggagaggatgatactgcttccaatatcacggaaggtgtacacccccttgtgatattgttccgaatatccagggaaggagaggatgacattattcccaatatcactgggggtgtaccacctcccacagggatattgttcttaatatctgtagtggagagaatgatgttactcccaatatcccagggggtgtaaaccacccctgtttgtaaacaggggtgtatcacccctgtgatattgttccaaatggcctgtgaaagagtcaatatgactcccattatcgcagggggtgttcagccctgatgatattgttttctaacatccagggaaggagagtatgctattactcccaatattgcaggggttgtacacctttttgtgttattgggcccaatatccaggaaaatagaggatgagagtactcccaatatggaaataattgtacagcacccctgtgatattcttcctcatatccagaaaggaaatgaatgatattacttccaacagtgtaggaaatgtatacccgtgctgtgatatctttcccaatatccagttggggagaggatcatattacttccaatatcgcagggtgtgtacaccccctctgtgatctcgttgctaacatccaggtttggggaggatgacattactgccaatatcgcaggaggagtccaccctgcccctgtgtccttcttactcatttcccaggtggagaggatgatgttcctcccaatatcgcagggggtgtacacacccctgtgaaaatcttcctcatctccagaggaagaggggatgatattactcccagtaccgcagggcgtttacacagccctgtgatactcttcctaatatccacagggagagaggatgatattactcccaatatcgcagggggcgtacacaaccctgtgagattgttcctaacatccagagtgaaagaggatgatatgactcgcaatatcgcagggtgtgtacacccctcctgtcctattgttctgaataccctgggagggagaggataaggtgacattgaatatcgcagggaatgtgtaccctccccctctgatacccttcctagtatccaggggaagagaggaaaattttactcccaatatcgcagaggcagtacaacccacctgtgatgttgttcccaatacgcaaggttggacaggatgatactactccgaatatcgcaggggtgttcacatcccccgtgacattttccttaatatctaggggagagacaattatatgacagcaaaggtcgcagggtctgtacatcccttcctgatattgttcctaatatccaagggggaagaggatgatatcgaatatgaaaaggagtgtacaacccccacccctaagatattgttcttaatattcttgaggggagacgatgatataactccaaatatcgcaggggttgttcacaccccccgtgatattctttccaatatcctgggtgggagaaaatcatattacttccaatattgtaggtagtgtattccccacctgaaatactgcactgaatatccaaagagggagaggatggtattcataccaatatcgaagtgtgtgtgcacgccccttgtgatacggtttttaatatccagtgggcgggaggatgatattcatcctaatgtcacagagggtgtacactacccttgtgatactgtccctaagttccagatgggagaggatgaggtcactcccaatatctcagaagttgtacatcccccgtgatacttactgttcatcatatccagggaagcacaggatgacattccattgaatttcgcgacaggcgtacacgcacagtgtgatattgttcctaatatccaagaagggaggagatgatattactcccaataaagcagtggttgtacattacccgtgtgttattgtctctaatatctggggccgggggagcggggaagaggataacattccctcaaatttagcaggtggtttgacgcccctcgtggtggtgttttacatatccagaggggaagacaatagtactatttttgatagtccaattcatccgctccacctttccagaactctgaggctgggaggcggcatgcagtttccgtgtgatccccaatacctttgctgtcttctgtagcaagtcagctacaaatgcaggcccgttatctgagccgatccggaagggcagtcccaatctaggaatcagacctcgaagaagcacacgggtttcttcacgaggtttcccagttcgtgttggataagcctccacccacccagagtaggtacgcccaagaacaagtaaatacttgttacctccacactttggcatctctgtgaagtctacctggagatcttcaaaggggactgctccataagcttgtacactgggctgaacggctggaccttgcctcgcattaggctgtaggcaggtgacacaccactgcctcaccgttttggcaagagctgacaaatgtgagatgtagaaataccagcctaacaacttttcaagtgactcctgacatagatgggtgccagtacaactgcagttcctcacagctgtggcacagctacgctcccatctggtaactgactccatccttcctccatcacttgtccttccctctacctggagaaagtccttttattctttagaataagcaggtccaagatcaggtgcttgagggagcagaggggctatgactgatgcccggaaggggacagatgctgcttttgcagcctctgagtcagcgcgggaattccccaagcccaccaaggtggaagctcgctggtgtcctctgcaatgcataactgccaccttgtggggtttccatactgcttctaataaatgcaagatttctggttgttattttctgccttttcccccagagttcaataggcccttttccttctatcacgctccatgcacttgaagggttaaaaagacataccgagaatcagtgtaaatgttgacagtctcaccctcactgagttctaaggcctgaatgaaagcaatgagttcagctttctgggtgaagtggcctggggcatcgatctggcttcaacaacagtgtccagggttaccactgcataccctgcacctctctctccttgcgggatgatgaagctgctcccgtccacctatagttcccagtctactgatgcccaaggctggacccggaggtcaggtctgctagagtcaaccgagtccaacatttctacacaatcatgcttgacagggctctctgatagtgggagcaaggttgcagggtgtaggatgttacaaacttcaatggttatatggggattttcactttggtacttggtgagtctcgcattcgttagccaatcatgtcctttagtattcattaaagtcaccacagcatggggggccttttctgttcaggttctacccaagagtcagcttatttgcttcttgtactagcagggcagttgctgccaaggccctcaaacatgggggccatcctttagagaccccgtctacttgtttagagacgtaggccaccagcctcggccagggccccacagtttgggttcaaagtccggctgccatcttttctctctctgacacatacgatgtaaaaggctttgtcagatcaggtagccccagggctggggctgacataagtttctcctttaactcgtgaaagacttgctgttgttgggatccccattcaaaaggttcccggtccccgcctcctttgtgacctcaaacaaaggcttagctaatactgcaaagtttgggatccacagtctacaaaacctcacagctcctaagaattctctcacctgccttctgctcttaggctctgctagatggcaaatgacctgctttgtttctgatacgaggctgcattccccctgtcagatagtatatcccaaggaacatacctgctgtcagcagatctgagcttttttcttggacaccttatacccacagtcctccaggtgtgggcgtagggcaatccgttcccttggtgcacccgactgccgtggggtgtcccagccaaagctcatcaacctaccagagcaacacgcagcctaggtctctggtgggaaacttttggaggtctcgagccactcacacatgtaccttggggtgccaccatgcatggatctgagtgttgcggtctgttgtgagatgatgaaggatctcaggcatgttcctaaacatgtctagcttattgacatgaatctaaggaaaataatatgtacgggcaaattatttgaactgtatttcctataaattgttcaaggttaattactcagggcaaaacacccagttagtgaattcaccctctcttctttcttgaaaagcagtttttggctatttcagtgcactctggtatcctgccagcatgtcaacaggcacaaggctgactggtcaggatcgctgccatcactgacggaagcgaaaaattacagagactcggctcagggatgtcatttaatgatgttaatattgtccttcagtccttcaagggaaattcaattaatgttcttgtacacctactgtgtgtcgagctttattctaaatgcgaggaataaagcagtaatccacacagacaaaaacaatcaagaatcatctaccctcggccaggcgccatggctcatgcctgtaattccagcactttgggaggcggaggccagtggatcacttgaggtcaggagttcgagaccagcctgacaaacatgctgaagccccatctctactaaaaatacaaaaattagccaggtgtggtggctcaggcctgtaatctgagctacttcagaggctgaggcaagagaatcacttgaacccaggaggcggaggttgcagtgaaccgagaccatgccactgctgcactccagcctgggtgacagagcaagacagtctcaaaaataaaataaaataaaataaaaaatcaagaatcatctttaaggcatatacatgacatgcaacagaggagcatgtactgcaaaaaatccactcccatatctccttgttcaaatttattttcaatgctggtcacaatcgctaaatttatttcatgacccaaagtttgggaaaaatactttgtctatggggcatttcactgaaggctcttgtaagccatttgggcttctgtcaattttctcccaggaggatgtgactgaactaagatgatatattccttcagagggcccgcgaacctctgctgcagacacgtcttgatagggtgcttccatctgtccctgtttgcagttatttagcaggcaaggagggggaggaaaggtgagctgggaggatggaagggagcaagagaaaagaatgaatatgctgggagcactggctcacgcctataatcccagcactttgggaggccgaggcaggcagatagcttgaggtcaggagttcaagattagcctggccaacatggtgaaaccttgtctctaataaaaatacaaaaattagccgggcatggtggctcacacctgtaatcccagctactcaggaggctgaggcaggagaattgcttgaacccgggaggtggaggctgcagtgagccgagatcgcatcactgcactccagcctgggtgacatagcaagactccctctcaaaaaaagaaaaaaaaaaaaaaaaaaaaagaatgaacagtcaccatacctggactcctaattcttcactaaggttggtgaacaaatattcatagccataagccgctttgcagttcagccacacaacatggtacaggctctgagtgatccagctttgaaccagctctaagactccacataaacactcctcctagacaggattttaaagagacatttaacaggtggagagccgcacatagccttttccttcccaacagtcccaggtactcacacctacggggacagttaggatatgacctgtcaccctacaaacttcctactaaaaacacgggcacacccagatgataacccttttcctccaggcagacttacctgacttggaatttggtaaaatcttggatcacacaacatagtatctaaatatacactttggatgtctttgaaaagaagaaaaaaattgatgttagccatccaatgtgatataaattatgtgtaactttttttgttttttgagatggagtttcgctctgttgcccaggctgaagtgcaatgtctgctcactgccacctcctccatctcccgggttcaagcaattctcctgcctcagcctcccaagtatctgggatcacgggtgtgcatcaccactccttgctaatttttgtattttttagtagagacagggtttcaccatgttgaccagtctggtctcgaactcctggcctcaaatgatccacccacctcggcctcccaaactgctgggattactggcatgagccaccacacctgtttat

SEQ ID NO: 334 - DNA, 6269 bp, Homo sapiens
cgactctctggaatggttcattcctcgcaaatgaatagataggagatatctactatcaggaactacaaacacagtctccgtgctgtgatccgctttcacagggaattttgtctgggattcaagtagcggcaagtaaccctttttcgccctccatctctgctcaggggtgagccctggcagcgctcctacctgggacctacattggcttagtaagatgggccggcgcccaccccagccctcgcgcatgcgcataaaagcccactcccgggggcggggcctgagctagctgggcggggcctgaaggagccgggagctcctgcagcttcatcgcgttactaagagacgcgagggtcgcgaagggcacaacacttggcctctcgctggccctgctcgcggatcccgagtagagaacgcaagcacccacgcccgcctgcaagctcccgggcgcccccggcctctcctgctcggcggaacgaggataacccagtagagccggacccaggggtgggtggatgcgtcgctggaggcgagggccctgcccgccaacccctgcgccccggccgtagccccaccccggaagttcttgccccgccttctcggctccgcagttctctgctgtctcctgaggtttgccagggagatcccgtggttttcatgtctcttccgtgatttttagggaagagggtcactatttggcccttccagaatctcagggtccggttctcccggaagtttccgggccgccccggaccccattggctttaggggccgcgtctccgagggctccgatttgggccctagattttggaatactgtgttttgtccgtcccagccttcaccaggcggatttcatctcccacacagttagtgatttatggcagaaaggaagctggagggatggggactgcaggttagctgtgagggccggaagggagcggttttgtgctgcacacaggcaggtcagcactcccagagcagggaccgccgggcgtgctttcggaaccgcttttgtctttcaaatgaacgcccagcgacagcagacgggagttccaggaccttagagaccggctaatgcttctctttaagttaggaaacaggcgcaggcgtgttcatggccttgcctaaggttacgtgctggttacagggctcctcctgctgcctcttaagaacagaaataatctaataggaggaataaaagggactattagggaggctaatgctcttgaagttttaatactactaaaagtaaaagcgcttttcagagtgaaagggaagtgaaaagggaatttgggtggctggctacatcagaagcttctgttccaactttagattgtcagggagttgagatggtgttttttgtttttatttttgttttagttttttgagacggagtctcgctctgtagcccaggctggagtgcagtggcgggatctcggctcactgcaagctccgcctcccgggttcacgccattctcctgcctcagcctcccgagtagctgggaccacaggtgcccgccacgatgcccggctaattttttgtatttttagtagagacggggtttcactttgttggccaggatggtctcgatctcctgacctcgtgatccacccgcctcggtctcccaaagtgctgggattataggagtgagccaccgcgccgagatggtgtgtttttaaaataacgtgcccgaggccgggcgtggtggctcacccctgtaatcccagcactttgggaggctgaggcaggcggatcacctgaggtcgggaattcgagaccagcctgaccaacatgggaaaacctcgtctctactaaaaatacaaaaaaattaaccaggcatggtggcgcatgcctgtaattccagctactcgggaggctgaggcaggagaatcgctttaacctgggaggcggaggttgtggtgagacaagatcacgccatggcgctccagcctgagcaacaagagtgaaactccatctcaaaaaaataataaataaataaataaaataacatgctcctcaatttaactatgggattatgtcccaatacacccatggtaggtcgaaaatgcatttaatgcacctagccaactttaaacgtcctcagaacacttagctcccctgcagttgggcaacatcatctaacacaaagcctattttataataaagtgttgactatgtcatgtaacttactgaatactgaattcaaagtggaaaacagaatggttgcgtgggtactcgaattactgaatgcgtattgcttttgcaccatggtaaagtggagatatgagttgaaccattccacgggaccatctgtatgcatataaaccctaagtatttcatataattcagtttcacaaaccagaaactcaggcattgctgtttcctgtttgtggagctacaacttggtattttagatgtcaaatttatttatttttttgagatggtgtcttgctctgtcacccaggctggagtgcagtggtgcgatcttggctcaccgcaacctccgtctcctgggttcaagtgattctcctgcctcagcctcccgaagtagctgggactacaggcagccgccaccgcatccggctaatttttttttttttttttttttagtagagacaggttttcaccaggttggctaggctggtctcgaacccttgacctcaggtgatccacctgcctcggcctcccaaagtgctgggattacaggcgtgagccaccgcacatggccaaaacgtttatttttatttatttatttttttaacatttttttcttgaggcagggtctcattcttgtctcccaggctggaatgcagtgacttgatcacagctcactgtggcctcaaccttgggggatcaaacaatcctcccaccttagcctccccagtagctgagactacagtcatgggccaccacacccagctaattttattttttgtagagatagggtctcactacgttgcccaggctggtcttgaactcggactcaaaggatcctccctcctcagtctcagaaagagctgggattacaggtgtgagccgctgcatccagccattaaatgtattttttatcaattctttttttggcacaactgccagcaaagaaaccactcagtctgcaagagctaagtactagcagaattagaactgccactgaatttcctagaatcactgaaaaatttaatcaaggaattgtaagttgatctttcctaattttagtttcattttgtgtttttaataaactgaaagtaagggcaaaaaaaaagaatttccaccaccacttatatagcgtagttacagtagtcactagagttcctactatggtgaaatttacattcatattctctttaggtattttgggaaaataaaattttgaaatgcttaataataaccggaggatgtctatttctactgagaaaagtggtgatttcccccaaagtccaattgaatacagcatattttctgctcttctattaaatgtagcatttttatgtatagttgccataattttttgagctgaaagtgacaaaaggttacatagatggcattcaagaaaatacgtttcgaatgaatatgagcaaaaagtcaagcctaaagcaaaaagggcatagataagacaaaaattaagattgtatcactacatgtgcttcatctgtaaaagtcctgtaagtaatacagtcactaaattcatataaaaatatgactaatttggaattttttttttttttctttttttcagacagtctcgctctgtcacccaggctggagtgcagtggcaccatctcggctcactgcaacctccatctcccaggttcaagcagttctctgcctcagcctcctgattagctggaattacaggcatgcgccaccatgcctggctaatttttatatttttagtagacacggggtttcaccatcttggccaggctggtcttgaactcctgacctcgtgatccacccacttcagtctcccagagtgctgggattacaggcgtgagccaccgtcctgtcctgaaagtattttaatacagtgaattcactaacttttttttttctctcttaatttagacagagttttgctcttgttgcccaggctggagtgcaatggcacgatcttggctcactgcaacctctgccccccaggttcaagcaattctcctacctcagcctcctgattagctgggattacaggcatgcgccaccacgcccggctaattttgtatttttagtagcgacgggtttctccatgttggtcaggctagtctcgaactcccgacctcaggtgatccacccacctcggcctcccaaagtgctgggattacaggcgtgagccaccacgcccagcctaacttttttctttaatatttcttagaacctttttcctgtgtaatatatctatattcctgtgtaatgtttcatattatatatatgaatggattcttaggctgtatcacatgtccaactcacctctttgtcatagctggtatattgctattatattgtgcagcagtggagtagtgaacttcccactagaatgaatggcattaaaggacaaaggtttcactgaagcgtggcttatttgttttgccaggtgttccaaattttacataaactcgtataatactgtaaaactggaccgggtgcggtggcttacacctgtaatcacagcactttgggaggccgaggtacacgatcacttgaggccaggagttcaagaccagcctgagaaacatggtgaaacccatctctactaaaaatataaaaatttggcaaggcgtggtggctcacgcctgtaatcccagccttttggggggctgaggcaggcggatcatgagttcaggagatccagaacatcctggctaacacagtgaaaccccgtctctactaaaaatacaaaaaattagctgggcatggtagtgggcgcctgtagtcccagctactcaggaggctgaggcaggagaatagcatgaacctgggaagtggagcttgcagtgagccgagatcgcgcctctgcactccagcctggtgacagagcgagactccgtctcaaaaaaaaaaaaaaaaaaagaatacaatataaacactataatatttagaatgttaagtaatttaacaaaaatctaaataggaagagcattagaacatctttcttgtttttcatagaaaagagtccattggtacttgtgacttagcctcctaacagtcttcattatctttttttaccaaccactaagggaacatttaggctacatctttcatattgaagaaatatttgtctgaaattcagcaagtctgtctattttatttccatttcctatttttcctctattaaatccaagtgaagctaaatttatgtcttgtaaaagcatttattagaagatccttttaaataaaacttttaagtctatgttaattaatcgtatatttagcatgatttttacccagtatgaaggatggatatttctaattaatgtcatgcttattttgagttttcctttatatatatgtatataagagtgtgtgtgtgtgtgtgtgtgtatatatatatatatatatatatacacacacacacacatatatatgtatacttttttttttttttttttttttggagccagagtcttgctctgtcacccaggctggagtgcaacctccacctcctgggtttcaagcgattctcaagcctcagcctcccaagtagctgtgattgcaggcacctgctaccacgcccagttcattttttttttttcctttttgagaaggagtttcgctcatgttgcccaggctaaagtgcaatggtgtgatctcagctcactgcaacctccacctcccaggttcaagtgattgtcatgcctcagcctcccaagtagttgggattacaggcatgtgccaccatgcctggctaattttgtatttttaatagagacggggtttcaccatgttggccaggctggtcttgaactcctgacctcaggtctcctgacttcagtctccccaactgctgggattacaggctcgagccaccatgtccagcctttccctgttatacctttaatgtatttcttgaccttttaaacataatgagcatttgttattgtgattgaaaaaaattcataaaatattaatttatttacaggatctgactttaatgtgtttcagccaatagaaatatattttaatagaagaatgcattcaaggaatcatagtgaaaattctgtacactttatttcagttaaatgactgatatattttgttaataaaataagtagctgag

SEQ ID NO: 335 - DNA, 82964 bp, Homo sapiens
ggtcaatgagattaagcaaacaaaactgagacctagatctcactcttgaggaagaaggaaaacatatcaacaactaccaaatgttgacttctgccatattgttcaatgccaacagacttaattttttttttcttttttttttttttttttttagatggagtcccactctgttgcccaggctggagtgcagtggcgtgatctcagctcattgcaaccattgcttcctgggttcaagcaattatcctgcctcagcctcacaagtagctgggactacaagtgtgtgccacgacacctggccaaattttgtatttttagtagagacagggttttaccatgttggccaggctggtcatgaactcctgacctcaagtgatccatccgccaaggcctcccaaagtgctgggattataggtgtaagccaccatgtccggccagagactcaatattctaattaatgtggataactgaagtatgttacaaactgaggcaaagtttttgtcaatctacctctaaaaatacttcccacttaaaaaaaattaagttattaaaaaaataaaacttacaattcgtttcttccaaaatctgtatttcgggctcgttaacaacaactccttagtcacaggtgaacagtatagataaaccttcaagctgaaaggaaaaaagaaaaaaactttcagtacaatccaaaatgagccatcttggtgactaagaaatctatttcatcatacatctaataatttcatttgagaccagtctgaccaacatggtgaaaccccatccctaataaaaacacaaatactagcctggcatggttatgaaatctatttcatcatacatctaataattcagaaattacgctggcacaaaatctgttagagtcactctcaacatacctatgcacaccatttcagtgccaccaagagcacaaggtgggggtggaaacacggtgtccctggacctcctccaacagtggtccctcaccattgttacttggaaatacgcgcttgtatgtgatcaggtgtgtctggaaagataccgccacacattacactacctctggaaaaggtgtgttgagaacagaaacttctgctttttactgtataagtctattctttttttttttttttttttttttgagatggagtcttgctctgttacccaggctggagtgcaatggtgtgatctcgtctcactgcaaactccacttcccaggttcaagcgattctcctgcctcagcctcccgagtagctgggattacaagcacgcgccatgatgccggactaatttttgtatttttgtagagatggagtttgaccacgttggccaggctggtctcgaactcctgacctcgggtgatccacccacctcggcctcccaaagtgatgggattacaggcgagagccactgcgcccggcctattctttttttttttttttaatgaacagaaattaatttcataataaactttttttttctttttttttgagatggagtcttgatctgtcactcaggctggagtgcggtggcgcgatctcggctcaaagcaaccttccgcctcccgggttcaagcgattctcctgtcttagcctcttgagtagctgggactacatgcgcaccaccacgcccagctaactttttgtatttttaatagaaatggggtttcaccgtgttggccaggctggtctcgatatcctgacctcaactgatccacccacctcagcctcccaaagtgatgggattacaggcatgagccaccgcgcccagaccataataaacttttaaaacttaacgctatcattttgaggttaggaatatagtctacggtagattgtattttccaaagatggccacacaatgacatacaccatccatacatgctctccttacaaaatagatactaaaattcctccactgactggcggggtctatgttccctccccttgaacctgggcagttttctgtaattaccttcaccatagaatgcggtggaagtaattgcatggcttttgaggttagatctccaggtagtacaacttcctcctagctctctcttaggacatacgctttttaaccctgagtctccatttaacaggtctggccatcctgacagactcacgctaaagagatttttttttttagggggaggggagctcactgtcacccaggctggaatgcaagctatcctcccacatcagcagcctgagcacctgggactacagcacatgccaccacacctggctcatttttcctattttctgcagagatgaggtctccctacgttgcccaggttggtttcaaactcctatgctcaggtcatcctcccacctcagcttcccaaaggcctgggattataagcctaagccactacgcctggcctaaagagacttttagagatagagatgccgcacgcctgtaatcccagcactttgggaagccaaggtgggcagatcacttgaagtcaggagtttgagaccagcctgaccaacatggtgaaaccccatctctactgaaaaataaaaaattagttgggcttagaggcacgtgcctgtagtcctagctgcttgggaggctgagctgggagaattgcttgaacctgggaggcagagattgcagtgagccaacatcacgctactgcactcctgcctgggcagcagagttcgactctgtttcaaacaaacaaacaaacaaacaaacaaacaaaaaaacatgccaaatggttctagcccctagctgtgtgagttttcccagcccaggtatcagacatggataagggagtcttcagatcttaaggggctgacatctgaagactctgctcactgatgtttgatacctgggctgggaaaccattcccattctaccctgtcaatccctgatccacagaaactgagcaataagacatgatcagtgttaagtcactccattttgaagtaatttgttacgcagcagcagatgactgatacataggctctgcaatcagacagacctggctggaatcctggtcctgccacttactggctgtgtgacactgggcaactaatttaacctctctggttcctcagtttcctcatctgtaaaatagaaataatagtaggatctattcaaaaggttatcaagaagctctaatgacaatgtcaggtacaagtgtgcagagccttgcatctgtgtggctcactaatgcattctccacctccagtacaatgcccgacatgtcacaggtgaccaaaaaaaattactgaggccaggagtggtggctcatgcctgtaatcccaacactttgggaggctgaggcaggcagatcacttgaggtcaggagttcgagaccagcctggcgaacatggtaaaacccctctctaccgaaaatacaaaaagtagctgggcgtggtggtgggtgcctgtaatcccagctactccggtggctgaggcaaaagaatcactcgaaaagaagttgcagtgagctgagatcgtgccactgcactccagcctgggcgacagagcaacaccctgtcacaaaagtcaataagtaaatacaaataaagtaataaaaaattattggccaggtgcaaaggctcatgcctataagcccagggctttgggaggccaagatgggagatcacttgaagccaggagtttacaaccagcctgggcaacatggtaagtccccgtctctacaaaaaaaaaaaaaattgttgaacaaaaaatacacagtgccaagatacagtaagtattcaataaacgttagctatcattatcaagaagacagagtattgctatcaattagcagagaagcctgacatccactggcccttttcaaatatgtatcttgagaagggggaatttagatgtaggcaatggctgcaagagaagcatctaacagttcagctttaagaaaaaatccagtattatatgatcctttacaatggaacagccattctctctcatatactcttacagaaataacatggagtgagttactgctgtacctagcagcatagataaatcacacaaatacaaagttaagtaaagtaaaacaaatataaaagggtatatttggggccaggtgccagtggctcacatctataatgccagccctttggaagaatgaggcaggaggatcacctgaggccaggagttcgagatcagcctgggcgacatagcaaaactccatctctgttttttttgttgctgtcgttgttgttgttgttgtttttagagagtgtatttggtaggattatatatatatatatatatatcaagttcacaaacagccaaagctaacccatgatgacaaaagtcagaatagaggttacctttgggaggagggaatgagttgggaggtaagaggggtctgggatattggtactgtcctatttcttaatctgggtgatgcgttcattttgtaaatgactatatgcttggatgtatatacttttctgtacagttgttatctctcaattaaaatgtttgcttaaaaacacaagtagcaaaataaattacctgcactccaaccttcttttcaaggtaggggctcttaatcctttcatgtgatctaaaaacaaaagaacaaaaactcatgaatatgtttttccagaggattccttagcccaagggaaacagtcgtcttctttttcagcttcaagagaaaacccatgaggtttgcttttataagaattgattcacatgggctatgagctctttcttctgcaagtgaagaatcctcctcagaacaggaccggctgcccatttctgagccatccaagtcaatttaaaaggagagtgattctgtgcatcataggccagagtttaaatcactctgggcagccacagaagaatgagaactgcttctagccctccactcttacttcatttcaatccaaccatccttcgagccaagctctatgggacccattcactttctgccacttaaatcagtctatctagaaattcaagttcgtggtcatggagtctgctgggaaatcactcaggttcagagtaagtgtttcgtcatcttctcagcctactgtgatggattgaaaggggaatattactatccacaaagacttgctccacagcgctccacattaacagacacagacaacagaaaggtagcaattagaccgactattacattaagtatatcatgcattccaatatattctgaatctttagcaagtaaaggcccagacaacaatgatcaaacagctctaaattgtttaactaaaccagttggacatggtggctcttgcctgtaatcccaacactttgggaggccgacgtaggcggatcacctgaggtcagaagttcaagaccaaccttgccaacatggtaaaaccccatctctactaaaaatacaaaaattagccatgaatagtagcacacccctataatcccagctactcgggtggctgaggcaggacaatcacttgaacatgggaggtagaggttgcagtgagccaaggccataacactgcacttcggcctgggcgacagagtgagacttcatctcaaaaacaaacaaacggctgggcgcggtggctcatgcctgtaaccccagcactttgggaggccgaggcaggcggatcacctgaggttgggagttcgagaccagcctgaccaatacggagataccctgtctccactaaaaatataaaattagctggggctggtggcgcatggctgtaatcccagctacttgggaggctgagataggagaattgcttgaaccccgaaggcagaggttgcggtgagctgagattgtaccattgcactccagcctgggcaactagagtgaaactccatctcaaaaataaataataaccaaaaaaaaaaaaaaaaaaacaagaacaataaattgcttagctaaaccaaaccaattctaattaccacgagcaccaccacacacacacacaagcaccccctcaatttatatgtcgtgtggccatcattagacccagtgaaagcagagcagtcaccacatgtcacttggcagcccttgattgtatatatgcctccaggagagtccacctgtctcccactgggtaaattccctcaagggatatctggtccagtcttttagggcctatgggtatatccctgggcagcattctccgtaattggagtttccaaagagtttgcgccatggcaaagaggaggctgaatgcagactctgcatcctgctcccacactgactaagcaggcagcaccctgcatggtgcatcatggtcccccatcctcaccaccctgaggccccttccagctggtagtcacaagaactggatgggtttgctttgtgtggctggaactgcacccaggtctgcttttccagggaggttttccttttccttggcaaccatcataaattgtcccctctaggggatttccccaaccctgggccactatctcaggtctcaggggtcggggggccctctcatctttcagaacttactgatgatgcttagtaaagcccaccctgcacacagcattggcttccagatggcccacaaataagcatcaggtgggtccatagcctactccgaattatatcaaaatgtgatgtggggctgggtgtggtagctcacacctgtcatcccagcactttgggaggctgaggtgagtggatcacctgcacccaggagttcgataccagcctgggcaacatggggaaatcctgtctctctataaaaaatagaaaaattagccaggcatgatggtgcatgtctgtaatcccaactactcaggtgggagtacttgctgaggtgggaggattggttgagtccaggaggtgaaggctgcagtgagccgagatcgcaccactgcactccagcctgggtgacagagcaaaaccctgtctcaaaaaaaaaaaaaaaaaaaaaaaaaaaaaaaaggaagtgatgtggatgggtttccatgcattttttctagcaaaagagtccatacagtttctcatgtttgagctgctatcacaagataccatagataccatagttggccttcacaccagcgctgtaaggaaaggtagtgttttggttgccttcaacaccaaaaaggtatttctcacagttcaggaagctgggaagatcaagatgcggggcgatttggtttctggagagggcacttttcctaacttacagacagccgccttctcactatgcactcacatggctttcctaggccccgcatgaggacagagcgccctctctcttccttctcttgtaaggaaactaatcctatcagagtaggacaccacggtaggaccccacttaaacttattttcctcctaaaagccccagccccaaatacagtcgctttgggggttagggcttcaacatatgaattttgtggagatagtccatatcataatcaaagaagcctgtgtcccaaaaaggtgaaaagccaacagaaggcaatgtgagaaacctccaaaagcagaagttgtgttttcacccttgatgagtttatgtcctggttgactaagcagatccacatgtggtcagagaacagaaaaagttgttatagactgttcaacagtagggaagagtccatttctggcttaatgcacaaacttatgatgatttcaaattcctttagatttattatttctccaaactcagccatcctaaacacgaagtgcaagtttcggaagtatactttaatcctggctagcccattttgagttcagagactccagtgcggctctacacaaaaagtaaaaataggcatatcctcgtccagcagtggattctcaatgaaaaacaaaaccagaaatgtgtcaggcacagcggctcacacctgtaatcctaacactttgggaggctgaggtgggtggatctacctgaggccaggagttcgagaccagcctggccaacatggtgaaacatcatctctactaaaaacacaaaaattacctgggtgtggtggtgcgtgcctgtaactccagctacttgggaggctgaggcacgagaatcgcttgaacccaggaggcggaggttgcagtgaacagagatcacgccactgcactccagcctggtgatggagactccacctcaaaataataataaaaatacaaacattagctaggcatggtggctgactcctgtagtcccaactacttgagcagagagcatgtgccacactgtactccagcctgggcgacaaagggagaccctgtctccaaaaaaaagaaaaagaagaaggagatgctcaaagacgtgcacgatgcgaatacggcaacgcacgagaagaggtccagattttcccattaaagagaaatcactggtggctttgtggaaaaaaaaagcagagacatttcgcagaagcagtaacttcaacgatttatagtccaagtgattgattccacacacaaaacaacatagctggccttcacaccaaccctgtgaggaaaggctgtgtttggatacctgtaatttactttaaaatactttcctactgcgcaggtacagataggtttgttacgctgattgactccacagggtagtgggagcttcctgctccagcacgctgcaaggccacacagcaggaggcagcaactccagtgattccgtttatcattttctccaattaacactaatggctgggcgaattagcacaatgagcattaaaactgttttccctggtaaaagttagtgacttgttagcacaatagaagtgaaaatgaacaatggttgtcaagttagcggtatttaaactctggaacttagctccaatctctgcttggagcatcagcgacactctaaccttaatccctaaatcggcccagctgtgaaaggatccagctgtgaaatcatagtagcttttcaggttgcctgataccatctagaagggaaacatccctccaacctaaactagaacgaaactttcatattggatacggacagaacacccaaaggccaaggagcttgcacttcgtggagctcttaggcgggctgttccacagttgtgtgtgtgtctgagtctcctgcttgctgaccaatgtttgagggtgtggtcaaatggatctgaaacttgttttcttcatacatggtagcgaggctctgagggaagtactaaccctcgccaatctctgatcatcggccaccagcaaagctaccaagagaaactactagcagtgcttgaccaagccggcccggggcgcaactggcaggcgccgttacgccgcgttgaccacatccgaaaatagatgaagcctttgagaggctgaagagcccgactgggacaaggcgtgtgctggccgccccctcgctggcttcccacaggctgcagctccttgctccagggccggccccctcctgtcctctctccagcccccagcgccccgggagcgggcgacgcgcagccctcactcacctttgtggcagtgggacaggaagtaggcgcgggccctcaggttctccctatcgaagcggtctatggagatagttggatactcggccatctgcccctcgaaagaactcatagcgccgccgatcccagagtccgggaccccaaaaccgcagctgaagccaaggccagccctgaccgcgccgccacttccgggaagccgcgcgctgcctcgccattgggcggccgaacgcagccacgtccaatcagaggagtccggagaccgggggcaaagtcaaggagcatccggtcgggttctaggcgcccgctgcttgggtttaaatcacccgcgcttcgctgcacgcgatgggccctgagccctgcccagtgcaaggctcattcccgcccaacaaacacaggtgttgctctggtaaggcgttgcccatgtctgtggaggtgcagtcgcgggaagggaaatcgaaactcccagagcaggtggccccagccgacgaggtgagtgggctgcggaactgcgcttagaaatcattcttcgttccgcttcctgcttgtctgctgctagcctgaaacccgagctcagttccccgccctctctcttctgttcccaatttctaaccttgtgggattaccgtgagggttgtatgagaaagtttgtatctgactcatggtagattcaggaactattaattccctcttccgtttatataatctacaaactgaataaatcatctctgcgtgatcttggggcaaataagatcccaataatgccttcgctgctggcctctcccctgggcccccacctttttgagctatacttttaggaagttagaatgatgtacttaaaaaaagaaaaatggcaggaaaggtctaaaattttttaacaaccaaagcaactttatgaaaaggtttgttaaaccttttattgtatttcctttattgtattacaataaaccaaataatcaccatgacatttattgtgctccttcctatcaaatctccttagtataattaaacacaaacaacccagaacactttcgctttattttatttatttattcagttggggtctagttctatcgcccaggctggagtgcagtggcgtgatttcggctctctgcaacctccgcctcccgggttcaggcgattctcctgcctcagcctccagagtagctgggactacaggcacgcgccgccacgcctggctcatttttatatttttagcagagacggggtttcaccacgttgaccaggctggtctcgagctcctggcctcatgcgatccgctcgcctcggcctcccaaagtgctgggtgagccattgtacctggctttccaggcctccataacacttgaagtcccactttgtgcacagcactgtgacaaaccttcgggtagcattcaatctatctggcgacaacatgtttgcagaatatggcaaataaatgcttccacagagacgcaaggtaacgtgagaacaaatccaggaacaaagatttctgaccagggaaatcaggaatcagaatgccatcccagcccacctcagtggctcatgcctgtaatcccagcactttggagggctgaggcaggtgatcacctgaggtcaggagttcaggaccagcctggacaacatggtgaaaccccatctctactaaaaatacaaaaatcggccgggcatggtggcacacatctccagctactcgggaggccgaggcaggagaatcacttgaacctgggaggcggaggttgcagtgagcctagatcatgccagttcactccagcctgggcaacagagagagactctgtctcaaaaaaacaaaacaaaacagaatgacatccctagtgaatgtcagcttgtgcctgtagccatgatactcagagttctattcaaatacagatttccatgaaatcttgaggagggggaggaggggtgacatggaaaggtatacacaacataatcactaattgaggtaaaatatcctgctagtatactactggcaacacctttgatggtttgtcttagaacacatgggaacaactgccctggcagggttatggagacctaacaacaaattctgctgtgagtctagtgtccgaagaatctcacggtagagctccaggaaaggcaggtcaagttaatgctcgtgatcttatgtatttgctcacttatttatctcctcctctttccacaatggatacagtacaaacaaagggaaatagagtcaggacaaagagaaagacaggatagaaaataggcaagataggtaagcatagcccagaccaaacctagtgaatcagaaactctgggagagtggggcctggcagtttgcagcttaacacaccttctaggtgattctgatggaccctaaagtttgagaaccactggattcgagtctaaagaacattcagggccagtgtggtggctcatgcctataatcccaacactttgggaggccgacgcaggtggatcacccgaggtcaggagttcgagaccagcctgaccaacatggggaaaccccgtctctactaaaaataaaaaaaaaaatagccaggcatggagtcaggggcctgtaatcccagctactcaggaggctgaggcaggagaattgcttgtacccaggatgcggaaattgcactgagccgagattggaccatggcactccagcctgggcaacaagagcgaaactccatctcgaaagcaaaacaaaacaaaaaaacacaacactcaagaagtctggggcaggaattcaggtaggaagctgctgcaatactgcaggaaatgtgatggtgaagcttaattcattcagcaaatcattcactgaccatctactgtgtatcagacactattttagacactaaagatacagtagtgagcaaagtagacaaaaaatgtggcccatcctggtggctcctgcctgtaatctcagcactttgggaggccaaggcaggtggatcacttgaggccaggagttaaagaccaacatgacaaaaccccagctctactaaagatgcaaaaagaattagccgggtgtggtggtacacctacaataacaactacttgggagctgaggcacaagaatcacttgaacctggaggcagagattgcagtgagccaagatggcaccactgcactccagtctagacgacaaaagagaccctgtctcaaaaaaataaaactaaaaaagcagacaaaaatccctgtggacgtgggagtgtaccttctaatgcaagtaattactgtctaccatttatgtagttccagatgttatcagtgttttatactcattatttcatcctcacatcctacctgcccatcagataggtacactttctgtcctcatttgccagttgaggatacggaggttaagtagcttgtccagggtcatgttgatagtaagtagagctcagatttaaatccaagaaggccaccacacttttagacactgtgctctctgacaacacactgctagccaccgtgccatgctgcctccacagcatcggaagggcagtgatgaaatatactgattcaaaatatatccctttagcacctactgtgtgctaggcagtgttaggccagtgtggctgcagcagaatgatccggggctacagaggaaggagggagggtgttgtgagcaaatcttacagggctttgctcaccatgtatagcctctggttttcactctccataagatgggaagccattgcagggttgtgagcagaggactgacataatttgacttaggtttttttgttttgttttctttgagacggagtctccctctatgcccaggctggagtgcagtgacgcaatctcggctcactgccacctccacctccacctccacctcctgggttcaagcgattctcctgcctcagcctcccgagtagctgggactacaggtgcacgccaccactcccagctagttcttttgtatttttagtagagaaagggtttcaccatattggccaggctggtctcgaactcctgacctcgtgatctgcccacctcagcctcccaaagtgctgggattacaggtgtgagccaccgcgcccggccttgacttaggttttaaacagattgcattgactgttgtgttgacaacagactacagagggggcatagagagctgttgggaacggttgtaattaccagaaaaaagaaaaattatgatggcttgagtagaagctataaagtcagcaggttgcattgatggatatggaaagagagggctctaggccacatctactaaaagacatgaagaaggagcagggtttttgtttttgttttggcagggaggtgtttggggaggttgttttgtacaatcaagtggatgttgaatatacattgatatacaaatctaaagttcagagaaagaccgggctgaagagagaaatttgggagttgtaagtaaatagttttttgtttttagttttactaagtattgcctttgttttagtatgactcgtttatttagaagtttatataatttaatttgtgatatgtcttgtgtttttgttttgtttggggcaggtgcccgaggcccttgtcatcttcattgactccagctcatggcttgtatttaacaacgagctcagaaaaattcctaaaaatttaattactgagtctccagagctctaatgagctggctccagcacacaattgctcctttctttcattcaacaatttgacaagtcctgatggctctacattcaaaacatgtaaattggccgggcgcggtggctcacgcctgtaatcccagctctttgggaggccgaggcgggtggatgacgaggtcaggagatcgagatcatcctggctaacacggtgaaaccccgtctctactaaaaatacaaaaaattagccaggcgtggtggtgggtgcctgtagtcccagctactcgggaggctgaggcaggagaatggcgtgaacccgggaggcggagcttgcagtgagccgagatagcaccactgcactccagcctgggcgacggagcgagactccgtctaaaaaaaaacaaaaacaaaaaaacaaaaaaccgtatatcttgaatctgatcacttttcgcttagatagtactgtaatatagtaatagataatgctagaaaaaataattaaagctatagatatcatctattgtaggtttactgattgtcaggcactatggcgactctctggaatggttcattcctcgcaaatgaatagataggagatatctactatcaggaactacaaacacagtctccgtgctgtgatccgctttcacagggaattttgtctgggattcaagtagcggcaagtaaccctttttcgccctccatctctgctcaggggtgagccctggcagcgctcctacctgggacctacattggcttagtaagatgggccggcgcccaccccagccctcgcgcatgcgcataaaagcccactcccgggggcggggcctgagctagctgggcggggcctgaaggagccgggagctcctgcagcttcatcgcgttactaagagacgcgagggtcgcgaagggcacaacacttggcctctcgctggccctgctcgcggatcccgagtagagaacgcaagcacccacgcccgcctgcaagctcccgggcgcccccggcctctcctgctcggcggaacgaggataacccagtagagccggacccaggggtgggtggatgcgtcgctggaggcgagggccctgcccgccaacccctgcgccccggccgtagccccaccccggaagttcttgccccgccttctcggctccgcagttctctgctgtctcctgaggtttgccagggagatcccgtggttttcatgtctcttccgtgatttttagggaagagggtcactatttggcccttccagaatctcagggtccggttctcccggaagtttccgggccgccccggaccccattggctttaggggccgcgtctccgagggctccgatttgggccctagattttggaatactgtgttttgtccgtcccagccttcaccaggcggatttcatctcccacacagttagtgatttatggcagaaaggaagctggagggatggggactgcaggttagctgtgagggccggaagggagcggttttgtgctgcacacaggcaggtcagcactcccagagcagggaccgccgggcgtgctttcggaaccgcttttgtctttcaaatgaacgcccagcgacagcagacgggagttccaggaccttagagaccggctaatgcttctctttaagttaggaaacaggcgcaggcgtgttcatggccttgcctaaggttacgtgctggttacagggctcctcctgctgcctcttaagaacagaaataatctaataggaggaataaaagggactattagggaggctaatgctcttgaagttttaatactactaaaagtaaaagcgcttttcagagtgaaagggaagtgaaaagggaatttgggtggctggctacatcagaagcttctgttccaactttagattgtcagggagttgagatggtgttttttgtttttatttttgttttagttttttgagacggagtctcgctctgtagcccaggctggagtgcagtggcgggatctcggctcactgcaagctccgcctcccgggttcacgccattctcctgcctcagcctcccgagtagctgggaccacaggtgcccgccacgatgcccggctaattttttgtatttttagtagagacggggtttcactttgttggccaggatggtctcgatctcctgacctcgtgatccacccgcctcggtctcccaaagtgctgggattataggagtgagccaccgcgccgagatggtgtgtttttaaaataacgtgcccgaggccgggcgtggtggctcacccctgtaatcccagcactttgggaggctgaggcaggcggatcacctgaggtcgggaattcgagaccagcctgaccaacatgggaaaacctcgtctctactaaaaatacaaaaaaattaaccaggcatggtggcgcatgcctgtaattccagctactcgggaggctgaggcaggagaatcgctttaacctgggaggcggaggttgtggtgagacaagatcacgccatggcgctccagcctgagcaacaagagtgaaactccatctcaaaaaaataataaataaataaataaaataacatgctcctcaatttaactatgggattatgtcccaatacacccatggtaggtcgaaaatgcatttaatgcacctagccaactttaaacgtcctcagaacacttagctcccctgcagttgggcaacatcatctaacacaaagcctattttataataaagtgttgactatgtcatgtaacttactgaatactgaattcaaagtggaaaacagaatggttgcgtgggtactcgaattactgaatgcgtattgcttttgcaccatggtaaagtggagatatgagttgaaccattccacgggaccatctgtatgcatataaaccctaagtatttcatataattcagtttcacaaaccagaaactcaggcattgctgtttcctgtttgtggagctacaacttggtattttagatgtcaaatttatttatttttttgagatggtgtcttgctctgtcacccaggctggagtgcagtggtgcgatcttggctcaccgcaacctccgtctcctgggttcaagtgattctcctgcctcagcctcccgaagtagctgggactacaggcagccgccaccgcatccggctaatttttttttttttttttttttagtagagacaggttttcaccaggttggctaggctggtctcgaacccttgacctcaggtgatccacctgcctcggcctcccaaagtgctgggattacaggcgtgagccaccgcacatggccaaaacgtttatttttatttatttatttttttaacatttttttcttgaggcagggtctcattcttgtctcccaggctggaatgcagtgacttgatcacagctcactgtggcctcaaccttgggggatcaaacaatcctcccaccttagcctccccagtagctgagactacagtcatgggccaccacacccagctaattttattttttgtagagatagggtctcactacgttgcccaggctggtcttgaactcggactcaaaggatcctccctcctcagtctcagaaagagctgggattacaggtgtgagccgctgcatccagccattaaatgtattttttatcaattctttttttggcacaactgccagcaaagaaaccactcagtctgcaagagctaagtactagcagaattagaactgccactgaatttcctagaatcactgaaaaatttaatcaaggaattgtaagttgatctttcctaattttagtttcattttgtgtttttaataaactgaaagtaagggcaaaaaaaaagaatttccaccaccacttatatagcgtagttacagtagtcactagagttcctactatggtgaaatttacattcatattctctttaggtattttgggaaaataaaattttgaaatgcttaataataaccggaggatgtctatttctactgagaaaagtggtgatttcccccaaagtccaattgaatacagcatattttctgctcttctattaaatgtagcatttttatgtatagttgccataattttttgagctgaaagtgacaaaaggttacatagatggcattcaagaaaatacgtttcgaatgaatatgagcaaaaagtcaagcctaaagcaaaaagggcatagataagacaaaaattaagattgtatcactacatgtgcttcatctgtaaaagtcctgtaagtaatacagtcactaaattcatataaaaatatgactaatttggaattttttttttttttctttttttcagacagtctcgctctgtcacccaggctggagtgcagtggcaccatctcggctcactgcaacctccatctcccaggttcaagcagttctctgcctcagcctcctgattagctggaattacaggcatgcgccaccatgcctggctaatttttatatttttagtagacacggggtttcaccatcttggccaggctggtcttgaactcctgacctcgtgatccacccacttcagtctcccagagtgctgggattacaggcgtgagccaccgtcctgtcctgaaagtattttaatacagtgaattcactaacttttttttttctctcttaatttagacagagttttgctcttgttgcccaggctggagtgcaatggcacgatcttggctcactgcaacctctgccccccaggttcaagcaattctcctacctcagcctcctgattagctgggattacaggcatgcgccaccacgcccggctaattttgtatttttagtagcgacgggtttctccatgttggtcaggctagtctcgaactcccgacctcaggtgatccacccacctcggcctcccaaagtgctgggattacaggcgtgagccaccacgcccagcctaacttttttctttaatatttcttagaacctttttcctgtgtaatatatctatattcctgtgtaatgtttcatattatatatatgaatggattcttaggctgtatcacatgtccaactcacctctttgtcatagctggtatattgctattatattgtgcagcagtggagtagtgaacttcccactagaatgaatggcattaaaggacaaaggtttcactgaagcgtggcttatttgttttgccaggtgttccaaattttacataaactcgtataatactgtaaaactggaccgggtgcggtggcttacacctgtaatcacagcactttgggaggccgaggtacacgatcacttgaggccaggagttcaagaccagcctgagaaacatggtgaaacccatctctactaaaaatataaaaatttggcaaggcgtggtggctcacgcctgtaatcccagccttttggggggctgaggcaggcggatcatgagttcaggagatccagaacatcctggctaacacagtgaaaccccgtctctactaaaaatacaaaaaattagctgggcatggtagtgggcgcctgtagtcccagctactcaggaggctgaggcaggagaatagcatgaacctgggaagtggagcttgcagtgagccgagatcgcgcctctgcactccagcctggtgacagagcgagactccgtctcaaaaaaaaaaaaaaaaaaagaatacaatataaacactataatatttagaatgttaagtaatttaacaaaaatctaaataggaagagcattagaacatctttcttgtttttcatagaaaagagtccattggtacttgtgacttagcctcctaacagtcttcattatctttttttaccaaccactaagggaacatttaggctacatctttcatattgaagaaatatttgtctgaaattcagcaagtctgtctattttatttccatttcctatttttcctctattaaatccaagtgaagctaaatttatgtcttgtaaaagcatttattagaagatccttttaaataaaacttttaagtctatgttaattaatcgtatatttagcatgatttttacccagtatgaaggatggatatttctaattaatgtcatgcttattttgagttttcctttatatatatgtatataagagtgtgtgtgtgtgtgtgtgtgtatatatatatatatatatatatacacacacacacacatatatatgtatacttttttttttttttttttttttggagccagagtcttgctctgtcacccaggctggagtgcaacctccacctcctgggtttcaagcgattctcaagcctcagcctcccaagtagctgtgattgcaggcacctgctaccacgcccagttcattttttttttttcctttttgagaaggagtttcgctcatgttgcccaggctaaagtgcaatggtgtgatctcagctcactgcaacctccacctcccaggttcaagtgattgtcatgcctcagcctcccaagtagttgggattacaggcatgtgccaccatgcctggctaattttgtatttttaatagagacggggtttcaccatgttggccaggctggtcttgaactcctgacctcaggtctcctgacttcagtctccccaactgctgggattacaggctcgagccaccatgtccagcctttccctgttatacctttaatgtatttcttgaccttttaaacataatgagcatttgttattgtgattgaaaaaaattcataaaatattaatttatttacaggatctgactttaatgtgtttcagccaatagaaatatattttaatagaagaatgcattcaaggaatcatagtgaaaattctgtacactttatttcagttaaatgactgatatattttgttaataaaataagtagctgagaaaacaagtgtaagattatgcctttgaaaaacttgctatggaagttcggtgaatagacaattacatgaactaaagtcgtatattagactttccaagactattagtgacctcctacactgtttttaaatccatggtctcagtaccacgacagccacacagtgtgcatggaatctgtgttaggccattttctcacattagttcatcaaaagatcaggtactacagtgacctcagtaaatgaattgcagcaattgggatgtctccaagcaattaagaagtgaaaaagaataaaccatcccctcccagaaacaagaaagcgaacagagtgagaagacgggtcttacattccctttttgagagagagagagagagagagagagagagagagagagagaggtgcagctttgaatataagtaatggaatggtggtggatattttgacaatctactgagcatgttttcagaaatgtgcaaactattacctggaactccagtatttgcatacagcttttagaacatcactccgtaactccaactctgactgggattttattgataaagaaaaaaacagttttgtatgtatctttcagggacttggggttttttttgtttgtttcttacagttttatccccacaaaatagagcatgaatccttctcaatcttggaattgtatgtttaaaaactactatatttaatgggattctcaactctaagtataatttttaagtgttagttttatttattctttttttttttttttgagatggagtcttgctctgtcacccagcttggagtgcggtggcacaatctcagctcactgcaacctccacctcctgggttcaagccattctcctggctcagctgccccagtagctgggatgacaggcgtgcaccaccatgcctagctaatttttgtatttttagcagagacggtgtttcaccatgttggccaggctggtctcaaactcctgacctcatgatccacctgcctcagcctcccaaagtgctgggattacaggtgtgagccaccgcacccggccagttttgtttattcttaaagggaatttcaaaattgtcactattacattatccattaatgttgttttaacatctttcagatattattgataataaggcctctgtaaccatggctagttctgacgtaaaaccaaaatcagtaagtcatgccaaaaaatggtcagaagagatagaaaatctgtacagatttcaacaagcaggatatcgggatgaaaccgaatatagacaagtgaaacaagtttctatggtaagatttctgtctctacaaacctcaactcgaaatgtatttctcagatgctgaaaagtattttataaacaaccagagaataactgaaggaaattcgactccaactctctcattttatttgttttcttttatttacttttattttattttttgagacagagtctcattctgtcacccaggctggagtgcagtgacgcaatctcggcacactccacctcccggattcaagggattctcttgcctcagcctcgtgagtagctgggatcacaggcgtgcaccaccacgcctggctaatttttgtatttttgtagagacgggattttgccgtgtttggccaggctggtcttgaactcctgacctcaagtgatccacgcgcctaagccttccagagtgctaggattacaggcaatagccaggacgcccagccagactctctcatcttattaacggggagaggcccagaagaatgatttgcaggcagagtgggagaagaggtggtcgtttagctgggcacattcagaattttctcttttattgagcaactgtgctctgctaaatgaatcttttgcggtagaccacaaaaaaaaagcttttttcctcactcaggtgatttcattatcagataatcagtatgttgggtaactattatttccctcctgttactttttattttaaccatgaattagaaagaggttaaaatcctgtggtttttggggcaattataccttacaaacaaaagtgttagaacaactcgtgactttgatagtatatcccaggctttcctgagagggtagagacctagctttgctttatgaaggctagaccaaagtctagatttggctcccgtttatacagtgtggttcttcttaacttatttattctcttggctactaagatattttttttttttttttttgagacagagtctcactctgtcacccaggctggagtgcactggcgcaatctcggctcagtgcaacctccacctcccgggttcaagtgattcttaagagacgtgtttttacaaattcagttcacccctgaacaacacagggactaggggcttcaatgcttcatgccgtcaaaaatttgtgtataacttttgactccccaaaacaactactagtaacctagtgttaacagaaactcttgcccataaggtgaataattgatcaacccaggaatacactaatatcttgatatattttatgcattcatgacaaaccttttcttaattatttttgatatttatagtctgtgtggtttgcaacttttttcaaatcgttgcaaatctcaaaaaaaatttcaacaaattttttgaaaacaatccatgtatatatggactccccaagttcaaacttgcattggtcaagggtcaactgtattgtaaaatatgacatagtattcataaatatattttaatttttagatttgggattataacagtgtttattaactcagttgtttatttttattttttactaactcatcatttttcagattctaatgtgtagattttgcagatcactataagctcttctttttcttttattctattctttgacctctacttaaaaattcctttaaaagtacataggaggctgggagtggtggctcacgcctgcaatcccagccctttgggaggccgaggtaggcagatcacttgaggtaatgagtttgagaccagcctagccaacatggtgaaaccctgtctctactaaaaatacaaaaattagccgggcatggtggcatgcacctgtagtcccaactacttgggaggctgaggcaggagaatcacttgagcccaggaggcagaggttgcagttagctgagatcacaccattacactacagcctgggcaacaaagcgaaaccccatctcaaataaataaattaattaattaaattaaaattttaaaagtacataggaaaaataatggaggcaatacggaactatcatgttattacctctttaatagacattaatttaatgacattattgtggttaacaatagaatttaaaatactgatcaagtgaagattgattactgtgacttccatgtatctgtcttctcaaccattatactctatccccattgccaaggataattttcattactatatcatctatggcttttaaacagaaaaaacagaagcattatcatttttatgctgtttaaaataagctttgggctgggcgtgttggctcacacctgtaatcccagcagtttgggaggccgaggcaggtggatcatctgaggttgggagtttgagaccagcctgaccaatatggagaaaccctatctctgctaaaaatacaaaacttgccaggcatggtggcacatgcctgtaatcctagctattcgggaggccgaggcaggagaatcacttgaaaccaggaggtggaggttgtagtgagccgagatcacgccattgcactccagcctgggcaacaagagtgaaactccatctcaaataaataaataaataaaataagtttcataccctgccttaagattgggatgcccctaaagatacacaagcctcagactcataggcggccagctgtggtggcttacgcctctaagcccagtgctttgggaggctgagggtgaaggattgcttgaggccaggattttgagaccagtctgggtgacatagtgagaacccatttctacaaaaaactttttttaattagccaggcatggtggagtgtctctgtagtcccagctactgggaggctcaggtgggaggattgcttgagtgcaggagatcgaggctgcagtgacctgtgatcacatcactgcacaccagcctgggtgagagagcaagaccctgtctcaaaaaaaaaaaaagaaaaaaggaaaaaagaaaagaaagttgtcacaagaattaaatgtaatcacatgtttgaagtgcctgacattatagtgctcataatttgttgggctgggcacagtggctcacgcctgtaatcctagcactttgggaggcagaggcgggccgttcacctgcagtcaggagttagagaccagcctggccaacatggtgaaaccctgtctctactaaaaatacacaaaattagccgggcatggtggtgcacacatgtaatcccagctactagggaggctgaggcaggagaatcacttgaacccgggagggggaggttacagtaagctgagatcatgccactgcactccagcctgggcgacagagcgagactcccccacaaaaaatttgttgactgaaggaacagcaagtgtttagtaaatgataccttttattaatctcatcatcttagattctaaaataagtaacaagaacaataaaaccttacacaaatcgaagtatatgttccttaacaaaaagaagcacagggatttagaggaaaacaaaatcacttccttccagggacaatccccagagagggcttagtgtccccagtggcatttgcagtgggtcttcagggacggataggatggtgactgaaggcttgctttgggtgggatgtttctcccagtgtgcagtggtttgaggtttgagagaagctgtttttcattacctggtggtatagtgcttgctgaccttccctcctgaggggaaagtccttgaacttgaggatctcattccattccaccacaggcaagaaagtttcccagatcaaatggaaatgatcaagttgaaagtcaagaagaaaagaaagttcagagatgccaagggacatcaaaaggaaaaatgtctagaagtcaacaagcaaaggagcaacttagctgtcctaaggattgtcccatatcaagtagctcagctccagatgttcggaagaggcattggttgtactgttttctcaccggatcagatggctttcagataatctgctcctggccccaggagggaagagggctgtaatggagtcttgagaacacctcctttccctgccaaaggtattggaagccacacaggcaggtgtggcctcagtggtggaaaggactgctggttttctgtaatgtatgtcagaaggcctgccaaggcttctcagatatgctgttacctattctcgctaattcataagtaaatgagatgacacaaaaaatgaagatgtgttattagaaagtaaaagacatgtggacacagatggtatattcatctcctcttcctactgaaagctgagatttattcatggggaacagaaaaggtgcaggactacctgtatagaaggtgttgaagaacaggatttggagaaagggtgcaggactgcctgtatagatggtgttgaagagcaggatttggttttctacaacctagataatgagtttttggttatgataaagtgcatctcacaaaatctgaaaggaacatatttgacagtggtgaaatacattaacctggccaggaagggataacattgaagaggaagtggagagacagatctccaaattagatcaagccaaatgaaaaagtagataaaccaatatggtatacaagaaggaatggtaggagatgactggggacagtggctcacacctgcaatcccaacactttggaaagccaagacaggaggatcatttgagaccaggagtttgagaccaacctcggcaacatataataataatgataataataataataataataacaacaataaagaatggtagaagaaattaaaaaaaagatttttgacactttgggaagccaaggtaggaggactgctttaggccaggagtttgagaccagcctgggcaacatagtgagaccctgtctctacaaaaaaaaaaaagaaaaatagaaaacttatctgggcatggtggtgcttacctgtagttctaactactcgggaggcagaggctggaggatcccctgagcccaggaggttgaggctgtagtgagctatgatcacaacaccgcactacagcctcggagacagagtgagaccctgtttcaaaaaaaaaaatggatttcaaggtgaacttgaaattggggcagaaggaaatgcatatacacttttggatagttcttgagttgcttgctttattcactgtgtattcatcaacaatcagcaggcagcacttacaaaatggagcctgggcttagccctaatttcctcctgtggtattaattttagaagttagaatgtttaaaatcttttgtaaacataagagaaatgaagtttagattacttggaatgttttgtcttatcttggccacagtattgaaatttaaatctagaaattggagctgggtgcagtggctcaggcctgtaattccagcacttgggaggccgagctgggaggatcacttgactacagcagttccaggacagcttgggcaatgtagcaagactctgtctccaaaataaaacaaaataaaataaacctagaaattgggctctagagaaaagcactgaattagttgtcttttttttttttttccgaggcagggtcttgttctgtcacccaggctggagtgcagtggcgccatctagagtcactgcaacccctgcctccagagttcaatggattcttctgcctcagccccctgagtacctgggattataggcacctaccaccacacccagctaatttttgtatttttagtagaggcattgtttcaccatgttggccaggttggtcttgaactcctgacctcaattgatccacctgcctcagcctcccagagtgctgggattacaggcatgagctactgcactcggcctgaattagttatcttacagcataaggctgcaatgtaagatgtgtcttgtgggtatcatactttaaaagctcaagcattctaaaatctaatcttatactttgtttctgtaagtcatactttttaactatttgatagtaaaatatgagataaaaatcaaccctccattgtaacgtttgtactctggttcttgatgtgcaggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttggtcctgctctttttgtccattttattttattttgagacagagtctcgctctgtcgcccaggctggagtgcagtggtgcaatctcgattcactgcaacctctgcctcccgggttcaagtgattctcatgcctcagcctcccaagtagctagaattacaggtgtgcactaccatacccatctaatttttatatatttaatagagatatgatttcatcacgttggccagggtggtctcaaactcctgacctcaagtgatctgcccgcctcagcctcccaaagtgctggcatttcaggtgtgagccaccacacctggcctctgtccataataactgtggtgtgatcaccattaagtatgggaaaacacctttgaaatcatcccaatggttagactagtgacatattttcttatagcagatagtcttagtgctccacctatacccattcctggcatttatgtctttactagaacattgctttgagatgccagatatgggtcttgtggcccaaggtctttctcttgcccctggagtcctttgcctcttgctgggcaaactggaagtgtcaaggaataatgccccccatggaagaagtcctccactagtgactgctgggaagtagtgatagaaatctcccagcaggctgggcacagtgacccacacctaaaatcctagcactttgggaggccgaggagggtgaatcatgaggtcaggaaatcaagaccatcctggctagcagggtgaaaccctgtctctactaaaaaatacaaaaaattagctgggagtggtggcggctgcctgtagtcccagctgctcagaaggctgaggcaggagaatggtgtgaacccaggaggcagagcttgcagtgagccaagatcccgccactgcactccagcctgggcgacagagggagactccatctcaaaaaaaaaaaaaaaaagaaaactataaagatctttgcctacttactaatgatgaaaagtatggtcatagaatatggtaatgtacagttgcatgaccttgagctaacaacttaggattgcagcctcaggatttacatttgtaaagtgaagagccagcgctttgacggactaaggccatgggaatcacgtgcttatttcagggctatcgggatcaaagggagtatacatatgataggccttacacagtctctcgtataattgtgctggactttcttctttttccctgaataacctcagagaccttgttaacgtttgtggccttctgagctcccctctttaatccttccaagagagcttccctgtctgggtttagcctttgcatatcctctctttcatgtgggtccatctgggggttggttcctggtaactgggtccttccatactcttgggggttttgacaatcagctggtgcatattcctctagccacttagttgctgcttggagccctctccgcctttcatctctgttaaagaggaacatgagcaaccggtggcaatcagcccaggtggggttgtgggtctggataacagtttggagcaaatcaattagggcttgtggcttttcggtagagggcggtgtattgttttcccagttgagaaggtcggcagaggtgaaggcctggtacccaaaaacacgcctctccactacgtgaccatcctcctctatcccagtataccgctgctctctcaggggcatttggatccccgttttgggtcgtaaaccagctgtcgagggaggggtggaatggcacaatgtgacttaccgcgattaatggtatcaattattaattgagactaataactatcaatattaataactgatcatataattcttaaaatcaatagcgataataatgataattcacattaaagagttatactcacgataacaataaatgattaatattaatgattaatgacacctgatattaataactgatattgatcttattcattagaaaacagtcatattagctcttaataattaatattaatattaataatctgaacactttatgagcaatgatttcttaatattaatatcaatattggtaatagatattcatgttaataataaatgaggatgaattaatactaatagtacacctaaaacctcagtgggtgtacacccacctgtgatattgttcataatgtccaggaagggagagagcatgatattacgttcaatatcgcagtagctgtacacccacccggtgatattgatccgaatctcatctccaggggatggcgtatgacgttactcccaatatagcactgggtgcgcatccacccggtgatgttcctcctcatattcacggaaaaagagaatgctattactcccggtatcacaggaaatgtacaccctttctgtgacattgttcctaatatccggagggggagagggtgatattactcccaatatcgcaggctgtgtacacccaccctctgatattgttcctagtagccaggaagggagaggacgatatgactccccagacagcaggaggtgtacacccatcctgggatattcttcctaatatccatggagaggagaggctgatatgactcccaatatggcagggggtctacatccagtctatgatattgttcttaacattcaaaggtggagaggttaatattactcccaatatcacagaaagtgtacaaacccgtgtactattgttgctattatccagaagaggagaagatgataataccccccataccgcaggaggtgtacacccactctgtgatattttttgtaatgtgcagggcgggggaggataatattcttcttaataacgcagggtgtgtacagcccccctgtgatatgatccttaatattccaagggggagaggataaccctactcccaatagcacagaaagcgtacaccaccccagggatattgttcccatgatccaggagagaagaggatgatgttactttcaatatcgcatgggatggacacgcccccagtgatattggtcctaatttcaacatgggagaggacgatactacacccaatgccgctgggggcagaaacactcccgtgatattgttcttaatatccagggggaagaggatgctattactgcaaatagtacagaggatgtgcacccgtctgtgacatagttggtaatttccagaggcagagaagatattactgacaataacgtcaacacgctgtgaccaccgtggatcctaatatccagggggggaccggggggtgatattactccccgcatcgcggggggcgtccgcccccttgcgacgggaatcgtaatacccaggtggggagagggggttgatattactccccgatttttcctaggatcttttctctactgccatcctgggttcacaccctgggacattattttccatattctagcaagatgccactagtaaagtcaccggggtatacaccctgctgcattattcataatattaattacatattattcatcggggaatattaatcctgatgtcacaggaccgtacacactgtgaagttattcccagtatcctagcgggacattaagaataatgtcacaatgtgtgtataccttgtggtgttattcttattctcctatggggaggttacttttattgtcacacgggctatgttcgctttgatattattcataatatcctagagggatgtcacctcttatgtcacagggtttgtacaccttgtcaaatcactcgtattatcctcataagatgtcactcctcatatcacagagggtgtacactctgtgatattatcgtcctattctagggaaatgtgacttttaatgtcacagagggtgtacaccttgtgaaattattcgttataattttgtgggatgttacccctaatgtcacacggggtggacacacagtgatgttccatgtaatattctatagaaatgttactcgtaattcacaggtcctgtacaccctttcatattcttcataatattccaggaaaacgttactgctaatgtcacagggcgtgtagaccctgtcatgaaattcctaatatcctagcaggagttcactactcatttcacaatgcgtgtacacactttgatattattcgtactgtcctgaagagatgttactactgatgtcccaatgcaggtacattctctgacattattcgttatatccacgggggatgttacttctaatgtcacacggggtgtactccctgtgttctatttcctaatgtcctagcgcaattttacttttaatgacacaggggtgtacacattgagatattattcatgatattgtagaaagatgttactcctaatgtcacaggcgtgtacagcctgtgatagtattcataattacccaggggtctatactcctattggcacagaagataacaccctgtgacactattcgtaatattctagcgagatgatactcccaatgtcacagatggtgtacaccccatgttattattcttactcttctagggtgatgttagtcttaatgtcacaggcctgttccttctgtgatattattgaaaatatgctagcaggatattactactaatgccaaatgcgtgtacacgtgatattattagtaatattcaggggggatgttactcataaagttacagggatgtacaccgtgtgatattgttcccaatattgtagggggatgtcactcctataatgtcacagggggtgtacacccttcgatattatttgtaatcttatagagagatattactttaaatatcccagtgggtgtacacacatggggtacacccactgggatattatttgtaatttcttcaagagatataactcctaatatcacagtgggtgtaccccatgtgggtataccctgtgatattatttgtaatatccatggtaaacattacttctagtaacccacagagggtacaccctgtgatatttttcataatatcatagggagatattcctgctaataacacagtgggtgtacaccatgtgtgtacactctgtgatatgatagctcatatcctagggaggtattccttctaatatcaccgtgagtttacaccctgtgatatcattcgtaatatcctagaaagatgttgctgctaatatcacagagagtgtgcccccagtgacattattcgtaatatcctggggagatgttactcttaatgtcacagggattgtacaccctgttctattattgtaatattctaggggggtgttccttttaaagtcacaggggtgtacaccctgtaatgttattcgtaatatcctaggaagaggttactcctaatatcacatgtgttatcctaggaagaggttactcctaatatcacaccctgtgataccactcgcaatatccacagggaatgttactttgaatgtcacatggggtgtacaccctttgatgttagtcctaagacccagggatatattacttcaaatatcacattgggtgtagacacatggtgtacacattatgtatgaaaacgtactgtgatattattcataatatccttggaaaatgggactgctaatatcacagtgattgtccacactgtgatattattagtaacatcctaggggaatattagtccaaaaccaaaggcgtgtgttccccccatgatattattcgtaatactctagggagatgttactcctaatgtgatatcacaggggtgcacaccctgtgatattattcacagtatatgagagggatattagcactgaagtcacaatgcatgtacaccttgtgatattattcctaatatcctacggggatgttactcatattgtcacaggggttgtgttcgctgcgatagtattcgtagtctcctagacggatgttacacctaatgtcacagggtgtgtacatcttgttatattagccgtgatatcctaaaaagacatgactcctcatgtcacaggggctgtataccctgtgatattattcgtaatatcctagcgagatgtgacttttaatgtcacagagtgtacacaccttttgaaattattcatcacagtttcgtggtatgttacaacttatgtcacacggggtgcacaccaaatgatattacttgtaatattctatagaaatgttactcataaatcacaggtgttctacaccctgtaatgttatgggtcgtattctaggggattgtgacataaattaatgtcacccggcgtgtacaccttgtgatattattcgtaatatcctggtgggatgttactactaatgccacaatacgtgtacaccctctgatattatccgttatatcctcatgggtcattcctcctatgtcacatggggtgtactccctgtgatattattcggaatatctcagggggattttactttaaatatcacaaaggttgtacacgctgtgatattacccgtgatgttctagaaagatgttactcctaatgtcacagggggtgtacaccctgtgatattacacaggctaaccccctgtgacattattcgtaatactttagcgggatgatactcctaaagtcacaggaggtgtacaccctgtgatattattcggaatattccagggggatgttactcctaaagtcacaggtgtgtatgccctgggatagtattcacaatatactagcgggatactactactaatgtcaccatgtgtgtacaccttctgatattattcgtaatatcctgggaggatgttactcccaacgtcacaggggtgtacaccctgtgttattattactaatattctagcgggattttacttttaaaatcacaggggctgtcaaccctgggatcttatttgtaatatcctacgaagatgttacttgtaatgtcacatggggtgtacaccctgggatattatttcaaatatcctaaagagatgttatcttaatgtcatagggtgtgtacaccccttgatattattcctaatatcctgaggagatattactttaaaaatcacagtgggtgtgcacacatggtgtacaccctgtgatattattcacaatatgtgagggaggtataacttttaatatcgcagtgggtgtacacactgtgatactattcgttatatcgtagaagtatattatttctattgtcagaggagtttaacatcctgtgaaattatttgtagtaatccagggggataattaccctaaagtcgcaggctgtgtacaccctgttatgttattcataatattctagggggatgttactcctaatgtcgcaaatgtgtgcacgccgtgatattattcacaatctactagctggatattgttactagtgtcaccatgcctgttcaccttgtgatattattcgtaatatcctaaggggatgttacgcctattgtcacagggggtgtggtttctgtgctataattcggagtatcccagggggatgttactcccaccatacaaattgtgtacaatttgttatattattcgtaatatcctagagtgatgttactccttatgtcacagcggtgtatatcctgcgatgttattcttcgcattctagaaagatgttaacttctaatatcacagagagtgtacaatctgtgaggttattcataatcgtttccagggatgttactcctaatgtcacacgtggtgtacaaacagtgatatcatttgtgatattttatggaaatgttacccctaatatcgcaggggctgtacaccttgtaatcttattcagaatatgaagtaacgtacctgctgtcaggagatctgagcttttttcttggacacattatacccacagtcctccaggtgttggcgtagggcaatccgttctcttggcgcacccgactgacctggggtgtcccagcaaaagctcaacctactggagcaaagcgcagcctatgtctctggttggaaacctctggaggtctcgagccaacgcctcaccgaagatggtgggggagttcttgaacctttggggaagaccggtccaagtgtactgagtagtgacacctgactccggaccttcccactgaaaggcaaagagcttctgcctctcaggggctaatctgataggaaagaaagcgtctttcaggtccaagcaggtgaagcagctgtcctcagctggcagcaaccccaacaatgtggacgggttaggtactgttggatggaaagtcagtgtagcttgacgaagcaagcgcaaatcctgtcccggcctgtagaccttggtctgtggcttgggaacaggcaggaggggagtgttccatggcgaatgacaaggaagtatcattccacaagttcttaggtgcttgagacggacctggataccttgaagagcttctctggtgaccgggtcctgtttttgcctaagcggctgggccccagtcttaactggccaactctggagggttgtcttccgcccgtactcttggccaccgcttagccagagctggtcttctctcttggcctggctcagttcagaaaagtctccattcctcctctcgggggactgtaagggtcataatgactcccgtggtgggtaactttagcagcaaagagctgtgttctgtcaaagagagactggctctcagcttgctgagcaagtcccttcccagcaaggtcaagggacggtctggcatgtacaaaaactgatgaatgacttgatgtcctcctacagtacaagtccgaggcgagcagaaagcttgctttgcggaaacccccgtggctccggtgatgtcaagagtctttttggataagggggcgaccggggcggttactagcgaatgttcagcaccggtatctacaggaaaatcaatgtctctacccccgacagtcattctgaccagaggctctttggggacgcttgagcccggtctccctcagtccaataacccttctgcgaggttgagccgggccccttcctcctagtccagggcctcctgttctgagtcatcttgttttcttttgagctgagggcatttgttcttccaatgtcctatttctttccaataagcacactggttacactgcaaactctgacagccaagctgagtttctttcccagggccccccttcccttgcttctttggggggacccctctgattgctgcagctaacaaacaggtcggcgtttccccgggcctgacctccattctctttgcgcttttcctcgcggcttactgcatccctgtttacaaacacctgcttagctctttctcatcattgtgatgtattcacccctgcaagcccagcctgcttctgcagttttcttctaaggtcttccgcgctttgatggattaaagccatgtgaatcatgcgctgattttcagggttatcgggatcgaggggagtatacatatgataggcctcacacagtctctcgtataattgtgctggactttcttctttttcctgaatgacctcagagaccttgttaacatttgtggccttctgagctcccctcattaatccttccaagagagcttccctgcctcagtttagcctttgcatatcctctctttcatgtgggtccaactggtggtcggttcgtggtacctgggtccttccatactcttgggggttttgataatcagctggtgcatgttcctctagccacttagttgctgcttggaggactctttgcctttcatctctgttaaagaggaacatgagcaactggtggcaatcagcccaggtgtggttgtgggtctggataacagtttggagcaaatcaattagggcttgtggcttttccttctgggacggggtattgttttcccagttgagaaggtcagcagaggtgaagggctggtacacaaaaacagcctctccaccacgtgaccatcctcctctatcccagtataccgctgctctctcaggggcatttggatccccgttttgggtcgtagacgagctgccaagggaggggtggaatgacgcaatgttaccgcaattaataatatcaattgttaattgatactaataattatcaatattaacaactgatcatataattcttaaaatcaatacagataataatgaaaattcatattaaagagttatactcacgataacaataaatgattaatattaacgattaatgatgcctggtattaataagtgatattgatcttattcattagaaaacagtcatattagctcctaataattaatgttaatgttaatctgagcactttttatgagcaattatttcttaatattaatattaatattggtaatagatattcctgttaataataaatgaggaagaattaatatgaatattatgcctaataccccagtgggtgtacacccacctgtgatattgctcctaatgttcagggagggagagagcatgatattacgtttaatatcgcagtagctgtacacccacccggtgatattgatccgaatatcatctccagggggtggcgtatgaagttactcccaagatagcactgggtgtgcatccacccggtgatattcctcctaatattcacggaagaagagaatgctattactcccagtatcgcaggaagtgcacaacccttctgtgacatcgttcctaatatccagagggggagagggtgatattactcgcaatatcgcaggctgtgtacacccaccctctgatattcttcctagcagccaggaagggagaggacgatatgactccccatacagcaggaggtgtacacccatcctgggatattcttcctaatatccatggagaggagaggctgatatgactcccaatatcgcagggggtgtacatccagtctgtgctattgttcttaatattcaaaggtggagaggttgatattactcccaatatcacagaaagtgtacaaacccgtgtactattgctgctattatccagaagaagagaagatgataccacgcccccatcgcaggaggtgtacacccactctgtgatattttttgtaatgtgcagggcgggggaggataatattcttcttaatagcgcagggtgtgtatatccccccagtgatacggtccttaatattccaagggggagaggttgaccctcctcccaatagcacagaaagcgtgcaccaccccagggatattgttcccatgatccaggagagaagaggatgatgttactttcaatatcgcatggggtggacatgcccccagtgatattgttcctaatgtcaacgtgggagaggatgatactacacccaatgctgctgggggtataaacactcccgagatattgttcttaatatccaggggcaagaggatgctattacggcaaagagtgcagaggatgtacacccgtgtatgatatagttggtaatttccagaggcggaaaagatattattgacaataccgtcaacacgctgtgtgaccacggtggatcgtcatatccaggcggggagaggggggtgctattactccccgcatcgtggggggagcccacccccctgcgatgtggatcgtaatatccagggtgggagaggggggtgatattactccccgatttttccgaggagatttcgtctactaccacccttggttgacatcctgggacattattttccattttctagcaacatgccgctactgaagtcaccggggtatacaccctgcgatattattcgtaatattgtaggggaatgttaatcatgttgtcacaggactctacacactgagatgttattcacagtatcctagcgggacattaagaagaatgtcacaatgtgtgtacaccttgtggtcttattcttcttctcctaaggggaggttacttttattgtcacacggggaagtttccctttgatattattcataatatcctagagggatgtcacctcttatgtcacagggtttgtacaccttgtcaaattactcgtatgatccttgtaagatgtcactcctcttatcacagagggtgtacactctgtgatattatcgtcctattctagggaaatgtgacttttaatgtcacagaggttgtacaccttgtgaaattattcgttataattttgtgggatgttacccctgatgtcacacggggtggacacacagtgatggtatgtgcaatattctatagaaatgttactcgtaattcacaggtcctgtacacgcttcaatattcttcataatattccaggaaaacattactgctaatgtcacagggcgtgtagaccctgtcatgaaattcctaatatcctagcgggagttcactactcatttcacaatgcgtgtacaccctttgatattattcgtattgtcttgaagagatgttactactgatgtcccaatgcaggtacattctctgacattattcgttatttcctcgggggatgttacttctaatgtcacacggggtgtacacagagtcacacagtgataggagttgtaatattctagagatatgttactcataaatcactggggccgtacatcctgggatgttattcgtaatattctagggaaatgttgctactatggtcacgggggtatacaccctgtgatatgactcgtcatatcctggcgggatgttactactaatgtcacaatgcctgtacaccctgtgatattatttgtaatatcctaaagggacgttactagtaaggtcacaatgcatgtacaccctctgatatgatcggttatatccttgggggtgttactcctaatgtcatatgggatgtactccatcatattagtcgtaatatccaagggagatgttatttttaatgtcaccgggagtgtatgtcatacgtattcaatgcttgtgatactattcctaatatcctaggggcatgatctccctaatgtcacacggggtgaggcggtgtacatcgtgtgtgtacaccacctgtgatattattcataatagcctaggaggatgtttgtttgaatgtcacaaagagtgtacaaaatgtcacagaaggtgtacaccttgtgacgtgatctgcaataccctaggaggatgttactcctaatatgtcacaggggtgtacatgctttgttattatttgtaatcccctagagagatattaattcaaatatcacagtggatgtacacacatagtgtataccctgtgatagtattcataatatcctagggagatacaactcctgatatcacagtgcgtgtaccccgggtgtgtacacccttgatattagtcttaatatccagggtaaatattactcctcatatcacacagtgtgcacaccctgtgatatttttcatcatactttagggagatattgcttctaatatcacagtgggtgtaccccatgtgtgtatactctgtgacagtatattttatatcctagggaggtattaattctaatatcacagtgggtcttcaccctgtgatataattcttatttcatcttgcagcattttttaaccatgaaatacaacattagctgggcgtgctggcgcatgcctgtaatcccagctactcgggaggtggaggcagaagaatcgcttgaacccaggaggcagaggatctggtgagccaagattgcaccatcacacttcagcctgggcaacaagagcgaaactccatctcaaaacaaaaaacaaaaaaccagcatgatttcaagagcagaaagagaagaccttaaaaaccagcataatgagaaagttaggaagtttcttaccaaaccatctggaattgtgcaagaaattcttgtgaagtaaaattttcatactgtactatcaaacactagaactcacttattccatctttctgtatttcaggacccaattatccacttgtcttcattccccatcccatcccttttcttcgtagcgtctgctaacctcctttatactttccaccttactcagattccttttgtatgtaggtgtatgatggagtctctttctgttgcccaggttggagtacacaggcacaatccgggctcactgcaagctccgcctcctgagttcaagcgcttcttgggcctcggccctgcgaatagctgagactacaggcaggcgtcaccaagcctgactaatagtttgttttttccgtagagacggggtttcaccatgttggccaagcgggtctcgaactcctggactcaagtgatcccagcgactcagcctcccagagttgagaagttgagaggggtcacagacaaaatgagagatttccacattcttgatgatggtgaattgtcacacaatccaaccgtgcagctgggaatccaacaggctaaggaaaaaggacaccaaaacgaagaagacacagaggtgaggattcatgatgactgggtagtgcagagggagacagatggctacaaagccgtcataggccatcacagtcaggagcatgcattctatacatgcaaaaaaggaccaagaaagacatctgtgtcaggcagcccgcatgagagatgactctgctatgcgactgcatgtccacagtcaccttgggaaccgtggccgaagtgaacccgatgtcagcccagcacaggttggagaggaagaagtacatgggggtatggaggggggagtcagagctgacagccaggatgctgagcaggttcctcagaaccatgaccagatacaaggacagggacagggacagggacagcaaagcgaggacaggctgcagttctggatcctctgagagtcccaggaggaggaattctcagacacctgtgagattccgtggctctgtgtgtcttggacaccttgagaaggaaagaggattggaaaataaaaggtaaaaaccagcccttaatgttggatgcaagcaattcacaaggaacatctttacacttgcagaccatacaccaccagcaatgtttctcagttgtgacaattccaaaaatctcagaatttttacgtgatttactttttagctatacgaggctttctgtacatactactttagagaaaatccactgaagaatatcagaagaccaaaacgtcgtatataacaaatccgtgatctccgtaaaatacggcctactcttttcagaaaaaacacaatgcaatgaaaatatccttctctctttcagaaaaagatctcagtctaattgaaagaaattaagaagccgtgaaatacactctactttattctgacaccgtgctacaacttccattgatgtagaatatgtaaaaggacgacacgagagctacgaccccattatctgaaaacgaaatcgaaccttatagttctcaatgggaacaccttttcacatacctgttacttttcatatttattatcatccttcggttttctgacatcacttcttcataaaagtacatgcacacttaaaaatgggagctgtgtttccaaatgaattgaatctctaactcttggcccagcaccatggctcacaactgtaatcccagcactttgggtggccgagtctgatggatcacctgagatcacgagttccagaccagcctggccaacgtggtgaaaccccgtttcgagtgaaaataaaaaaaatttagccaggcgtggtggcgggtaaccccagctactcgggaggctgaagcaggagaatcccttagaacatggaaggcagagattggacaacatgtgataggatttttgatatcctagggagatattgctcctgacagtagagtgggcgtacaccctgtgatattatttgtaatatcctagaaagatattgctcctaatatcacggtggctctacaccctgtgatattaattgtaatatcctacagagatattactcctaataatacagtggacgtacaacctgtgatattattcataatatattacagagatacgactcctgatatcacagtgagtgtacaccatgtttgtacaccctgtgatcttatttgtaacaactttgaaaaatattacagctaatatcaaagtgggtgtacaccctgcgatgttatttgttatctactaggtagatattactcctaatatcacagtgagtgtacaccatgtgtgtacagactgtgaaattatttgtaataccctaggaagatattactcctcatatcacagtgggtgtacactgtgagtgattttttttctattatccagcgggggagaggatgatattgcttcccatatcacagaaggtgtacacccccctgtgatattgttcctaatatccagggaaggagaggatgacattattcgtaatatcactgggggtgtaccacctcccgccgggatattgttcttaatatccggaggtggagagaatgatgttactcccaatataacagggggtgtacaccacccctgtttgtaaacgccccctgtgatattgttccaaatggcctgtgaaagagtaaacatgactcccattatcgcggggggtgttcagccctgatgatattgttttctaacatccagggaaggagagtatgttattactctcaatatcacaggggttgtacaaccttttgtgtttttgtgcccaatatccgggaaaatagaggatgatattactcccaatatcgaagtaattgtacagtacccctgtgatattcttcctaatatccagaaaggaaaagaatgatgttactcccaacagcgtaggaaacgtatacccgcgctgtgctatctttcccagtatccaggtggggagaggatcatattacttccaatgtcgcagggtgtgtacaccccctctgtgatctcgttgctaacatccaggtttggggaggatgacattactgccaatatcgcaggggaagcacactcccccgtgaccttgttagtcatttcctgggtggagaggatgatcttactcccaatatcgcagggggtgtacacacccttgtgaaaatcttcctatattcagagggagagaggatgatattactcccagtaccgcagggggtttccacagctctgtgatactcttcctaatatccacagggagagaggatgatatgactcccaatatcgcagggggtgtacgcaactctgtgatattgttcctaacatccagagtgaaagaggatgatatgactctcaatatcgcagagggtgtacacccctcctgtaatattgttctgaataccctgggagggaggggataaggttacgttgaataacgcagggaatgtacacactccccctctgatacccttcctaatgtccaggggaagagaggaaaacttcactcccaatatcacagaggcagtacaccccacctgtgatgttgttcccaatatgcaaggggggacaggatgatactactctcaatatcacagggctgttcacatccccagtgacattttttcctaatatctaggggacagacaattctatgaccgcaaaggttgcagagtctgtacatcccttcctgatattgttcctaatatccaggggggaagaggatgatatcaaatatgaaagggggtgtacatcccccacccctacgatgttgttcttaataatcatgaggggagacgatgatattactccaaatatcgcagggattgttcacaaccccctgtgatattgtttctgatatccaggggggggagaaaatcatattactgccaatattgtaggtggtgtataccccacctgaaatatggcaccgaatatccaaagagggagaggatggtattcataccaatatcgaagtgtgtgtacacgccccttgtgatatggtttttaatatccagtgggcgggaggatgatattagtcccaacatcccagaggctgtacactacccctgtgatattgtccctaacttccagaggggagagggtggtatcactcccagtatctcagaagttgtacatcccccgtgatattgttcgtcatatccaggcaggcgcaggatgacattccattgaatttcgcgacaggcgtacacgcacagtgtgatattgttcctaatatccaagaagggagaggatgatattactcccaataaagcagtgggtgtacatcacccctgtgttattgtctctaatgtccggggccgggggaggggggcagaggataatattccctcaaatttagcaggtggtttgacgccccttgtggtgttgttttacatatccagcgggaaagacaatagtactgtttttgaaagtccgattcatccgctccacctttccggaactctgaggccggtaggcggcatgcagtttccatgtgatccccaatacctttgccgtcttctgtaccaaggcagccaaaaacacaggcccgttgtctgagccgatccgtaagggcggtcgaaatctaggaatcacatctcgaagaagcacaggggttacttcatgagctttctcagttcatgttggataggcctccacccacccagagcaggtacgcccaagaactagtacatacttgttacctccacacttgggcgtctctgtgaagtccacctggagaccttcaaagggggctgctccataagctcgtatgccgggcggaacggctgcaccttgccccgcatcatgctgtcggcaggtaacacaccgctgcctcacagttttggcaagggctgacaaaggcgagatgtagaaataccggcctaacaacttttccagtgactcctgacctcgatgggtggtttcttgcacagccagtacaactgcagctcctagcagctgtggcacagcttctctcccatgtggtaaccgaatccatccttcctccatcacttgtccttccctctacctggagacagtccttttcttctttagaagaagcaggtccaagatcaggtgcttgagggagcactgatgcccagaagggggcagatgctgcttttcgagcctctgagtcagcgccggaattccccaaacccagcaaggtggaagctcgctggtgtcctctgcaatgcttaactgccaccttgtggggtctccatactgcttctaatcattggaagatttcttgttgatattttctgtcttttcccccagagttcaataggcccttttctttctatcacgctacatgcacttgaagggttaaaaagacataccgagaatcagtgtaaatgttgacagtctcaccctcactgagttctaaggcccgaatgaaagcaatgagttcagctttctgggctgaagtggcctggggcaatgatctggcttcaacaacagtgcccagggttatcactgcataccctgcacctctctctccttgggggttgaagaagctgctcccatccacatatcgttcccagtctactgatgcccaaggctggtcccggaagtcaggtctgctagagtcaattgagtccaacacttctacacaatcaggctcgacagggctctctgatacctgcagcaaggtggcggggtgtagggtgttacaaacttcaatggttatatggggactttcacagagcaaagtttcgtccttggtgagtctggctttcgttagccaatgatgtcctttagtgttcattaaagtcaccacagcacgggaggcctttatgttcaagttttgcccaagagtcagcttatttgcttcttgtactggcagggcagttgctgccaaggccttccaacaggggggccatcctttagaaaccccgtctagttgttgagagaggtaggccaccggcctcggccagggacccacagtttaggatcaaagtccagctgccatcttttctctctctgatgcatacaatggaaaaggctttgtcagatcgggtagccccagggctggggcagccagaagtttttcctttaactcatgaaagacttgctgttgttgggatccgcattccaaaagttcccggtccccgcccccttggtaacctcatacaaaggctggctaattctgcaaactttgggatccacagtctacaaaagcccacagctcctaagaattctcttacctaccttctgcccttaggctccgctagatggcaaatgatctgctttctttctgatcccaggttgcgttccgacccctgtcggatagtcaatcccaagtaacctacctgctgtcggcagatctgagctttcttcttggacaccttttacccacagtcctccaggtgccggtgtagggcatctattcccttggcacacccgactgccgtggggtgtcccagcagaaggtcatcaacctactggagcaacacgcagcctaggtctctgctgggaaacttctggaggtctcgagcccacgcgtccccgaggatggtggggaagttcttgaactcatgggggagaccggtccaagtgtactgagtagtgacacctgactccggatctgcccactgaaaggcaaacagcttctgcctctcaggggctaatctgatagcaaagaaaacgtctttcaggtccaagcaggtgaaccagctgtcctcagctggcggcaaccccaacaatgtggacgggttaggtactgttggatggaaagtcagtgtagcttgatgaagcaagcgcaaatcctgtaccagctggtagtccttggtccgtggcttgggaacaggcaggaggggagtgttccatggagactgacaaggaacaatcattccaaaagttcttaggtgcttgagacggacctggataccttgaagggcttctctggggaccggctcctgtttttgcctcaccggctgggccccagtattaactggcaaatcccggagggttgtcttctgcccgtactcttggccaccgcttagccagtgctggtcttctctcttggctcggctccgttcagaaaagtctccattcctcctcttgggggaccataagggtcataatgactcccgttctgggtaatcttagcaacgaagagccatgctctgtcaaacagatagtggttctcagcttgctgagcaagtcccttcgcgaaaaggtcaagggacagtcaggcatgtaccaaaactgatgaatgactttatgtcctcctacagtacaagtccgaggcgagcagaaagcttgctttgcggaaacccccgtggctccgatgacgtcaacagtctttttggataagggggcgaccggggcagttactagcgaatgttcagcaccgctatctacaagaaagtcaatgtctccacccccgattgtcattctgaccagaggctctttggggacgcttgagcccggtctccctcagtccaataacccttctgccaggttgagcagggccccttcctccttttccggggcctcctgctctgagtcaccttgttttcttttgagctcagggcattttttcttccactgtcctatttctttacaatgagcacactggttacgctgcaaactctgacagccaagctgagtttctttcccagggccccccttcccttgcctctttgcgggggcccctctgattgctgcagctgacaaacaggtaggcgtgtcgccgggcctgacctccattctctttgccgttttccttacggcttactgcatccctgtttacaaacacctggctagatatttctagtaattgggatggattcatcccttcaagcccagcctgtttgtctagttttcttttcatgtcttctgcactttgacggactaaagccatgtgaatcacgcgctgatttcagggctatcgggatcaaagggagtatacctacgataggcctcccacagtctctcgtagaattgtgctggactttcttcttttccctgaatgacctcagagagcttgttaacgtttgtggccttctgagctcccctcattaatccttccaagagagcttccttgtgtcggtttagcctttgcatatcctctcttccatgtgggtccaactgggggtcggttcctggcaactgggtccttccatactcttggggattttgataatcagctggtgcatgttcctctagccacttagttgctgcttggaggactctccgcctttcttcgctgttaaagaggaacatgagcaactggtgccaatcagcccaggtgtggttttgggtctggataacagcttggagcaaatcaattagggcttgtggcttttgggtagagggcggtgtattgtttttccagttgagaaggtcgacgcaggtgaagggctggtacccaaaaacacgcctctccaccacgtgaccatcctcatctatcccagtctaccgctgctctctcaggggcatttgtgtccccgtttagggtcctaaacgagctgccgagggaggggtgcaatgaagcaatgcgacttaccgcaattaataatctcaattattaattgacactgataattatcaatattaaaaacccataatataatttttaaaatcaataccgataataatcataactaatattaaatagttatactaacgataacaatacatgattaatattaatgattaatgacgcctgctactaataactgatattgatcttattcattagaaaacggtaatattagctcctaataattgatattaatattaataatctgaaaacattttattagcaattatttcttaatattaatattaatatcggtcattcatattcatgttaataataaatgaggaataattcatactaatattacgccctaatacctcagtgggtgtacacccacctgcgatattgctcctaatgtccagagagggagagagcatgatattacgttcaaaatcgcagtaggtgtacacccagccggtgatattgatctgaatataatctgcgggggtggagtatgacgttacattcaatatagcactgtgtgtgcatccaccaggtgactttgctcctaatattcacggaagaagagaatgctattactcccaacatcgcaggaagtgtacacccccgtgtgagatggtccttaaaaatattccaaggtagagggggtgatatgactacatatatggcaaagagtggacacccccaaggatattgttcgcatgatcccggagggaagaggataatattactttcaatatcacagaaggtggacaagcccccaatgatattgtttctaatttcaacgtgggagaggaggacatgacacccgatatccaagggagtagaaacacccctgtgatactgttccaaatattcagggaggaagaggatgatatgactcccaatgcacacgagtgtacaacttctgtacaccctcggtgtacacaggtctgtgaaacagttcataatgtgcagaggggaagatgatattactcacaatatgataaacaggctgtgagtccaccgcggatcctaagagccaggggggcaagaggggctggctctttactccccgcatcgcggggggcgcctcgcccccctgcgatgggggtcgtcataccccggagtcgagagggtggtgatatgactcctcgtatcgcggagtgcgcccgcccccctgcaatgtggatcgtcatatccagggtgggagattggggtgatattactccccgcaaggaggggggcgtcggcccccctgcgatgtggttcgtcatatccggtggggagtgggggttgatattactccccttatgtgggcgggcgcccgcccctcggcgatgtggatcttcatatccagggttggagtgggggatgattttactccccgaatcgcgtgggctcccgcccccatgagtcgtggatcgtaatatccacgggggatgggcgggtgatattactccccgcatcgctggtcgcccgcgcccctgcgatgtggctcggaatatctaggcggagagtggggtgcgatattactccccgcatctcggtggcccaccgccctcctgcgatgtggatcgtaatatccagcggggagagcggggtgatattactccctgatttttcctgggatcctttctatgctgccaccctcggttcactccctgggacattatcttccatattctagcaagatgcggctgataaagtcgcaggggtatacacccttcaatattattcgtaattttgtaggggaatgttagacctgatgtcacaggactctgtacactgtgatgttattcccaatattctagctttaccttaatcataatgtcacattgtgtgtacaccttgtggtgttattcttattctcctaaagggaggttgcatttattgtcacacggggtatgttccttttgatattatccataatgtcctagagggatgtcaccccttatgtcacagggtttgtacgccttgtccaattactcttattatcctcataagatgtcactcctcatatcacagagggtgtacactctgtgatatttttgtcatattctagggaaatgttacttttaatgtcacagagggtgcacaccttgtgaaactattctttataattttgtggggtgttacccctaacgtcacacggcgtgttcacacagtgatgctacgtgcaatatgctatggaaatgctgctcgtaattcacaggtcctgtacaccctttcatattcttcgtaatctaggaaaacgttactgctaatgtcacagggcgtgtagatcctgttatcaaattcctaatatcctagcgggagttcactactcatttctcaatgcgtgtacaccctttgatattattcatattgtcttgaagagatgttactactgatgtcccaatgcgggtacattctctgatcttattcgttatatcctcgggggatgttacttctaatgtcacacggggtgtactccctgtgttctatttcataatatcctagggcaatttgacttttaatgacacatggggtgtacacattgtgatattatttgtgatattctagaaagatattactcctaatgtcacagggctgtacagcctgtgatagtattcataatttcccaggggtctatactcctattggcacagacgataacaccctgtgacattatttgtaatattctagcgagatgatactcctcatgtcacaggtggtgtacaccccgtgttagtattcttactattctagggggatgttactcctaacatcacagggaggtacaccctgtgatattactcatagtgtaccagagggatattagcactcatgtcacgatgcatgtacactttgttatattatttgtcatatcctaatgtcacaggaggtgtgttctgtgtgatattcttcctaacatcctagacggatgttgctcctaacgtcacagggtgtgtacatcttgtcaaatcattcacaatatcctaaaactatgttattcctcaggtcacagggggtgttcaccctgtgatatttttcatcatagctttgtgggatgttactcctaaagtcacatggggtgtacacagagtcacacagtgatatgagttgtaacattctatagacatgttactcgtaaatcacaggggctgtacctcctttgatattattcatagtattctaggggaatgttgatactattgtcacggaggtgtacaccctgtgatgtgactcgtcatcccagcgggatgttactactaatgtcacaatgcctgtacaccctgtgatactatttgtaatatcctaaagagatgttactactaaggtcacagtgcatgtacaccctctgatattattcgttatatcctttgggggtgttactcctcatgtcacatggggtgtactccctgtcatattattcgtaatatccaagggggatgttatttttaatgtcaccgggggtgacattacgcattaaaaatgcgtattcaaccccagtgatactattcctaatatcctaggggcatgctcttccgaatgtcacatggggtgtacaccatgtgtgtacacctgctgtgatattattcgtaatatcctagggaattgttactcctgatgacacaggtggtgtacaccttgtgtgtacccctcctgttttattattcataatatcctagggggatgtttcttttaatgtcacaaagagtgtacaaaacgtcacaggaggtgtacacgttgtggcgtgatctgcaataccctagaagaatgttactcctaataagtcacaggcttgtacaagctttgatgttatttataatctcatagagagatattacttcaaatatcacagtggatgtacacacatagtgtataccctgtgacagtattcataatatcctagggagatacaactcctgatatcacagtgcgtgtacccctggtgtgtacacccttgatgttagtcgtaatatccagggtaaatattactcctcatatcacacagtgtgcacaccctgtgatatttttcatcgtactttagggagatattgcttctaatatcacagtgggtgtaccccatgtgtgtatactctgtgacagtatattctatatcctagggaggtattactcctaatatcacagtgggtgttcaccctgtgacttcattcttatttgaccttgctgccttttttaacccacactacaaaaggaatggaacaaataagaagatattgagatgagatcgtgctgccatgtggccgctgcaggacacttttcatatccctgtttctcaggctgtagatgaaggggttcggcatggggatgaccaccgtgtacatcactgaggccactgcagcctttctcggggaagatgacacatctgaaccgaggtagcctccaatgcctgttccataaaatcagcaaacaactgacaggtgagacccacaggtggagaaggccttatacttcccacctgatgatgaaacccttagaatggagaaaacaattttattgtaagagaaaagggtccccgagatgggaagaaaaccaaatatggcggcagggaaatacatgattatgttattggtgaaggtgccacaatatgcaagatggggagttgagaagggtcacagaagaaattaggaatttccacatccttgaagcaggtcctttgtaaggcaatcaagttgtgcagctgggcgtctaaaagactgagaaaaaaaaaagacaacaaaactagaaagccacagaaacatgggttcatgatggctgaatgatatagagggtgacagatggctacaaaccgctcataggctatcacactcaggagcatgtctctcttccatgcctccaaaaatggcaaagagagacatctgagtcaggcagcctgcgtaggagatgactctgctgtgagactggatgtccacaatcatcttggggaccgtggtggaggtgaaaccgatgtcaggcagggacaggttggagaggaagaagtacatggggatgtggaggtgggagtcagggctgacggccaggatgatgagcaggttccccagcaccgtgaccaggcacatggacaggcacagcccagtgaggaccggctgccattctggatcctctgagcttctaggaggaggaatatagagacatctgttagattctgtgggtctgtagagattggacaacttttgcctagaaaagagggttgagaaatcggaaacaagtaaaccgacacccagcatcgtgtctgcattttggatagaagcaattcacaagtcatgttttcagatttcagagcaatccacactcagcaatagtttgcacttctgacaatctcaattgtcttctaatgctttcatcattgatttctgtgtgattcacttcttgttgtacacacctgcctcagagacactagattcaagaatgttccaagaacgagatcatcctatataacaaattcgtcattgctagaaaatacagcctatctttaccgacggaaactatgtaatcaaaccattctcttcactttaagaaaaaggttatcctaattaaaggaaattaagaactcaaatattttattttattcgaatagactgatacaaattcccttgatttagaacatctgtaaacaccgtataactgctgagaccatgccatctggaaatgaaattaaagttgatagttcataagcagagaatagttccacaggccggttggatcctattgatttcatcattctgttttctgacttttcaccttcaagagaggaattgcttcctcaaatctgtgggtcttgttttaaaattcatggaagctgtaactcctgtccttagctttggtggacttagcgttttcatcagaacgtttggccggacgcggtggctcacgcctgtgatcccagcactttgggaggccgaggagggcggatcacgaggtcaggagatcaagaccatccgggccaacatggtgaaaccccgcctctactgaaaatacaaaaacttcgcccagcatggcggtgcgtgcctgtagtcccagcttctcgggaggctgaggcaggagaatggcttgaacctgggaggcagaggctacagtgagcccagatcacaccactgcactccagcctgggcaaaaagagcaaaactctgtctcgaaaaacaatttaaaaaaagtacacgctctgtcacactgacgtcacactgatgacagccaatttttgtgaaccaaggaagtgtcaattcaataattcacatagatgttgactttggctatctcctatgtgccaagcgagatataggctctggggaatcagaaacaaaagagactcacttgttcctctcacaatactcaggacttactgagataaggacaaaagaaaatgtcctgtctggaatgcagggaaaccagaacttcaggtcaggggatatttccgttgaaccgtatggagtttaagctgaaaatattaacgaatgtatctaaaattcactttgccttgactttacgcatccatcacacagagatcacgcagcgggcacccacgatcggtttcatcgtcgctcacttccattggatcaactagaaatcaactcagatgagagtgctgagtctcagaagatggacgtctcaccccttgccatacagataagtagaaagggcggtattgaaaattaatggccagactctaactcctgcataccatacttgatggtctccaaactctcaaaaagttgtggggtttttttgtttttgttcttgtttttttttttttttttttttttttgagacgcagtctctttctcttgcccaggctggagtccagtggagtgatcttggctcactgcaacctccgcatcccaggttcaagctattctcttgcctcagcctgccgaatagctgagattacaggcacccaccactacacccagctcattttgttctctttttaggagagacggggtttcaccatgttggccaggctggtctcgaacacctgatcttgtgattcacctacctcagactcccaaagtgctgggattacaggcgtgagccaccgcgcccagcttccaaaagttttcaacagagctcagaggtcttaaccacaggcacatctgaggagcatttctgaaatggtttccagcttcctcaataggaatggaagccaaaccctgaattgatgactccttggaggaagtcgagagctgtaaggaaagccaggaacaggggcaagggagcgatgcatcccaaatgatcctgtgccaattctttctggaatctttgatgtgatctcagctgccctttccatacttgacacagtgattgcggcacccactggtctagctgtggtctacaaggaacccccaaagggaagggcacagtgagcaggggcatcggcctgactgacaaggattggagggggcaggttggatgcagggtgaggaatggccaaatgtcatgtgtctggccttagactgcctggttcagattgggcttcaccctttttgacttcatgatctggtacaagttatatgaaaatgtgttgctccttttctagtctgtaaaataatcatgaaatgtgcactaataactgggagactacacagatgaaatgaaacaagtagcatagaccacagagctcagagcctgcctttaggaagccctcagtaagggttcatgatgccgtggtgtctgtcatcatcctctttatcctcatcatcaccttcatcatctttttgttgttctcagggaacagtttagagagggactcattccctgcttgcatgggtgagatgtctatgaaaaggacaaccagtgggggagggaagcacaattttgaagaagattcctgagagagaccccccaccacaaccaagaacagaaactccacagtctgctgagctgacagtttgcacattggtctcctcccatctggccatggcactctcccgtttgtcctgaggatgaggaaacaaacaaggctcccgaccgtccctcagcactcactgaactgcccttctcctgtgctgggccatgaccacggagaacaggtccactgtcttccctgcgtggtacacaggggaggctcagactccatcctcaaggatgacaagaagacaggccaagacatgagcctcaggatacaggtgatgggtgtggagcccacaggactgcagcctcacactgcagggctggaggcacagactgagtatttactattctatggcctggggggctcaaggcatagagctccttattagccgaagtcgcccaagttccccaacctctaaagatttcctcataatcatgcaagaagaagaagggaaaagtgagtgtccatagaagttttggggctcttcctctaatcaggagagagcttgtgtaaaattcttcgcctctttcttttctttttcaagatccaagtgctttaattttcatattttattatgggaaaatataccacgtataaatcctaaaaattataaatatagattattgcatatagaatggccagtatgaacattcacaatttccactagttttcagtttagagtttaatcacattaggtacattcacattgtttagcaaccatcactgccatcatctccagaacagttttagctttcaaaatggaaattgcacccattaagcaaactctccattcctctctctcacccacccctgggggccaccattctattttgcaactctatgagtttaactactctagacacttgacagaaggggaatgataccgtgtttcattttctttgtttctttgttttggagacagtctttctctgtcacccaggctggagtgcagtggcatggtctcggctgactgcaacctccacatcgtgggtccaagcgattcttgtgtctcagtctcccatgtagctggggttacaggcgtgcgccaccacgcccagctaatttttgtatttttaatagaaacgaggtttcacaatatggccaggctggtctcgaactcctgacctgaagtgatacgcctgcctcggcctctcaaagtgctgggtttacaggtgcgagccacggaggctggtcatgtttatccttttgggatttatttatttcactagcgataatgtcttcaaggttcatccatgttgcagcctgtgtcagaagtgcctgcctggctttttcggttttttattatttatttatttttttggttgtgttttgttttgtgtttacacggagtctcactctgtcacacaggctggagtgcagtggcacaatctgggctcactgcaacctccgcctcccgggttccagcgattcttgtgcctcagcctcccgagtagctgggagtataggcacgcgccaccacgctcgtctaattttgtgcatattcagtagagacagggtttcaccaagatggccaggctggtcttgaattcctgacctcgggtgatccgcccacctcggtcttccaagatgctgggattacaggcgtgagccaccgcaccagccagaagtgcctgcatttttatggctaaatagtcttccgttgtatgaatgaactgcactgtgctttttcattcatctgcccacgaacccttgggttgcttccacattttggctgttttgagtaactctgctatgaatatgggtgtacaaatctctcttccactcctggcttctaattccttttggtgggtacccacaagtgcaactgcgggaacatctgatcattctgtttctaattttccaggacaggccatactatcttccccattccttcatggttttacactccctccaatcagattcgagcattcctacttctctctagtttcaccaagtcttgttcgtttatcatatccatcctaatatgtggtatcacattcttgctttgatttgcgcttccctatgattagtgattttgaacatcattttaggcgcttattggccattgctatatcttctttcgggacacgtctactcgagtcttctgaccattgttaatggggtgctttgggtttcttgttgtttagttctggctcttctttatatatgatggatattagcctcttttcagagatatgatttgcaaacctttttcctaatccatgggttatcttttcactcagttcacagtgtttgctgatgcgcaaaagtgtctgtcatttagatgtcatccaaggaatctaattttcttttgttgcctatgcttttggtgtcatatcccagaaagcactgcccaatctgatgtcatgaaagtgtggccaatgttttctttgaggcatattattctttcagcacttggggtgaggtctttgatccagtttgtattcatttttgcaccctctgtgacatagggtccaccttcattcttctgcatgtggaaatcaagtttctccaacaccatttcttgaaaaggctgcttttccaccaatggactttcttagcactcatgttagaaatcatttgaacatataggggagaagttatttctgggctcaaaaacaaacaaacaacaacagacaacagataaggatgcagcatggaccgggcgcggttgctcacgcctgtaatcccagcactttgggaggccgaggcgggcagatcacgtgaggtcaggagttcaagaccagcctcacagacacgaagaaacccccctctctactacaaatacaacattagctgggcgtgctggggcatgcctgtaatcccagctgctcgggatatggagccaggagaatcgcttgaacccaggaggcagaggttgcggtgagccaagattgcaccattacactccagcctgggcaacaagagtgaaactctgtctcaaaacaaaacaccaaaaacaaaaaatccagcatgatttcgagagcagaaagataatagctgaaaatccagcataatgagaaagttaggaagcttcttatcaaagcatctggaaatatgcaagaaattcctgtgaactaaaattttcatactgtgctgtcaaacactagaactcacttattccatctttctgtattttgggacccaattatccacttctcttcattccccatcccaccccttttcttcctagcatctgctaaccacctttatactttccaccttcctgagattccttttgtgtgtaggtgtgtgatggagtctctttctgttgcccaggttggagtatacaggcacaatccgggctcactgcaacccccgcctcctgagttcaagcgcttcttgggcctcagccctccaagtagctgagactacaggcacgtgtcaccacgcccagctaattgtttgtgttttcagtagagacgggtttcaccatgttggccaggcagttctccaactcctggcctcaagtgatccgtgtgactcggcctcccacagtgctgggattacaggcctgagccaccacacctggccaagattttcttttttgttcctacatagaagtgaggatgtgaaatatttgtcattctgtgcctggcttatttcacttaatatacagacctgcaatctcatccattttgtctgcaatggagacgattttcttcctttttaggctgaataatacttcattgggtgtgtataccacagttcctcaattgaaacaaatttctaaaaagcaaatatttttaacatgtctcggaatgtgaaacttcagggataccatgcccattttattcttttctatttcccatcttatgtatatgcaagtgtataacaaagcagcaatccaagtgtgtataaatctataatttcaacaaatgtaaaatgaaaatgctaagtggtggctgggcacgatcgctcatgcctgtaatcccagaacattgggaggcggaagcgggcagatcacttgaggtcgggagttcaagaccagcctgaccaatatggagaaacactgtctctactaaaaataccaaaaaaaaaaaaaaaaaaaaaaaaattagccaggcatggtagtgcatgcctgtaatcccagctacttgcaaggctgagacaggagaatcgcttgaataggggaggcagaggttgcagtgagccgagatcgtgccattgcactccagcctgggcaacaagaatgaaactctgcctcaaaaagaaaaaaagaaaaaaaaagaaaaagaaaaaaatggaaaatgctaaatggtaagaaacaacagcataataaacatttgtatggtgttgatggacaatgcatttgaagataatatttgaagaaatcatattacaattaacttctgctcttactcattggagcttgatgcctctaaaaacttcgtcattggaaccacctctggtgctttaaaaaaaaaaaaaatccacatactcacacaggtgcagggaaatcagaatctcaggtattgagacccaggcctcatcatctgtaagctccccaggtgatttgactcaaagccaagattgaggaacggcgacatggatctctacacataacctgcctaaatagattctctagaagcagtttataaagaaattccacatgaactctggaagaggatatgaatttgatgtacagtatgtcctcacttaatatctttgaaagtctcttggaaacttcacctttaagcaaaattaggtatagtgaaaccacttattcctcaccaacattataactacacaactttgaacgcaccaattgtgttggaagacttgctgtacattgtttccatcaagtcaattttcagggaattccaaaatgaagtgaggacttcatgtatataaaaagatggttgtgattccacctggatgacagggttattgctcagaaactaaaggaggccgcctaggtatagaggattctgtcatgaggtttctgctaaacaaaggagcccagaatactcacccattccagttaaaggcataacgaagaaaacaatattcacataggaaatgcggaaaggaataaaagccatcaagccacaaaaataatgtgactaaggggcagcatttgcagatgtagggatttaatgtggttgccctttctcacccacacaaaaaaaggatggaacagatcatgagattccactcttctgctgcgcagcctccacagggtgttttgaatgtccctgtttctcaggctgtagatgaaagggttcagcatgggggtgaccacagcgtacatcactgacgccaccacaccattcctggggggtggtgccacagctgaagtcaggtacatgccaatgcctgttccatcaaataagcaaacaactgctaggtgagagccacaggtggtgaaggctttatacttcccatctgacgatgaaatccttagaatggaggggacaattttatagtaagacaaaaggatccttgaaatgggaagaaaaccaaacatagtactatcaaaatatatgaatatgctattgatgatgctgtcagaacaggcaaggtagagaagttgagatggctcacagacaaaattagagatttccacattcttggagaaggtgaattgtcacacaatccaactgtgcagctgggaatccaacaggctaaggaaaaaggacaccaaaacgaagaagacacagaggtgaggatttatgatgactgggtagtaaagagggcgacagatggctacaaatctgtcataggccatcacagtcaggaacatgtcttctatacatgcaaaaaggaccaagaaagacatctgtgtcaggcagcccgcatgagagatgactctgctatgagactgcatgtccacagtcatcttgggaactatggccaaggtgaaaccgatgtcagcccagcacaggttggagaggaagaagtacatgggggtgtggaggggggagtcagagctgacagccagggtgctgagcaggttcctcagcaccgtgaccagatacatggacagggacagcccagcgaggaccggctgcagttctggatcctctgagagtcccaggaggaggaattctcagatacctgtgagattctgtggctctgtgtgacttggacaccttgggaagaaaagaggattggaaaaagaaaagataaaaaccagcccttaatgctgtgtgtatattttggatgcaagcaaatgaaaaggaacattttcacacttgcggaccgtacactgccagcgatgtttctcagttgtgacaaatccaaaaatctcagaattattacatgatttacttttttgctattgaactctttctgtacatactactttagagaaaatccactagagaatgttaggagaccaaaacgtcatatataacaaatccgtgatctcagtaaaatacggcctactcttttcagaaaaaatacaatgcaatgaaaatgtccttctctcttgaagaaaaagatctcagtctaattgaaagaaattaagaagctgtgaaatacactctgttttattctgacaccgtgctacaaattcctttgatgtagaatatgtaaaaggacgatacaagagctaggaccacattatctaaaaacgaaatcgaaacttagagttcttaatcggaacaccttttcacatgccagttacttttcatatttattatcatcctgaggttttctgacatcatttcttcaaaaaagtacatgcacactcaaatatgggagctgtgtttccaaatgaattgaatatataactcttggccgagtgccatggatcacacctgtaatcccagcactttgggcggccaaggctgatggatcacctgaggtcaggagttccagaccagcctggccaaggtggtgaaaccccgtctccagtgaaaataaaaaaaaaaaaattagctgggcgtggtggggggtaaccctagctactcgggaggctgaagcaggagaatcccttagaacctggaaggcagagattggacaccctgtgataggatttttgatatcctagggagatattgctcctgacagcagagtgggcgtacaccctgtgatattatttgtaatatcctagaaagatattgctcctaatatcacagtgactgtacaccctgtgatattaatagtaatatcctacagagatattactctgaataattcagtgggtgtacaccctgtgatattattcataatatattacagagatatgactcctgatatcacagtgagtgtacaccatgtttgtacaccctgtgatcttatttgtaacaactttgaaaaatattacagctaatatcaaagtgggcatacactctgcaatgttatttgttatccactaggtagaaattactcctaatatcacagtgagtgtacaccatgtgtgtacagactgtgaaattattcataataccctaggaagatattactcctaatatcacagtgggtgtataccctttgatattatttgtaatcacctagggagatacgattcctaatattacagtgggtgtacactccgtgatgttatttgtaatgtcctaggaagatattactcctaatatcaaagtggatgtacaccatgagtgtacactctgtgatataattcatattatcccagagagatatttctcctaatatcacagtgggtgtacactctgtgatattctttgtactatcctagagagatattgctcccagtatcacagtgggtgtacaccctgtgatattattcataatctcctagagagatattacctctaatatcacagtttctctacaccctgtggtattattcatcatatcccagggagatattatccctaacatcacagtgcgtgtacaccatgggtggacaccctgtgatgttattggtaatatcctagggggatattacacttaatgtcacagcgggtgttcaccatgtgtgcacgcactgagatgttacttgtaatatcctggggagaaattacacctagcgttacagtgggggtacaccatgtgtttctattctgtgatgctattcgtaatatcttagaaagttattagtcctagtgccacagtgggtgtataccatgtgtgtccactctgcgatgttattcgtattatcctagggagatagttctcataacatcactgtgggtgtacctcatgtatgtactccctgtggtcttattggttatgccctgggttgatattacacctaatatcaccatgggtgcacaccataggtgtacattctgtgatgttactcataatatcctagggagatatcactcctgatgtcatagtgggtttacagccctgtgatattcttggtagtatccttgggacatattactcctgttatcacagtgggtatacaccctgtgatagtatttgtaatatcctagggagatatcactgtataccctgtggtattatttgtgacatttgagggagctatttctcctaaagtcagagtgggtgtacaccctgtaatattcttcctaatatcacagtggctgtacaccatgagtgatatgtttttctaatatccagtgagggagaggatgatactgcttccaatatcacggaaggtgtacacccccttgtgatattgttccgaatatccagggaaggagaggatgacattattcccaatatcactgggggtgtaccacctcccacagggatattgttcttaatatctgtagtggagagaatgatgttactcccaatatcccagggggtgtaaaccacccctgtttgtaaacaggggtgtatcacccctgtgatattgttccaaatggcctgtgaaagagtcaatatgactcccattatcgcagggggtgttcagccctgatgatattgttttctaacatccagggaaggagagtatgctattactcccaatattgcaggggttgtacacctttttgtgttattgggcccaatatccaggaaaatagaggatgagagtactcccaatatggaaataattgtacagcacccctgtgatattcttcctcatatccagaaaggaaatgaatgatattacttccaacagtgtaggaaatgtatacccgtgctgtgatatctttcccaatatccagttggggagaggatcatattacttccaatatcgcagggtgtgtacaccccctctgtgatctcgttgctaacatccaggtttggggaggatgacattactgccaatatcgcaggaggagtccaccctgcccctgtgtccttcttactcatttcccaggtggagaggatgatgttcctcccaatatcgcagggggtgtacacacccctgtgaaaatcttcctcatctccagaggaagaggggatgatattactcccagtaccgcagggcgtttacacagccctgtgatactcttcctaatatccacagggagagaggatgatattactcccaatatcgcagggggcgtacacaaccctgtgagattgttcctaacatccagagtgaaagaggatgatatgactcgcaatatcgcagggtgtgtacacccctcctgtcctattgttctgaataccctgggagggagaggataaggtgacattgaatatcgcagggaatgtgtaccctccccctctgatacccttcctagtatccaggggaagagaggaaaattttactcccaatatcgcagaggcagtacaacccacctgtgatgttgttcccaatacgcaaggttggacaggatgatactactccgaatatcgcaggggtgttcacatcccccgtgacattttccttaatatctaggggagagacaattatatgacagcaaaggtcgcagggtctgtacatcccttcctgatattgttcctaatatccaagggggaagaggatgatatcgaatatgaaaaggagtgtacaacccccacccctaagatattgttcttaatattcttgaggggagacgatgatataactccaaatatcgcaggggttgttcacaccccccgtgatattctttccaatatcctgggtgggagaaaatcatattacttccaatattgtaggtagtgtattccccacctgaaatactgcactgaatatccaaagagggagaggatggtattcataccaatatcgaagtgtgtgtgcacgccccttgtgatacggtttttaatatccagtgggcgggaggatgatattcatcctaatgtcacagagggtgtacactacccttgtgatactgtccctaagttccagatgggagaggatgaggtcactcccaatatctcagaagttgtacatcccccgtgatacttactgttcatcatatccagggaagcacaggatgacattccattgaatttcgcgacaggcgtacacgcacagtgtgatattgttcctaatatccaagaagggaggagatgatattactcccaataaagcagtggttgtacattacccgtgtgttattgtctctaatatctggggccgggggagcggggaagaggataacattccctcaaatttagcaggtggtttgacgcccctcgtggtggtgttttacatatccagaggggaagacaatagtactatttttgatagtccaattcatccgctccacctttccagaactctgaggctgggaggcggcatgcagtttccgtgtgatccccaatacctttgctgtcttctgtagcaagtcagctacaaatgcaggcccgttatctgagccgatccggaagggcagtcccaatctaggaatcagacctcgaagaagcacacgggtttcttcacgaggtttcccagttcgtgttggataagcctccacccacccagagtaggtacgcccaagaacaagtaaatacttgttacctccacactttggcatctctgtgaagtctacctggagatcttcaaaggggactgctccataagcttgtacactgggctgaacggctggaccttgcctcgcattaggctgtaggcaggtgacacaccactgcctcaccgttttggcaagagctgacaaatgtgagatgtagaaataccagcctaacaacttttcaagtgactcctgacatagatgggtgccagtacaactgcagttcctcacagctgtggcacagctacgctcccatctggtaactgactccatccttcctccatcacttgtccttccctctacctggagaaagtccttttattctttagaataagcaggtccaagatcaggtgcttgagggagcagaggggctatgactgatgcccggaaggggacagatgctgcttttgcagcctctgagtcagcgcgggaattccccaagcccaccaaggtggaagctcgctggtgtcctctgcaatgcataactgccaccttgtggggtttccatactgcttctaataaatgcaagatttctggttgttattttctgccttttcccccagagttcaataggcccttttccttctatcacgctccatgcacttgaagggttaaaaagacataccgagaatcagtgtaaatgttgacagtctcaccctcactgagttctaaggcctgaatgaaagcaatgagttcagctttctgggtgaagtggcctggggcatcgatctggcttcaacaacagtgtccagggttaccactgcataccctgcacctctctctccttgcgggatgatgaagctgctcccgtccacctatagttcccagtctactgatgcccaaggctggacccggaggtcaggtctgctagagtcaaccgagtccaacatttctacacaatcatgcttgacagggctctctgatagtgggagcaaggttgcagggtgtaggatgttacaaacttcaatggttatatggggattttcactttggtacttggtgagtctcgcattcgttagccaatcatgtcctttagtattcattaaagtcaccacagcatggggggccttttctgttcaggttctacccaagagtcagcttatttgcttcttgtactagcagggcagttgctgccaaggccctcaaacatgggggccatcctttagagaccccgtctacttgtttagagacgtaggccaccagcctcggccagggccccacagtttgggttcaaagtccggctgccatcttttctctctctgacacatacgatgtaaaaggctttgtcagatcaggtagccccagggctggggctgacataagtttctcctttaactcgtgaaagacttgctgttgttgggatccccattcaaaaggttcccggtccccgcctcctttgtgacctcaaacaaaggcttagctaatactgcaaagtttgggatccacagtctacaaaacctcacagctcctaagaattctctcacctgccttctgctcttaggctctgctagatggcaaatgacctgctttgtttctgatacgaggctgcattccccctgtcagatagtatatcccaaggaacatacctgctgtcagcagatctgagcttttttcttggacaccttatacccacagtcctccaggtgtgggcgtagggcaatccgttcccttggtgcacccgactgccgtggggtgtcccagccaaagctcatcaacctaccagagcaacacgcagcctaggtctctggtgggaaacttttggaggtctcgagccactcacacatgtaccttggggtgccaccatgcatggatctgagtgttgcggtctgttgtgagatgatgaaggatctcaggcatgttcctaaacatgtctagcttattgacatgaatctaaggaaaataatatgtacgggcaaattatttgaactgtatttcctataaattgttcaaggttaattactcagggcaaaacacccagttagtgaattcaccctctcttctttcttgaaaagcagtttttggctatttcagtgcactctggtatcctgccagcatgtcaacaggcacaaggctgactggtcaggatcgctgccatcactgacggaagcgaaaaattacagagactcggctcagggatgtcatttaatgatgttaatattgtccttcagtccttcaagggaaattcaattaatgttcttgtacacctactgtgtgtcgagctttattctaaatgcgaggaataaagcagtaatccacacagacaaaaacaatcaagaatcatctaccctcggccaggcgccatggctcatgcctgtaattccagcactttgggaggcggaggccagtggatcacttgaggtcaggagttcgagaccagcctgacaaacatgctgaagccccatctctactaaaaatacaaaaattagccaggtgtggtggctcaggcctgtaatctgagctacttcagaggctgaggcaagagaatcacttgaacccaggaggcggaggttgcagtgaaccgagaccatgccactgctgcactccagcctgggtgacagagcaagacagtctcaaaaataaaataaaataaaataaaaaatcaagaatcatctttaaggcatatacatgacatgcaacagaggagcatgtactgcaaaaaatccactcccatatctccttgttcaaatttattttcaatgctggtcacaatcgctaaatttatttcatgacccaaagtttgggaaaaatactttgtctatggggcatttcactgaaggctcttgtaagccatttgggcttctgtcaattttctcccaggaggatgtgactgaactaagatgatatattccttcagagggcccgcgaacctctgctgcagacacgtcttgatagggtgcttccatctgtccctgtttgcagttatttagcaggcaaggagggggaggaaaggtgagctgggaggatggaagggagcaagagaaaagaatgaatatgctgggagcactggctcacgcctataatcccagcactttgggaggccgaggcaggcagatagcttgaggtcaggagttcaagattagcctggccaacatggtgaaaccttgtctctaataaaaatacaaaaattagccgggcatggtggctcacacctgtaatcccagctactcaggaggctgaggcaggagaattgcttgaacccgggaggtggaggctgcagtgagccgagatcgcatcactgcactccagcctgggtgacatagcaagactccctctcaaaaaaagaaaaaaaaaaaaaaaaaaaaagaatgaacagtcaccatacctggactcctaattcttcactaaggttggtgaacaaatattcatagccataagccgctttgcagttcagccacacaacatggtacaggctctgagtgatccagctttgaaccagctctaagactccacataaacactcctcctagacaggattttaaagagacatttaacaggtggagagccgcacatagccttttccttcccaacagtcccaggtactcacacctacggggacagttaggatatgacctgtcaccctacaaacttcctactaaaaacacgggcacacccagatgataacccttttcctccaggcagacttacctgacttggaatttggtaaaatcttggatcacacaacatagtatctaaatatacactttggatgtctttgaaaagaagaaaaaaattgatgttagccatccaatgtgatataaattatgtgtaactttttttgttttttgagatggagtttcgctctgttgcccaggctgaagtgcaatgtctgctcactgccacctcctccatctcccgggttcaagcaattctcctgcctcagcctcccaagtatctgggatcacgggtgtgcatcaccactccttgctaatttttgtattttttagtagagacagggtttcaccatgttgaccagtctggtctcgaactcctggcctcaaatgatccacccacctcggcctcccaaactgctgggattactggcatgagccaccacacctgtttatggccagaacaatattgttctgtttatggccagaacaataatactttattcagtcatacacataagaactgtacaaggggccaggcacagtggctcatgcctgtaatctcagcaatttgagaggccagggctggcagatcacctgaggtcaggagttcaagaccagcctggccaacatggcaaaaccccatctctactaaaaatacaaaattagttgagtgtggtggcacacacctgttatcccagctacttgggaggctgaggcaggagaatcacttgaactctggaggcagaggttgcagtgagccaagattacatcactgccctccagcctgggcgacagagcaacactccgtttcacaaaacaaacaaacaaacaaaaaaccacctatacgaggcccagtacctgcccccggagtgcaaaagctccattctagcagcttctccttgcaccaatctgaagtcccctgtgtacaagatagttccattattgccctgaaataaaaacctgaaaaagaaatatatcccagtgacttctgagtctcatataaaatcccaaataaagcaaatacatgtgagctgcatagtaaatgcttcctgcaaatatatccattaaaatacaatggtaatggaatcccacagtaatttgaaccacaccaggcactcagctgttacctcttccctcgggtagaaaataacagaatggagatgctacccaatttctaatagatgttccttgtgatatgttagcactttcaattatatgttgagatcattcttgctcatggagagagaaatacaagtgatgataaaatacaaggtcgctggggaaacagctgctgaagacttccatttatttatttatttatttatttatttatttatttatttatttttattttgagacaagagtcttgctctgtcccccaggctggaatgcggtggtgcaatcttggctcactgtaacctccgccacctgggatcaagcaattctctgcctcagcctccccagtagctgggactacaggagtgtgccaccaagataagtgaaaaccgatggccacaaaaaatgtgtgcctgactgttcacagcagcattcttttttttttttttttgggagacggagtctggctctgtcgcctactctggagtgcagtggtgcgatcaagattcctgggttcaagccattctcctacctcagcctcccaaatagctgggactacaggcgggcactgccacgcccagctggcacagcggcattcttcatactagccaaaaggtggaaccagttcaaatgtctatcaactgatgcacgaatcaggaaaatgtggtctagccatacaatgaaatattatttggccataaaaagaagtgacacgtgctgcaacatggatgatccttgaaaacatcctcagtgaaagaagccggatatgaaatgagcacatgttgtatgattccactcataggaaatatccggaataggtgaacccatggagacagagagtccaatacagtagtggttgccgggggttggggaaggagagaatagggaggcattgcgatcgctaaaggcttcttcccttggggtgctgaaaatattctgaaattgattgtggtgatggatacacaagtgtgtgacttgatttctatgtcaataaagctatttacttttttttttttttttgagacggagtctcactctgtcgcccaggctggagtgcaatggcgtgatcttggctcactgcaacctctgcctcctgggttcaagcaattctcctgccccagcctccccagctgggattacaggcgcctgccatcacgcctggctaattttttgtatttttagtagagatggggtttcaccatgttcgccaggctagtcttgaactcttgacctcaagtgatacgtctgcctcggcctcccaaagtgctgggattacaggtgagagccaccaagcccggccactatttaacaatttttaaagccttagccaggtgcggtggctcacgcctgtaattccagcactttgggaggctgaggtgagtgaaccccttgaggtcaggagttagagaccagtctggccaacatggtgaaaccctgtgtctactaaaaatacaaaaattagccaggcgtggtggtgggcacctgtaatcccagctactcaggaggctgaggcaagagaatcgcttgaacccaggaggtggagattgcagtgaaccaagatcgccctactgcactccagcctgggcgacacagtgaggctcagtctcaaaaaaaaaaaaaaaaagattaaagcctggatgaggcctggtcccgatacacactgcacatcatactgttcggcaagggcaagacctgcgggcactactgcctctccagccatcagtaagtggggagagctctgcacacaccaggtcactgctcagtgacagtgactcctcatggaagtctccattcattctggaggaccctttcgaatgggtctccccctggttggagctggataaacaatgcacaaaagtcatggcacacaggaagaaacataaaaaatcaaagtggaggcaagactgctcaaaagtcagcctgctgtcagcccccagctcagggaatgcctttcaccaatatccctgatgtgacaaggccacacactatcacactattccccggaaaagcagttggcagagtccaggatggcatttacaaaggttcacctatttttttttttcctttttaattctccctaaactggctctgtagtcctccctcaggataatttgatgggaagaatacttcaacttcaactgtctgatctccaaagaagaaacatctgaaaaggtcagtttctgttcagatcacattcaaacaacacaagacaccctcacagttaaacatggcaaagcagtgtgctataatcaagctacaaaaccaatattaaccaaaataggaaaaggttaaaaaaacggggggtgtatgtctatagtcctacttattaaaaccatacattcacaaaagtactactcaaaatttaatgatgaaaaataaatttttccacttggcagtgccccttttctgaataagggttcagaaaaaaagtacaatatccatgaatttgctgcaaaaatattaatcaccattttaaattctgaatattataaaactcagtaaatgtgacaataacatcaggtagtaatatcaacaccagggttcccatcattagcatgtaataaggaacaaaaaataagccatgcccaatcctttacaacatgggaaataaatacatcactgttaaggactaaatgttcgtgtcccttcccaaaatccgtatgttgaaatcctaacccccaaagtggttttattaggaggcctttgggaggtgattagttgttgggcatagaagccttgtgagtgacatcagtgcctttataaaagatgcccaggggagcttgtttgctcctttactatgggaggacacagggaaaaagacagcatctaagaaccaggaagtggccaggcacagtgactcacaccggtcaccccagcactttgggaggccaaggcaggcagatcacttgaggtcaggagttcaagatgagtctgaccaacatggtgaaaccccctctctactaaaaatacaataattagctgggctctggtcgtggtggcaggcgcctgtaatcccagctactagagaggctgaggcaggagaatcgcttgaacccaggaggtggaggttgcagtgagccaagatcacaccactgcactccagcctgggtgacggagtgagactccgtctcaaaaaaaaaaagaaccaggaagtgggccctcaccagacacgaaatctgctggagactggatcttggatttccagtctctagaaacctaagcaacaagtgtctattgtataagccactcagtctacggtagttttgtgagtccagcccaaatggacttacacaatcacaaagggattttttgcccctaaaaccccactcaattactagatttttatttatggttaaatgagcattcaaaatcaaagagaaagattgagggtatagctgatgggtggagcatctgactacaaaatcaaagagaaatataaacaatcattttagcaccgcatttttttaaaaaaatcaatatttaatatttagttacctctcctgatgcttcatccactaaagatatctgggtaggagcctcgatttcaatagatatctgtaaaaataaaataagagaccatgtatgtagcagtttttcatggctttatatgcctttgctgtctgaaacacagaaacggggcaaagagaagtttcagactctctatataaacaattccgattacattgtaataaatattttaacagaaagaattgtaaagaaaataatacctgtcttgaggcagatttggcaatacggagtaaatgccttgtaaatgcatataatcctctgacacaattctgtttccatgaattcatttttcctccttcatctccccatccctaccactcccgttcccctctctctctgaattttgagtctttgtaaaaacgtggtcatgtgtcctaacttttgtgcctcagaacacagtctggatgggtctgtgacatggatgcttcatacactggttctttttttttttttctcagatggattctcgctctcccaggctggagcgcagtggtgtggtattggctcactgcaaccaccgcctcctgggttcacgcgattctcctgcctcagcctcccaagtagctgggatgacaggcgcccgctactacgcaaggctgagttttttgtacttttagtagagacagggttttgacatgttggccaggctggtctccaactcctaacctcaggatcaactgcctcagctttccaaagtgctgggattacaggcgtgagccaccacacccagcctcatgcactggttctaagtgctgcagaacgctccctggtacatttccccctgccatcaaaacagagactagcacataagaggcattcagtaagtatctgatgaatagatcagtgtgatttttcatctttttagtccactaatgtcctaaaacttacagtgtctaaggtttgggtgttaaagtatttttgcatttctggaatgaaacatcttattcatgatgtactatttaacactgctagattcagttactgtctttatgaggattcttacattttcatgtatgaaatgagtttttccccatttattatttttgagatagggtctcactctgtcgcccaggctggggcgcagtggcacgatctcagcttgctgcaacctctgcctcccaggttcaagcaattctcctgcctcaccctcctgagcagctgggactacaggcacccgccaccatgcctggctaatgttttgtagcagagatcgggtttcaccatattggccagactggtctcgaactcctgacctcaggtgatccctccacctcagcctcccaaagtgctgcgattacaggtgtgagccactgagcccgtcctcttttctaatatatctatttaatgctctcaatttcccttcaaggacaaatttagctatgttccacacattctgacatgccacgtttccattgtccatcagctcctttatttatttatttatttatttatttatttatttatttatttatttagagacaggctcttgctgtgttggccagcctggagtgcagtggcgcaatcacggctcactatagcctcaaacttcggggctcaagtgatttttctgcctcagccttctgagtggctgggactacaggcacactctactataccaggctaatttttaaggtttttttgtagacatggggttttgcggtattgcccaggctgctttcgaactgctggactcacacaattgtcccaccttggcctcccgaagtgctaggactacacatgtgagcccccaagcctagccatatcagttctacatattgtatgttttctttatcgtacaatttcctttttaaccaaagggtcagttattgtatgcacttagtttccacgtgtatgggaagattttagctgtccctttgtttctgatctccaacatcattgccttcttttgtgacacagtacatggttagtttttgtaagtgtcatgagcaccccccaaaatactattttcttccttgggtttaaagttctgttcattagtccacattcacacattttctgcatcctgtttcctgcctccttctttcagcatctgggaggggcatgttaagctcttcagtgacaattgttgatttcctatttcttgccctgattctgcggtggccttgtttgtactatgtcaactcacctaagctggaactgtttcctagaacccctttccatgttgttgcccacagtaaacattcagaaggcagatgtgaactagtagggtttttttaatgctctgaagggtgccagaaatggtaacagctcgtgaacattgctgaccttctggcttaactcagagtctggggcagggccgcagcaacatcagcttctgctgggtgcctgtgtgcagctcctccgagtcctggggcaggtgcatgtgcttcagagccaaagcgggagaccagcactattgaggccagaagaagtgagagacagaagtgggtttcggtctgtcctgctgggctctagtgagccactctgccttccagtttgtctctgttcccctccacttctcttccagctttccttcctgactgctggccgggctgacctgtagtaacttcaagctgaatgtcagagacaacaggaacaaccctgctgttgtgactgctctgcagagggaggacaaatccccttcccaatcaaaggtcagatgtggaggtggatgatatcatgcacacaaacacacgtgcacacactatgtgtgcatactcacacacgcatgcacatacacacacacgcgagcacacacacgacagagaatgagaagaaaacttcagtcacatcacaggattttcggggagggcagtgcagtccctgagctgaggacagaagtgtttcctgtggcttaagagagagtaggagcaagtagccctggtttccactttggtgcgggttgggcctggacatgcctggtttgaacttcgctttagtgctaaggcaggcatgggcctttttgtcagcttgcccaaatgtgggtaggagggaggcactggctgtaagcagcttaagagcaaacagaagcctggcacagtggttcacacctgtaatcccagcacttgggtggccgaggcgggaggatcacctgagggcaggagtacaagaccagcctcgccaacatggcaaaaccccatctctactaaaaaatacaaaaattagccaggtatggtggttcaggcctgtaatccccgctactagggagggggaggcagggagaattgcttgaaccggttagatggaggttgcggtgagctgagatcacgcctctgcgctccagcctgtgacaaagtgagactatctcaaaaaaaggaaaaaaaaaaatagaaacagactctttgtgacactgggacaaactgctctgccaactcccacaatgatttaagaactaatccatgtaatgaacccacattctgttaagtcattgtggttctcctcagatcaagcactgggtgacaggttctcgcagtttctacttcagctggacgctattttgtcagttgcacatacatccatatgacccatggctccttttaacagtgacaccctcttcaaaccttgtctttctttgccttctagtctactttctgatattaaaaactgccactctgacattttggccttctaattggttagtaattttttcttcttcccccaaaatttcaaatttcaacctatatttatccttctgttttatctatgtctcttatagactaatactcatgaatttgtctaactgttttgtttgtttttgaagatggagtctctctctgtcacccaggctggagtgcagtggcacgatctcagctcactgcaacctccgcctcccaggttcaagcgattctcctgcctcagcatcccaaggagctgggactacaggcaccgccaccacacccaattttttgcatttttagtagacacggggtttcaccctgttggccaggctgttctctatctgacctcaggggagctgcccgcctcggcctcccaaagtgctgggattacaagcgtgagccactgggcccagccagatttgtctgatttttttaacttaaactgagaatttgtctttttttttttgagacggagtctcgctctgtcgcccaggccggacttcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgagaatttgtcttttgaccaaaggtacaattagatcctttcttatatatagtaatatataattggactttttctgccttctttgcattttctatgcaccagacgtttttctccccttgactacctcacattggacagatgcattttattctgccagaccgaaagttacccattctatctgtattcttctagctgtcatcccttccttatgacagactgtaatttatgtttatttttcttactctatcccacaatttaaataaaaggatttagcaattatgttaatgaacactttatattcttgttaaatatattaaaatgtggccaggcatggtggctcacacctgtaattccaacactttgggaggccaaggtgggtggatcacctgaagtcaggagtttgagaccagcctggccaacatggtgaaaccccgtccctactaaaaacacaaatattagctgggcatggtggcgggattctgtagtcccagctacttgggaggctgaggcaggagaatcgtttgaacccaggagtcagatgttgcagtgagctgagtttgagccactgcactccggcctgggcgacagagtgagactcctcctcaaaaaaaaaaaaaaaaaagagaagaaaagaaaagaaaagaaaaatactaaaatgcatcttagcaagagggtcaatgagattaaacaaacaaaactaaagacctagatagatccattgcactccagcctgggcgacagagtaagactccgtaacaaaaaaaaaaaaaaaaaattagccgggtgtggtggtacatgcctgtaatcccagctactcaggaggttgaggcatgagaatcgcttgagcctgggaggtagagattgcagtgagccgagattgcaccactgcactccagtctgggcaacagagtgagaccctctctcgaaatcaatcaatcaatcaatcaatcccccagcaacctcatagctcaggaggaataagtctgaggcgtatgttttacactggctccagcaacttctccagtaggagttaagcttccattacctgccacagtatccgactggataacgtactctgttgggttcctccctgccttgctgcttcttccaccccttacctatggttcttttcctcctgaataacctccttgtactccgaagccttatcccaggattggcctctaggttcccccacctaagacaacataatcccaatgctgccaggaatctctgcagaaacagcctaaatgttgatgagtgaggaaggcagtactaacctttaagatttaagaagtcccc

SEQ ID NO: 336 - DNA, 13812 bp, Homo sapiens
cttattgggtcttgattattacatttcaaactctactatctgtaagcaaaagagacataggccaagttatccttgtaaagaactcataagaatttcctgacttacctggctgatgcttcctttggggacattgccttcatgatcatatgggtgttggagtgtttgtcatgccaaagagaatctgcatgtgtgactaataagtcagcatttcaagaggcctggctatactctgcttaaaagtgaaaaagcactggattggcaggcataacaaggagaaagtggcattgatatggtaatagtgactttttaatggtctaaggaaagattccctctattctttaactgtgcattggtggtagggtgttgtgtaggtttcttgtctgccaaggcaatgaacagatacattatggtcacttttgtggattataatagggaaaatgatgattcgaaggaaagttaaaaggtatttaataatgagaattgtattagctttcaaatatctgttttcccttcacttacttccttgttatctcttcactgggagatgtgcttccatggctttcatcttttttttcccctcttttaaaagatatttcaaactttcttttcatacatttctcttatatattttaggcaagtagaagaaacccaatgttgtctgcatttgtgtagtttatgtgtgcccaggcctatatgactagtgttttgataacacagaatcatgatctgctttgacattccaaaattatggaggagagaaagtaccactctttgcacccttgttttcttgtaggacccttaaagactaatattaaaacatttgcccttctcaagacaattcaacaccccctcttcttcaggtaatgtctgccaccatgcccaccacttcaactcaagtataccccactgactctattcagtagagagatggcaaaagtgtgaaattgtattctcttccccctatttcagttctctttttgaagaggaaaccaaccaaccaagtttatatcttgaaattactatctgtgggatatttgcagctgagactaagtcctagtgctttcttaataaaagctatgcatgtaaatagggtcagcttttgggctgacattgcatttgaattaaaatctggcatctccacaccattgacaaatctgacagctggagcagcagtcacctcatcatatctctcagttgtgtctttcctggtttttggcatccttcctgtctaaatttttatcagatgagcacttttccttggcaagtactttaaataccttcaacttgttttatctctgaactgtaaccctttgccctcagatgtcatatctcacatgtatgactggaggatattcagaacaaattagttaagaatgcaacaccagagtgcaatttcatttggtcttctccctgccccatcctcttcccaaatattggagcttcctgttgaagagacctttatggacattgattaatttcatggaagctacttaatggtcttgcaaattggaacagttgtaagttttgattgtgacactgcagggctaactccacctgtgctaagcattcagcattgttttctttggctttgcttcattcacgataatcaaggacttgggttcattaccagcattagcaagcctcaaaggcctctcataaatccaagccaaacactgtgttaggaggttccttagattaatggcagccctggttctctgaggctgtgttgagatctgagagaaggtaatgttcactcggcttcagcatttctacttgtagttcaaagccaaacctggaggtacaggatgatctgcaggcaacaagagatagaatgtgggcctgcaaaaggtaccacctgtatacatgatgagctcttcctgcctggcacgcaaagaactttagagttttcctcaagccttttcctatgaaaactctcaggttttgtcagctgggtcaatccattgcctttccaatacacctggagcatttcttccttgatgaattaagggctgaacaaggatgcatgtcaggggtgaaaccctttgaagagtgcaaaaataaaaattggttgtttagtaagtagaaagataaatcaaaaccaatctataaaagttagattcatatctcttttcagggtcacaatttgcctttgttttctagcatcttcatcggtgcttgcaactgaaatgggtcttcttttgactcttggtctttccttagttaagggtgagggagactctttggttctccagcggacaaaagaagacagctaacaaataagtcactctttcttccatagtctatttataagccttacaagttaatgctggaaaggccaatgagaagaaaaataaaacaacagtagtagtagtagtaataagcatgatcatcatcatcatcattggccgcatttttagagaatttgctatgtaccaggcactgttgaaaagaaaaataactttactgagatataatacacattcaataaaattcattcacttgaagtataacagttcagaagtttttaatatatttacagagttgtgcaactgtcaccactatctaatcttagaacatttttgtcacccccataagctgccctatatcatgagctgtcactctccattcctcttgagcccccaacccctgtcaagtactaatctactttctctatatatgtatttgcgcattctggacatttcacataaatgcaatcatatagtgtgatcttttgtgcctggtgtctttcacgtagcatgttttcaaggttcatcatattatagcccatgtcagtacttcagttctttttagagatgaataatattctattgtctaggtacagacatgccacattttgttaattaccatcagctgatgaatattttgactagaattcaggcattatacttttatttttaacctttcattttgaattaatttcacactgttgaaaaattagtaaaattatttcttatacacccttctcccagatttcccagttattaacagcttatataatcacagtacaatgatcaaacatcgatacaatactattatctcatctaaagaccttattcaaatttctccctctgttgtactaacattctttttctagcacaggatccaacccaggatcacatattgcatttaattatcatgtctccttagtctttttaaatctggaacatttcatcattttttaactttgagactttacatttttaactttaaatatatattatttttatgttatatattttttagaaatagggtctcactctgtaacctagactgagggcactggcatgattgtagcttactacagccccaaactccttggttcaagtgatcctcctgcctcagccttctgagtagctaggactacaggcatgtgatactgtacctggctaatatttaagatttttttgtttagagacaggattttgttttgttgccaaggctgatatcaaactcctggctttaagcaatccttctgtcccagcctcccaaaatgctggaattacaagtatcagccactgggcctggccttagttttatattttaaaagctaagcacgcttactgcagaagaatatataaaacatgtaagacagaatgaatagaaatcacccttatttcattaccattagatggtcactattgacaatttgatctatttctgtccttctattcatattattgaaaatataatttatattctcttttaaaccagcattatatcatgaccattttccatgcattaagaactcttaaaaaacataatagtttcataatggtccatcttgtggttaatacatactgccctccagcatatctgtgatattaaacatttaggttttctctggtgaaacaaaatgaaattagtcaatgtgtatgaactgttttaaggttactaatttgtattgctaaaatgacttccaaaatgatgatatcaatataaattcccttaggactctgtgaaagcctgtttcaccacaccatcctcagcactggggaaattcatctttttccaatgtttgaaaaattaaattccactgtgcctttagtttgcatttccttattagtgatattaacttttaaaaacagttatcaatttgtgtattttctttggtgaattgtctctttgtatgcaaaatataattttttaattataaaagaaatcaaggaaaaggtatgctttacacactatgcttattttctgcctttttttaaaaaaaaaataaaagtaacttcaacatttattttagattcagaggggtacatgtgcaggcttgttacatgggtctattgcgtgatgctgaggtttgggatatggatgatcccatcatgtaggtagtgagcatagtacctaagaggtagtttttcagcccacactccctttctccttctcctctctagtagtctccagtgttgatcgttgtttccatttgtatgtctatgtgtactcagttcttagctcccacttataagtgaaagcatgtggtatttggttttctggtcctgcattattttgtttaggattagcctgccgctgtatccatgttgctgcaaatgacatttcattatttgtatagctgtgcagcattctaaggtgaacatataccacagtttccttattcagtctactactgatgggcacttgggttgattccatgtctttggtattgtgaatggtgcagcaatgaacattcaagtacatgtgtctttttggtagaacaatttattttcttctgggtgtatacccagtaattgggttactggttgaatggtagctccgttttatgttctttgagaaatttacagactgccttccacagtggctggactaattttcattctgacagtgtgtaagcatttgcttttctccatggcctcaccagcatatgtcattttttgactttttaatatagcaattctgactggtgtgagatggttttccattgtggttttcatttgaatttctctaatgattagtgatgatgaggattttttcatgtttgttgtatgttttcttttgagatgtgtctgttcatgtccttttcccatttttgatgggattatttctttattgcttgttgatttttttaagttccctatagattctggatattaggtctttgttggatgcatagtttgtgaatatctgctcccattctttaggtagtttgtttgctctattgatagtttcttttgttgtacagaagttctttcgtttaattagggctcacttgtctatttttgttttagttacaattgcttttggggatttagcccaaaattctttgccaaggcctctgtcatgaagagtatttcctatgttgtcttccaggatttttatagtgtgaggtcttacatttaaatctttaatccattttgagttaattttttacatgtggtgaagggtagtggtccagcttcaatcttctgtatatggctagccagttatcccagcatcatttattgaaaagggagtccttttcccattgcctatttttgtcagccatgtcaaaaatcagatggttgtagttttgccactttatttctgtgttttcttttctcttccatttgtctatgtgtatgttttcataccagtagcaagctgttttgggtactgtggctttacaatatagattaaggtctggtagtgtggtgcctccagttttgttctttttgcttaggattgttttggctatttgagctctttttttgtttcatatgaattttaaaatagtttcttctaattctgtgaagaatgacattggcagtttgatagaagtaaccttgaatctataaatttctttgggcagtatggccatttttatattgcttcttctaatccatgaccatggaatgtttttccatttattcatgttgtctctgatttctttcaacagtgttttggagttctccttgtggagatatttcaccctcttggttagctgtgttcctaagtattttaatttctttgtagtgattgtaagtgggattgttttcttgatttcactctcagcctggacattgttggtttatagaaatgctgctgatttttgtacattgatctttgcatcctgaaactttactacaatttttccttttttttctttcttttttttttgctaaagtggtttatgaattttgggagccttttggcagagtctttagggttttctaggtatagaatcattttgtcagagaagatagtttgatttcttctttgcctatttggatgccttttatttctttctcttgactgattgctctggctagggcttccaatactattttgaataggagtggggagagtggacatatttgtcttgttacagttctcccagggaataatgctttcagcttttgtctcttcagtatgacattggctatgggtttgtcatagatggctcttattattttgaagtatgttcttttaacacatagtctgttgagtgtttttatcatgaagggatgttggattttatctaaagctttttctgcatctattgagatgatcctatggcttttggttttaattctgtttatgtgatggatcacatttattgatttgtatatattgaaccaacctcacatcacaggaataaagcctatttgatcttggcaaattaactttttaatgttgattcaccaagatcaagtagaatttattctggagcctacggactggcgctgacattgtagaatgagtaagggaggagcccctcatccctgattttttagaatagtttcagtaggattggtacccatttttctttgcatgtctggtaaaatttggctgagaatctatctggtctggggctttctttgattggtagtttttttttttcaattgttgattcaattttgaatgtgttattgttccgttcaggttttcactttcttcctggatcaatcttgggagattgtatgtttccacgaatttatccatttcctgtagattttctaatttctgtgcatcaagttgttcataatagtctctgaggatcttttgtatttctgtggtatcaattgtaatgtcatctttgtcacttctgattttgcttatttagatcttctgggtttttttcattattagtctagctagagatctatgaattttgtttattcttttgaagatctaggtcttggtttcattgatcttttgcatggatttttgcatttcaatttcatttagttgttctctaattttaattatttatttctctgttatctttggggttggttcttttttttttttaagttcctctaagtatggtgttggattgttaacttgaggtctttctaacttcttgatgaaggtgtttagcactataaactatctccttttaacactgttttagctgcatcccaaagattttggtaagttgtgtctatattttcattaatttcaaagaattttttttatttctgccttaattattttgttcatgcaagagttactgaggagcaagttgtttaatttctctgtatttgtatagttttgagagatcttcttggtattgatttccatttttattatggtgtggtccaagagtgtgcacagtatgatatcaacttttttgaatttattgagacttccttaatgattgagcatatggttgatattagaatatgttccatgtgcagatgagaagaatatatattctgttgcagttgggtatagtattctttaaatgtctattgggtccaattggctgagtgtcatgtttaaatccataatttttttgttcatttctgcctcaatgatatgtcagtaaagtctgtcagtggagtgttgaagttttccattattattgtgtgggtcttcttgtagttgttttatgaatctggatgctccaatgttgggtacatatatgtttatgatagttaaatcttcttgttaaatcaaaacctttcattatgtaatgtccttctttctgctttttgtttgttgatgttttaaagtttgttttatctgatataagaatagtgagtagtgctcttttttccttcctgtttgcacggtagatcctgctacttttagcctgtggatgtcattacgtatgagatggatctctaaatgatggcagagagtttgatcttgtctttttatccagttggccactctatgccttttaagtggggtgtttagactgtttacattcagggttattattgatatctgagattttgaccctgtcatcatattgttagctggttgttttgtagaattgattgtgtagtttctttatagtgtctgtgggctatgtgcttaagtgtgtttttgtggtagcaggtatcattcttttgtttccatgtatagcactctgttaaggacctcttgtaaggttggtctagtggtaataaattccctcagtatttgcttgtctgagaaggattttatttctcttttgcttttgaagcttagtttggcagaatatgaaactgttggtatgaaatttctttttttttttttaaggatactggaaacaggctccctatgtcttctgccttgtaagaattctgctgagaagtccactgctagcttgatgggattccctttgtaaatgaacggatccttctctctagctacctttatgatgttctcttttgcatttaccttgatgattctggtaactatgttccttggggattgtcatcttgtatagtattttgcaggggttcttggtatttcttgaatttgcatgccagcctgtctagcaagattggagaaatgttcatggattaataataatgtcaatgacttgtaggtttggtctctttatataaccatatatttctcagatgttttgttcattttttaaaaattattttttaaaaaatttttatctgagtttactcaaataactggtcttcaagctctgagattctttctgtggcttggtctattctgctgttaatgcttcttattgtattatgaaattctcatagtgaattttttcaattccagaagttcagtttggttcttttttgaaatggctattttgtcttttagctcttggatcattttactggattccgtgaatttctggattgggtttgaatgttcttcttgatctcaatgagcttccttgccatccacaatgaattctatgtgtgtcattttagtcatttcaaactgattggataccattgcttatgagctagggtgcttatttggagggaaaggaacactctgactttttgaattctcaggtttcttgcatggattctttctcatttgagaggactggtgtttctttagctgtagcataagttgagtataatcaattggctttgtttctgggcgctttcagggtgccaatgctctgtacaggatctgtacttaaagctggatttttgccccttctctaggagctatttggggccaggaactgtccctgacatttgacaaatctatgcagggttcccagcttcctccctcttcagccttggggtctgcctcacctctcttttgactcttggtattttctctttgaaaatctgttcaaaatatgttagcttacccaatttttggtctttcttggtgacagcagtgcttcctgactgtgtccagttggacgtcttgtccagaacccctggtgattatttttaaaatgaagctttgttgtagcactcttggccaatttaatataatgtccttttttccctttataagttagccttcatgtcttcagtctacacttagacattcaggtcctaaatattacctttgcatattcagtatacaccagctccattcatagctgaacacttcaccaggttcctaattcctgaaagaacagaagccatatctgtatcccaggaggctggggcgacaagatggtggatctccccttattttcttttcatacattttttcaccaaaatttgacttgtatttgcagctatctgctatcaaacactagaagttattctttctcactgtatttttgtagctatcaaccaacttttcttcatccctctctcccctctacttttctcaacctctgttaaccactattctactttttagctccatggcataagtattttttagttcccacatatgaattataacatacaatatttttctttttgtgcctggcttatttaacataatatcctccagttccatctatgttgctgcagaatgacaggatttcattctttttatggctgaatattccattgtgcgtatataacacattatccatttatctgttggtggacatttagcttgattccatatcttggctatggtgaatagtgttgcaacaaatataggagtacagatacctctgcaatatatttatttactttcttttggacatatacccagcagtgggatttctggatcatatggtagttctactgtttataaattttttgtactggctgtgctaattctaattcccaccgtaagtatatgaatgttcccctttctctgcatctttaccagcatctgttattttgtgtctttttgataatagccattttaactgaggtgagttaataattcattgtagttttgatttgcagttccttgatgattagcaatgttgaacattttttttttcatatacctattggccatttgtatgtcttcttttgagaaatgtctattcagatcttttgcccattaaaaaaaaatcagattgttattaatattatttttgctattgatttccttatgtattttggttgttaatcccttggcacatgtataatttgcacatattttctcctattttgtaggttatgcattcatttgtttattgtttttgttttttgctatgcaaaactttttagtgtgatgtaatcctatttgtctctgagtcttcttatccttatcttagaaatgaatctaatactatttgtctgtctgtgttgttggctgtgcttttgaggtcttactcaaaaaatatttgctaagattgttatcctaaagtatttcctcattgttttcccctagtagtttcatagttttggttcttatattaagtttttaatccatttttattttatttttgtatgggctaagagataggggtctaattttattgttctgcatatgggtgtccagtttttcccacaccaatcattgaagagactatcctttccccagtgtatgttcttgatgcctctgtcaaaaatgagttggctataaatgcctgggtttatttctgggttctctatttttttccattggtctatgtatctgtttttgtgccagtaccatgtaactctggttactatagctttatagtacattttcaaatcaggcagtgtaatgcctccagctttgttctttttgctcaagactgctttgggtattccaggagaatgacatttttgaagaatactagccaattattttatgcaatatccctcaatttagaatttttagatgcttcttcatgagtaaatttagatgatgcatatttggccagaatagcatactgcatccttctcagtgcattgtatcaggaggtatgtgatatcaatttctcccagttgtggtgataccagctttgatcacttggttaaggggaaatctgtcaggtttctgaaaagagttcctgttttcctttgtatttaataagtatcttgtggggagatattttgagactgtgtaagtatcctgttccacatgataatctccttcactaagtttagcacctgttggtacttacctacaacagttattaccgtggtgtttgccaaatggtgattttctactctcatcacttcttatacatttatttctccaaatactgctgtgagaaagagtttaccatgctctcctatttatatatttacttatttataacattgtggtctcatggattcttactttattctatgggttataatccattactgttgttatttatgttgttgatcaaactgttttaagatttgcccattgggagactgttccatttgactcttgactttttttttttacatgcccttgttatttattgtgctattccttattttcttttataagttgatcttatacttttctttgtctggaattagccatttctccaaggaaatctgatgacttttactggaggaaggtacttagaaatcatgatctggaccgtgttctattttatcttctccctatgagttaggcacaattagcaatcctacatttttaatgaaataactgagaactcaagaagttaaataatacatctgatgccacacaactgaaggtgatagaactactatttgaacccagtctaaagtttggtctccagtgtccatacttaaatttaatttctctctgggattggaaagcttttccagtgtctctgagtcttcttttccttgtcttagcaatgagtctagtactatttgcctctcagtgttgttgtgatggctaaatgaaaggacacatcggaaattgtctatacattatttgttccatagtggatactcaaatatacgttgaatttgagctatattcactcagtattcataaacacccactttgttcgcagcactgaggtagaaaatatgcaggtacatgcatatttcctggtaagagctcatatttcctggcaataatttctaatgtcactccttcctgtgcatccaatataggataccagaatcctttccaagatagaatttaggcagacactactgaacaaatgaaacgtatttgctgccctagacatgagtgatgaagggttgggagaacaggcgtgactctaccaaaaacaggcagataatccaggctcacatttcaaaacaccttgcaacttaagtttctaaccattttctaacagtccttgaaattatgctaatataaggacttccaggcaacatagaagactgggtgtacatgctaatacacaaatgacatagaggatcagcatcccaacttcttggaatatgccagacagtaataaatgtaacagccacaaaattccagccttgcttaatttggggaaatgagaatcagtttgttcttcccctgctggcactgaacagtggtttgcaggatcactgcgtgggaaagatctgacagtagagatctgagaggctgtctgtgtgaaggctgaatttcatgaactatctcattgttgggatggttccctttcagcctcgtggtaagtacaacactcaggtcactgtaagcgcagggcaggcaagcttaagccacaatgagtgaaaatatgtgtgtattgggttgggggaagggattttagtctggattatctgaagctcagactttaagctgagagcctgggctgccaagcaggtatatgtaaaggacagctcaaagctgaggtttaaaactagtatgctccaaccaggctgtgaaagtaactaaagtagctgagtgcctcagatcacctaatgtttatttttgttttgttttattttttgtttttccatttttgttgttgtttgtttgttgttttttctgagacagagtctggctttgttgtctaggctggagtggagtggcacgatctcggctcactgcaacctccgcctcccggattcaagcgattctcctgcctcaacctcctgagtagctgagactacaagcgtgtgccaccacgcttggctaatttttgtatttttagtagaaacggggtttcaccaagttagccaggctgttctcgaactcctgacctcagggaatccacccaccttggcctcccaaagtgctgggattacaggcgtgagccaccacccccagccgccctaatgttttacaagtttgagacataaacctgtggcatgcttttttttgggaacatgattcaga

SEQ ID NO: 337 - DNA, 16420 bp, Homo sapiens
cttattgggtcttgattattacatttcaaactctactatctgtaagcaaaagagacataggccaagttatccttgtaaagaactcataagaatttcctgacttacctggctgatgcttcctttggggacattgccttcatgatcatatgggtgttggagtgtttgtcatgccaaagagaatctgcatgtgtgactaataagtcagcatttcaagaggcctggctatactctgcttaaaagtgaaaaagcactggattggcaggcataacaaggagaaagtggcattgatatggtaatagtgactttttaatggtctaaggaaagattccctctattctttaactgtgcattggtggtagggtgttgtgtaggtttcttgtctgccaaggcaatgaacagatacattatggtcacttttgtggattataatagggaaaatgatgattcgaaggaaagttaaaaggtatttaataatgagaattgtattagctttcaaatatctgttttcccttcacttacttccttgttatctcttcactgggagatgtgcttccatggctttcatcttttttttcccctcttttaaaagatatttcaaactttcttttcatacatttctcttatatattttaggcaagtagaagaaacccaatgttgtctgcatttgtgtagtttatgtgtgcccaggcctatatgactagtgttttgataacacagaatcatgatctgctttgacattccaaaattatggaggagagaaagtaccactctttgcacccttgttttcttgtaggacccttaaagactaatattaaaacatttgcccttctcaagacaattcaacaccccctcttcttcaggtaatgtctgccaccatgcccaccacttcaactcaagtataccccactgactctattcagtagagagatggcaaaagtgtgaaattgtattctcttccccctatttcagttctctttttgaagaggaaaccaaccaaccaagtttatatcttgaaattactatctgtgggatatttgcagctgagactaagtcctagtgctttcttaataaaagctatgcatgtaaatagggtcagcttttgggctgacattgcatttgaattaaaatctggcatctccacaccattgacaaatctgacagctggagcagcagtcacctcatcatatctctcagttgtgtctttcctggtttttggcatccttcctgtctaaatttttatcagatgagcacttttccttggcaagtactttaaataccttcaacttgttttatctctgaactgtaaccctttgccctcagatgtcatatctcacatgtatgactggaggatattcagaacaaattagttaagaatgcaacaccagagtgcaatttcatttggtcttctccctgccccatcctcttcccaaatattggagcttcctgttgaagagacctttatggacattgattaatttcatggaagctacttaatggtcttgcaaattggaacagttgtaagttttgattgtgacactgcagggctaactccacctgtgctaagcattcagcattgttttctttggctttgcttcattcacgataatcaaggacttgggttcattaccagcattagcaagcctcaaaggcctctcataaatccaagccaaacactgtgttaggaggttccttagattaatggcagccctggttctctgaggctgtgttgagatctgagagaaggtaatgttcactcggcttcagcatttctacttgtagttcaaagccaaacctggaggtacaggatgatctgcaggcaacaagagatagaatgtgggcctgcaaaaggtaccacctgtatacatgatgagctcttcctgcctggcacgcaaagaactttagagttttcctcaagccttttcctatgaaaactctcaggttttgtcagctgggtcaatccattgcctttccaatacacctggagcatttcttccttgatgaattaagggctgaacaaggatgcatgtcaggggtgaaaccctttgaagagtgcaaaaataaaaattggttgtttagtaagtagaaagataaatcaaaaccaatctataaaagttagattcatatctcttttcagggtcacaatttgcctttgttttctagcatcttcatcggtgcttgcaactgaaatgggtcttcttttgactcttggtctttccttagttaagggtgagggagactctttggttctccagcggacaaaagaagacagctaacaaataagtcactctttcttccatagtctatttataagccttacaagttaatgctggaaaggccaatgagaagaaaaataaaacaacagtagtagtagtagtaataagcatgatcatcatcatcatcattggccgcatttttagagaatttgctatgtaccaggcactgttgaaaagaaaaataactttactgagatataatacacattcaataaaattcattcacttgaagtataacagttcagaagtttttaatatatttacagagttgtgcaactgtcaccactatctaatcttagaacatttttgtcacccccataagctgccctatatcatgagctgtcactctccattcctcttgagcccccaacccctgtcaagtactaatctactttctctatatatgtatttgcgcattctggacatttcacataaatgcaatcatatagtgtgatcttttgtgcctggtgtctttcacgtagcatgttttcaaggttcatcatattatagcccatgtcagtacttcagttctttttagagatgaataatattctattgtctaggtacagacatgccacattttgttaattaccatcagctgatgaatattttgactagaattcaggcattatacttttatttttaacctttcattttgaattaatttcacactgttgaaaaattagtaaaattatttcttatacacccttctcccagatttcccagttattaacagcttatataatcacagtacaatgatcaaacatcgatacaatactattatctcatctaaagaccttattcaaatttctccctctgttgtactaacattctttttctagcacaggatccaacccaggatcacatattgcatttaattatcatgtctccttagtctttttaaatctggaacatttcatcattttttaactttgagactttacatttttaactttaaatatatattatttttatgttatatattttttagaaatagggtctcactctgtaacctagactgagggcactggcatgattgtagcttactacagccccaaactccttggttcaagtgatcctcctgcctcagccttctgagtagctaggactacaggcatgtgatactgtacctggctaatatttaagatttttttgtttagagacaggattttgttttgttgccaaggctgatatcaaactcctggctttaagcaatccttctgtcccagcctcccaaaatgctggaattacaagtatcagccactgggcctggccttagttttatattttaaaagctaagcacgcttactgcagaagaatatataaaacatgtaagacagaatgaatagaaatcacccttatttcattaccattagatggtcactattgacaatttgatctatttctgtccttctattcatattattgaaaatataatttatattctcttttaaaccagcattatatcatgaccattttccatgcattaagaactcttaaaaaacataatagtttcataatggtccatcttgtggttaatacatactgccctccagcatatctgtgatattaaacatttaggttttctctggtgaaacaaaatgaaattagtcaatgtgtatgaactgttttaaggttactaatttgtattgctaaaatgacttccaaaatgatgatatcaatataaattcccttaggactctgtgaaagcctgtttcaccacaccatcctcagcactggggaaattcatctttttccaatgtttgaaaaattaaattccactgtgcctttagtttgcatttccttattagtgatattaacttttaaaaacagttatcaatttgtgtattttctttggtgaattgtctctttgtatgcaaaatataattttttaattataaaagaaatcaaggaaaaggtatgctttacacactatgcttattttctgcctttttttaaaaaaaaaataaaagtaacttcaacatttattttagattcagaggggtacatgtgcaggcttgttacatgggtctattgcgtgatgctgaggtttgggatatggatgatcccatcatgtaggtagtgagcatagtacctaagaggtagtttttcagcccacactccctttctccttctcctctctagtagtctccagtgttgatcgttgtttccatttgtatgtctatgtgtactcagttcttagctcccacttataagtgaaagcatgtggtatttggttttctggtcctgcattattttgtttaggattagcctgccgctgtatccatgttgctgcaaatgacatttcattatttgtatagctgtgcagcattctaaggtgaacatataccacagtttccttattcagtctactactgatgggcacttgggttgattccatgtctttggtattgtgaatggtgcagcaatgaacattcaagtacatgtgtctttttggtagaacaatttattttcttctgggtgtatacccagtaattgggttactggttgaatggtagctccgttttatgttctttgagaaatttacagactgccttccacagtggctggactaattttcattctgacagtgtgtaagcatttgcttttctccatggcctcaccagcatatgtcattttttgactttttaatatagcaattctgactggtgtgagatggttttccattgtggttttcatttgaatttctctaatgattagtgatgatgaggattttttcatgtttgttgtatgttttcttttgagatgtgtctgttcatgtccttttcccatttttgatgggattatttctttattgcttgttgatttttttaagttccctatagattctggatattaggtctttgttggatgcatagtttgtgaatatctgctcccattctttaggtagtttgtttgctctattgatagtttcttttgttgtacagaagttctttcgtttaattagggctcacttgtctatttttgttttagttacaattgcttttggggatttagcccaaaattctttgccaaggcctctgtcatgaagagtatttcctatgttgtcttccaggatttttatagtgtgaggtcttacatttaaatctttaatccattttgagttaattttttacatgtggtgaagggtagtggtccagcttcaatcttctgtatatggctagccagttatcccagcatcatttattgaaaagggagtccttttcccattgcctatttttgtcagccatgtcaaaaatcagatggttgtagttttgccactttatttctgtgttttcttttctcttccatttgtctatgtgtatgttttcataccagtagcaagctgttttgggtactgtggctttacaatatagattaaggtctggtagtgtggtgcctccagttttgttctttttgcttaggattgttttggctatttgagctctttttttgtttcatatgaattttaaaatagtttcttctaattctgtgaagaatgacattggcagtttgatagaagtaaccttgaatctataaatttctttgggcagtatggccatttttatattgcttcttctaatccatgaccatggaatgtttttccatttattcatgttgtctctgatttctttcaacagtgttttggagttctccttgtggagatatttcaccctcttggttagctgtgttcctaagtattttaatttctttgtagtgattgtaagtgggattgttttcttgatttcactctcagcctggacattgttggtttatagaaatgctgctgatttttgtacattgatctttgcatcctgaaactttactacaatttttccttttttttctttcttttttttttgctaaagtggtttatgaattttgggagccttttggcagagtctttagggttttctaggtatagaatcattttgtcagagaagatagtttgatttcttctttgcctatttggatgccttttatttctttctcttgactgattgctctggctagggcttccaatactattttgaataggagtggggagagtggacatatttgtcttgttacagttctcccagggaataatgctttcagcttttgtctcttcagtatgacattggctatgggtttgtcatagatggctcttattattttgaagtatgttcttttaacacatagtctgttgagtgtttttatcatgaagggatgttggattttatctaaagctttttctgcatctattgagatgatcctatggcttttggttttaattctgtttatgtgatggatcacatttattgatttgtatatattgaaccaacctcacatcacaggaataaagcctatttgatcttggcaaattaactttttaatgttgattcaccaagatcaagtagaatttattctggagcctacggactggcgctgacattgtagaatgagtaagggaggagcccctcatccctgattttttagaatagtttcagtaggattggtacccatttttctttgcatgtctggtaaaatttggctgagaatctatctggtctggggctttctttgattggtagtttttttttttcaattgttgattcaattttgaatgtgttattgttccgttcaggttttcactttcttcctggatcaatcttgggagattgtatgtttccacgaatttatccatttcctgtagattttctaatttctgtgcatcaagttgttcataatagtctctgaggatcttttgtatttctgtggtatcaattgtaatgtcatctttgtcacttctgattttgcttatttagatcttctgggtttttttcattattagtctagctagagatctatgaattttgtttattcttttgaagatctaggtcttggtttcattgatcttttgcatggatttttgcatttcaatttcatttagttgttctctaattttaattatttatttctctgttatctttggggttggttcttttttttttttaagttcctctaagtatggtgttggattgttaacttgaggtctttctaacttcttgatgaaggtgtttagcactataaactatctccttttaacactgttttagctgcatcccaaagattttggtaagttgtgtctatattttcattaatttcaaagaattttttttatttctgccttaattattttgttcatgcaagagttactgaggagcaagttgtttaatttctctgtatttgtatagttttgagagatcttcttggtattgatttccatttttattatggtgtggtccaagagtgtgcacagtatgatatcaacttttttgaatttattgagacttccttaatgattgagcatatggttgatattagaatatgttccatgtgcagatgagaagaatatatattctgttgcagttgggtatagtattctttaaatgtctattgggtccaattggctgagtgtcatgtttaaatccataatttttttgttcatttctgcctcaatgatatgtcagtaaagtctgtcagtggagtgttgaagttttccattattattgtgtgggtcttcttgtagttgttttatgaatctggatgctccaatgttgggtacatatatgtttatgatagttaaatcttcttgttaaatcaaaacctttcattatgtaatgtccttctttctgctttttgtttgttgatgttttaaagtttgttttatctgatataagaatagtgagtagtgctcttttttccttcctgtttgcacggtagatcctgctacttttagcctgtggatgtcattacgtatgagatggatctctaaatgatggcagagagtttgatcttgtctttttatccagttggccactctatgccttttaagtggggtgtttagactgtttacattcagggttattattgatatctgagattttgaccctgtcatcatattgttagctggttgttttgtagaattgattgtgtagtttctttatagtgtctgtgggctatgtgcttaagtgtgtttttgtggtagcaggtatcattcttttgtttccatgtatagcactctgttaaggacctcttgtaaggttggtctagtggtaataaattccctcagtatttgcttgtctgagaaggattttatttctcttttgcttttgaagcttagtttggcagaatatgaaactgttggtatgaaatttctttttttttttttaaggatactggaaacaggctccctatgtcttctgccttgtaagaattctgctgagaagtccactgctagcttgatgggattccctttgtaaatgaacggatccttctctctagctacctttatgatgttctcttttgcatttaccttgatgattctggtaactatgttccttggggattgtcatcttgtatagtattttgcaggggttcttggtatttcttgaatttgcatgccagcctgtctagcaagattggagaaatgttcatggattaataataatgtcaatgacttgtaggtttggtctctttatataaccatatatttctcagatgttttgttcattttttaaaaattattttttaaaaaatttttatctgagtttactcaaataactggtcttcaagctctgagattctttctgtggcttggtctattctgctgttaatgcttcttattgtattatgaaattctcatagtgaattttttcaattccagaagttcagtttggttcttttttgaaatggctattttgtcttttagctcttggatcattttactggattccgtgaatttctggattgggtttgaatgttcttcttgatctcaatgagcttccttgccatccacaatgaattctatgtgtgtcattttagtcatttcaaactgattggataccattgcttatgagctagggtgcttatttggagggaaaggaacactctgactttttgaattctcaggtttcttgcatggattctttctcatttgagaggactggtgtttctttagctgtagcataagttgagtataatcaattggctttgtttctgggcgctttcagggtgccaatgctctgtacaggatctgtacttaaagctggatttttgccccttctctaggagctatttggggccaggaactgtccctgacatttgacaaatctatgcagggttcccagcttcctccctcttcagccttggggtctgcctcacctctcttttgactcttggtattttctctttgaaaatctgttcaaaatatgttagcttacccaatttttggtctttcttggtgacagcagtgcttcctgactgtgtccagttggacgtcttgtccagaacccctggtgattatttttaaaatgaagctttgttgtagcactcttggccaatttaatataatgtccttttttccctttataagttagccttcatgtcttcagtctacacttagacattcaggtcctaaatattacctttgcatattcagtatacaccagctccattcatagctgaacacttcaccaggttcctaattcctgaaagaacagaagccatatctgtatcccaggaggctggggcgacaagatggtggatctccccttattttcttttcatacattttttcaccaaaatttgacttgtatttgcagctatctgctatcaaacactagaagttattctttctcactgtatttttgtagctatcaaccaacttttcttcatccctctctcccctctacttttctcaacctctgttaaccactattctactttttagctccatggcataagtattttttagttcccacatatgaattataacatacaatatttttctttttgtgcctggcttatttaacataatatcctccagttccatctatgttgctgcagaatgacaggatttcattctttttatggctgaatattccattgtgcgtatataacacattatccatttatctgttggtggacatttagcttgattccatatcttggctatggtgaatagtgttgcaacaaatataggagtacagatacctctgcaatatatttatttactttcttttggacatatacccagcagtgggatttctggatcatatggtagttctactgtttataaattttttgtactggctgtgctaattctaattcccaccgtaagtatatgaatgttcccctttctctgcatctttaccagcatctgttattttgtgtctttttgataatagccattttaactgaggtgagttaataattcattgtagttttgatttgcagttccttgatgattagcaatgttgaacattttttttttcatatacctattggccatttgtatgtcttcttttgagaaatgtctattcagatcttttgcccattaaaaaaaaatcagattgttattaatattatttttgctattgatttccttatgtattttggttgttaatcccttggcacatgtataatttgcacatattttctcctattttgtaggttatgcattcatttgtttattgtttttgttttttgctatgcaaaactttttagtgtgatgtaatcctatttgtctctgagtcttcttatccttatcttagaaatgaatctaatactatttgtctgtctgtgttgttggctgtgcttttgaggtcttactcaaaaaatatttgctaagattgttatcctaaagtatttcctcattgttttcccctagtagtttcatagttttggttcttatattaagtttttaatccatttttattttatttttgtatgggctaagagataggggtctaattttattgttctgcatatgggtgtccagtttttcccacaccaatcattgaagagactatcctttccccagtgtatgttcttgatgcctctgtcaaaaatgagttggctataaatgcctgggtttatttctgggttctctatttttttccattggtctatgtatctgtttttgtgccagtaccatgtaactctggttactatagctttatagtacattttcaaatcaggcagtgtaatgcctccagctttgttctttttgctcaagactgctttgggtattccaggagaatgacatttttgaagaatactagccaattattttatgcaatatccctcaatttagaatttttagatgcttcttcatgagtaaatttagatgatgcatatttggccagaatagcatactgcatccttctcagtgcattgtatcaggaggtatgtgatatcaatttctcccagttgtggtgataccagctttgatcacttggttaaggggaaatctgtcaggtttctgaaaagagttcctgttttcctttgtatttaataagtatcttgtggggagatattttgagactgtgtaagtatcctgttccacatgataatctccttcactaagtttagcacctgttggtacttacctacaacagttattaccgtggtgtttgccaaatggtgattttctactctcatcacttcttatacatttatttctccaaatactgctgtgagaaagagtttaccatgctctcctatttatatatttacttatttataacattgtggtctcatggattcttactttattctatgggttataatccattactgttgttatttatgttgttgatcaaactgttttaagatttgcccattgggagactgttccatttgactcttgactttttttttttacatgcccttgttatttattgtgctattccttattttcttttataagttgatcttatacttttctttgtctggaattagccatttctccaaggaaatctgatgacttttactggaggaaggtacttagaaatcatgatctggaccgtgttctattttatcttctccctatgagttaggcacaattagcaatcctacatttttaatgaaataactgagaactcaagaagttaaataatacatctgatgccacacaactgaaggtgatagaactactatttgaacccagtctaaagtttggtctccagtgtccatacttaaatttaatttctctctgggattggaaagcttttccagtgtctctgagtcttcttttccttgtcttagcaatgagtctagtactatttgcctctcagtgttgttgtgatggctaaatgaaaggacacatcggaaattgtctatacattatttgttccatagtggatactcaaatatacgttgaatttgagctatattcactcagtattcataaacacccactttgttcgcagcactgaggtagaaaatatgcaggtacatgcatatttcctggtaagagctcatatttcctggcaataatttctaatgtcactccttcctgtgcatccaatataggataccagaatcctttccaagatagaatttaggcagacactactgaacaaatgaaacgtatttgctgccctagacatgagtgatgaagggttgggagaacaggcgtgactctaccaaaaacaggcagataatccaggctcacatttcaaaacaccttgcaacttaagtttctaaccattttctaacagtccttgaaattatgctaatataaggacttccaggcaacatagaagactgggtgtacatgctaatacacaaatgacatagaggatcagcatcccaacttcttggaatatgccagacagtaataaatgtaacagccacaaaattccagccttgcttaatttggggaaatgagaatcagtttgttcttcccctgctggcactgaacagtggtttgcaggatcactgcgtgggaaagatctgacagtagagatctgagaggctgtctgtgtgaaggctgaatttcatgaactatctcattgttgggatggttccctttcagcctcgtggtaagtacaacactcaggtcactgtaagcgcagggcaggcaagcttaagccacaatgagtgaaaatatgtgtgtattgggttgggggaagggattttagtctggattatctgaagctcagactttaagctgagagcctgggctgccaagcaggtatatgtaaaggacagctcaaagctgaggtttaaaactagtatgctccaaccaggctgtgaaagtaactaaagtagctgagtgcctcagatcacctaatgtttatttttgttttgttttattttttgtttttccatttttgttgttgtttgtttgttgttttttctgagacagagtctggctttgttgtctaggctggagtggagtggcacgatctcggctcactgcaacctccgcctcccggattcaagcgattctcctgcctcaacctcctgagtagctgagactacaagcgtgtgccaccacgcttggctaatttttgtatttttagtagaaacggggtttcaccaagttagccaggctgttctcgaactcctgacctcagggaatccacccaccttggcctcccaaagtgctgggattacaggcgtgagccaccacccccagccgccctaatgttttacaagtttgagacataaacctgtggcatgcttttttttgggaacatgattcagaaatcactttttcctatcaaaaagcagaaaaatgagccatgatgattggaatccttcctgatcttataggtagactgggaaagcatagctgggaagagcacagacagggagatcagaagaacctcggactgccacaaaatgtgtaatgccaggtaacctaagccagccagtcaatttatctggggatcacttcttcacttgtacagcgaacaagatgaattagataattgtataattccttggagctctgaaattctactgcacaaatagatgcctcgtgatcgctgttgagatgaggtcttccagagcctgtgatcccagatgtgattgatcatcttgccagagctttagccaccttctcacctgttagacaattcctgcccctgtgtctctactgtatcgcctttcacagctcatatgctgcacctatgcagtcttcttcagggtaagctgtgtgaagtttaagtttcttataactattaaacttcatcttgcaaaggattcttcctttgaagaccaggttgcaaagtaaataaaaatgaaactacacttgataaagcagggatgggaagtctgtaaccttatccttattgtgggatatttgaattgtctctattttttgctatttgtcttcaagttgtcctaagaaggtgggatcaatatcccccatcctattggttcagagtcaagactaatgatgccacacatgcatgaagagtgtatggaaacatttattatttacatcatgaggctttctagggagagcagaggaaacacccaagcttttctattagatttgagtgaggaaggcacaagtggctttggtttctactgtgtgtgggtgtgggctggcattagggctcccgtgtacaggctcaagtttacgtggtttgacttctatgctagtgccaaggaaaggagggcctgggatttttttttaattggcttgctcatgtgtgaggggaaaagagaagtgggagaaaaggggtctgaaagctgtcagcagccagataatggagtcagatgatcttacatattagaaaattccaaggaaaccactaaaaacctattagaactaatacatgagttagcaagattgcaagatacaagatcaatatgtgaaaaatcaattttctttctatacatttacaaagaactatccaaaaatgaaattaagagaataatttcattcacaatagtatataaatatattaaatatataggaataaatttaatataatgtgtaaaacttacatggtgaaaactcaaaacattaaaaaattaaagaagagcaaaataatagaaagtccatattcatgaattaaaagtcttaatattatcaaaatgacaatatttctcaaatttatctagattcagcacaattcctatcaaaatctcagctggcttttttttttttgcagaaattgaccagctaattttaaaattcatattgaaaagcaagggatccagaataacaaaaataatcttgaaaaagaagacaaagtaggatgacttgctggtatggtttggttctgtgtccccacacaggtctcctcttaaattgtaatcttgtaattcccatatgttatgggagggacccagtgggagatgatttgaatcatggggatagtttcgcccatactgttctcgtggtagtgaataagtctcacgagatctgatggttttatcaggggtttctgcttttgcatcttcctcattttctcctgctgccactatgtaagaagtgcctttcatctcctgccatgattctgaggcctccccagccatgtgcaactgtaagtccaattaaacctctttttcttcccagtatcgggtatgtctttatcagcagtgtgaaaacggactaatacactcacacttcccaatttcaaaacttcaaaaacagttatgaagaaagtatagtactagtatgaggataaatgtatagatcaatgtaataaagttaaaaattcagaaataaagccttacatttaaggtcaattaatttttgacagtggtgccaagacatttcaatgggaaaagaacaaccttttcgacaaatgatgatgaggcaacagaatatgcctgtactcataaataaagtttcaccccttccttatacaatatacaaaaattaactcaaaatggatcatagactaaatgtaacagctaaaatgataaaatttttagaagaaaacataggagtaagtcttcatgaccttgggctaaacttcttagcaatgataccaaaagcaaagcaaccaaagaaaaaatagtgacccttagaatcaccattaaataggaagatagtaccccttgtattatgggccttaatttctataggccttgtttttttaatctgtattgggacatattaactattttaaccagagatggattattctattttaggttcgtggtattccatttttttaagctgattttcaatgtcaaagatttaattttatttcaatttattactcattgggttaggtcatatctactacgtgatatatgttaaggcaacaggtgctaaggccatggagaatttagagaaggaaagtgtaccagtagtcaaggtgaggcatacctgtttgccctctactttg

SEQ ID NO: 338 - DNA, 10237 bp, Homo sapiens
ctctcagtatcaggaataaagattctcctttttaaccatattttcaatcaaattaaaattatcaatcctagaaatatatgtgtactatatagactgaatgtttatgccctcccctcccaaattcatatgtttaaaccttatacctggcatgatggtgtttagagcagggccttgaggagctcatcaggtcttgggggcagaaccttcgtaaatgggattaataccctgacaaaagaagccccagagatctctctcatcccttctgccatgtgaggatacaaagagaaaatggccatttacgtacaaggaagcaggccctcaccagatacctaatctactagtgaagtgatttggggctcaaggtcccagcctccaggacttcgagaaataattttttgttgtttaaaagccacccagttatggcattctgttatagtagcccaaacagactaagacaggaaactgttacccagaactaggagtgctgctatcccaaacacctaacaatgtccaggtgactttgaaactgggcaatgggtagaggctagaagtgtttggaagtgcctgctagaaaaagcctacattgctgtaaagaacctttaaaagtgattctgggtagaaatctcagaaaaaaagaagagatgcagagaaagcctcaatcttagaaaatacctatgtaatcctgaaattaggaatatgaatggcaaaggtcattctgatgaggtctcagacagaaataaggaacatattactagacagtggaggaaggtaatctttgttataaagtggcagataacttggatgaatggattttgtgtttcagtgctttgtggaaggtagaatttgtgagcaaggcaatcggatactaggctgaggaaatctttaaacaaagcactgaaggagtggcttggctcctcctgactgcttatagttaagtgtgaaagaaatgaggtaacatcagcaaaatagtggaataagagctcacctaattgtatctcccacagcaacaataatttttcagccacccacagacaaaatagcctttgtgggaaccttggattaatttaggaggttgtgaaattccaggggagcccgatattcagtagggccattttgagagggccaactcatgcccagatggcagacttggtgatcatggttctgactgcagacctggaaatggctttatcctcttgtggactcagctatggccccattttctcttggtcttattataaaaatcatcagcaaagaggcccagaaaaattcatgcacactagtacattggcagacaggccagccaaagttgagtctggatgtagaccctgaaacagctctgaaacccagttttagacactcttagctgtggacagagaggaggccttctcatccacgaacgcagagggagaaatgcctgcctgagtccccagggtaggcttgccaaactcagccctacagcagatcttgaaatggcactaaaactcagctacaacccctctgagctgttggttgtgagcaatcctacatgcccaggcatctggagggaaacacacttatctatgatcctagagacaggactgcagaccttagtctcagctgtatatcctgaagcatccttgcatgtactgggctgtccttgcattcctataaagaagtacctgagactggataatttataaagaaaagatgtttaattggctcactgtgctgcaggctttacagaaagcatggtgctggcatctgcttggcttctggtgaagcctcaaggagctttcaatcatggtagaaggcaaaggaggaacaggcatatcacatggcaaaagcagaagcaaacaagagagtagtggtgaggtgccacacacttttaaatgaccagatctcaaaagaactcacccactaccatgaagacagcaccaagccatcaggaatctacccttatgactcaaatacctcccaccaggccccacctcaaacattggggattacaattcaacatgagattcaggcaggaagaaaaatccacactatatcattccaccccagtccctctcaaatctcatgtccttctcatattgcaaaatatgatcatgccttcacaacagtccccccgtcttaactcattctagcatcaactcaaaagtccaaaacccaaagtcttatctgagacaaaggaaatcccttctacttatgagcctgtaacataaaaaaaacaaatttgttacttccaagattcaatgagtgtataggcattggataaacattctcattccaaaagggagaagtcagccaaaagaaaggggctacaggctttatgcaagtttgaaaccagcaaggcagtcattaaatcttaaagctccaaaataatcttctttcactccttgtcccacatccatgggggtgatggtgcaacaggtgagcttccaaaaccctgggcagctctacccttgtggctttgcagggttcagcctgaggctgctctcacagtgtgttgagtgcctgagacttttccaggggcatggtgcaagctgccagtggatcaaccattctggggtctgatgggtggtagcccccttctcacagatccactaggcagtgccacagtgaggactccgtggggggcctctaaccacagatttcccctctgtgctgccctagtagaggttctctgtgagggttacacccctgcagcaggcttctacctgggcacctaggctttctcacacatcctccaaaatctagacggaggccaagcctcctttactcatacactctgtgaatctgcaggcttaacactacatggaagccaccaaggcgtatgacttgcaccctttgaagcagtagcctgagctatatctggggccctctgagccaaggatggagccagaggggctgggatgtggggagcagcatcccaatggtgtggagtacagtgaggccctgggccctgcccctgaaaccattctttccacttagacctctgggcctatgatgagaagggctgccacaaacctctctgaaataccttttccccattctctgggatattaacacttggctcccttttagttatgcaaatttctctagcaagcggttgctacgtagcctgcttgaattcctctcctgagaaagcttatcctttctgtgtcacgtggctaggctgcagattttctaaacttttacattctgtttcctgcttaaatataacatccaactttaagtcatttctttgctcctgcatctgataggtaggctattagaagcagccaggacatatcttgaatactttgctgcttagaaatttcttctgccagataccctaggtcatcaccctcaattccaaacttccacagatctttaggacatagatcacaatacagccaacttcttcagcaaggtataacaagggttcagtttctttgcttcagttcccaaaagctcctaatttccatctgaaacctcggcagcctgaacttcactgtccatatcactaacagcattttggtcacaaccatttaaatagtctgtaggaagttccaaactgtccctcatctttcttttttattctaagccctccagattttttcaacctctgctagttacccagtttcaaagttgcttctagattttcaggtatctttatagcaatacccaactcattagtaccgattttctatattaggccattcttatattgctataaagaaatacctaagacaaggtaatttataaataaaaaaggtttaattggctcacagttcttcatgcttaatagaaagtatggtgcaggcatttgcccagcttccggtgaagcctcagggagctttcaatcatggtggaaggcaaagggggaataggcatgtcacatggcaaacacaagagcaagctagagagttggggaggaggggctacagacttttaaatgactagatctcatgagaactcactcattatcacaaagatagcatcaagccatgagggatccaccctcataaccaaaacctcccaccaactccccccacccccaccaccaccactgcattggggattacaattcaacgtgagatttcagtggtgacaaatatccaaactatatcattgtgacttggttttagtccctttaagccatggctggggtcaggactgcctgcccaggtacatattcagtgacctaggaggagccctcccagggacctggaggaagtcactcccagttgtgcaactggtaacaggcctgctgtctgcataccttcaagtggttcttcatcccagtgccagccctactggccaaggtactaatggtatcttgtccaccaagaggtcagacaaaagccatgcctaccagagacactggtaacaggcctgccaactgtgggtcccctcgtggactcatgtgatccagctcaatcgccacaagactgcaatcctataggcaatcccatcagctcagagtctcaacatgaggaggcttttcctgccaaaactagtctgtaaagactagaagcggtatttgctcctgcaaatgcatagccatcaatgcaaggctacagcgataacaacaaatcaggcaaacatgacaccaccaaaggaaactatgaacattctataattgactccaaagaaatggagatctacaaatttccttaaaaaagaataaaaaataatcatcttaagaagctcaatgaaatgtaagaaaacatagacaatttgatgaaatcagaacaatgcatgaacaaaataaaaagtttaataaagaaatataaaccataataaagaatcaaacagaaatcctagagctgaaggataaaatgacaatattaaaaaattcaacagacaactttaacagcagactccactatgcagaagaaataattagtgaattcaaagacaggccatttgaaattagccaagtccaggaccaaaaagataaaaagatttttaaaagttgaagaaagcattagggacctatgggacaaaaatcaattgtacaaatatataaactgtgtgatttctggaaggagaaaggagagagagtaagagacagagaattatttaaagaaacacttgctgaaaactatccagacctttggagaaatatgagtattcagattcatgaaatttaaaggatcccaactaagatcaacctaaagaagaaactccaggacacattataaatgaattattaaaagtcaaagacaaagaaaatcctgaaagcagcaagagaaaagagacttgtcacatataagaaaatctgcataaggttaacagcagacatctcaacagaagcctttcaggccaaaatggagtaaggtaatatattcaaaatgtcaaaagaaaaactgccaactaacaatattatactcagcaactgtaatgctaaagggattctttcaatttgaaagaaaagagttatttctgtttcatgtaacaacatgaaaacatattaaagtataaagctcactggtaagcttaagtatgtagtcaaattcggaatatcctaatattataatggtggcttgcaaatcacttttaaccctagtataaaagttaaaaagcataaaaaaaaactatagctataataatttgttaatgaacacacaatataaaaagatgaaaatgtgctatcaattttataaaaaaatgggaaatggggcagtacaaacatagagttcttgtatgcaaaataaggtaatttgttatcagctaaactaaaatattataattttaggatgttttacgtatgttccatggtaaggtaaccagaaaggaagaaatctctagtagatacacaaaccataaaaagaaagaaaacaaagcataccaatacaaaaattcaacaaatcacaaaggaaaacagcaagagtggaagaaagaaacaaaggaactacaaaattgtagacaattaaaaaaatgtcaatagtaaatccttatctatcaacaataactttaaatgtaaatgaatgtaactctctaaagatacagagtgtctgaatgggttaaaaaaaatcaacaatatgctacctaaaatagactcacttaagccttaaggacaaacatagactgaaagtaaaaaaatagaaaaaggtattctatgaaaaatggcaaccaaaagagagcatgggtggctatacttatatcagacaacatagattttcagtcaaaatctgttagaagagacaaaaaaggtagctacatgatgataacaattgtaaatatatatgcactcaacactgacgcacctaaacatataaggcaaaaatttcagaaatgaagggagaaatagacagcaatcaaataataataggggacttcaataacccatttttcaacaatggatagatcatccagagagaaaattaataaagaagcagtaggcttgaacaacactataaaacaaatgaacttaccagacttacagcaaacattccatccaacagcaacaactacacgttcttctcaaatgcacatgaactttctccatgatagattatactttgggccacaaaacaattcttaacaaatttgagaagactgaaatcaacccacatatattttctgaccacaatggtataaaactataaatcgatatgagaaataattatgaaaaactcaccaatatgtggaaattaaacaacatactgttgaacaatcaatggttcaaagaaaaaaatcaaaatagaaatgaaaagcatttgagacaaatgaaaataaaatacaacataccaaaatttctgagatgcagcaaaaccagtgctgagagaactatatagtgataaatgccaacatcaaaatgaagaaaaaggccaggcgcggtgccttgcatctgtaatcccagcactttgggaggctgaggcagatggatcacgaggtcaagaggtcaagaccatcatcctggccaacatggtgaaatcctgtctctactaaaaatacaaaaattagcccggcaaggtggtgcgtgcctgtagtcccagctacttgggaggctgaggcaggagaatcgcttgaacccgggaggcggaggttgcagtgagcggagatcacaccactgcactccagcctgggtaacagggcaagactccatctcaaaaaaaaaaaaaaaaaaaggaaaagaaagaactgaaacaacctattgttacacctcaaggaactaggaaaataataaactaggcccaaagtcagcagaaagaaagacataataaagaccagacctgaagtaaatgaaatagagactaaaaagaaaagatcaacaaaactaagagttggtttttttgaaaagatataaatagacaaagctttaactaggttaaccagaaaataaagagagcccaaataaataaaattaaaattataaaagcgacccaaaactggtaatacaaaaatacaaaggatcataagagactacttgagtacagttattcaccaacaaattggataacttagaggaaataaataaattcctagaaacattccacctactaagatgaataatgaataactaggtaatttgaatagacaaataacaagtgagaagattgaatcagtaatcaaaaacctcccaacaaaaaaattccagggtcaattataccaaacgtttaaataattaatgcccatccttctcaaagtctttcaaaaaattaaagaggagaggacatctccaaactaattttatgaggccagcataaccttcaaactaaagccaggtaaggataataccagaaaataaattacagtccagaaaccttgatgaacaaagatagatgcaaaaatcctcaacaaaatactagtgaaacaaactcagaagcacattaaaaggatcatacaccatgtcaaatcagaagaatgattcaacatatgcaaatcaataaatgtgatgcactactttaaaagaacaaaggacaaaaatcatagatagtctcaacatatgcagaaaaagcatctgacaaaattcaacaatcactataaaaactctcaacaaattagatgtagaaggaatttacttcaacatgttaaaggccatacatgacaggcttatgggtagtataatactcaatggtgaaaaaatttaaagcttttcctcaagatcaggaataagacaagcatacacactctcatcacttctactcaacatagtaatggaagtcctagccagaaacattgtgtgataataagaaagaaaatgcatccaaattggaaatgaaaaagttaaattgtatgtttgcaggtgtcataatattatatacagaaaaacttaaacattctaccaaaaacctgtcagaactaataaataaattcagtaaagttacaggaaataatatcgacatacacatgtcagttgcatttctatcacctaacaaacaactatatccaaattgagatacagaaattgagatcccatttacaacagcatcaaaaataagatacttaagataaatttggccaaacaggtgaaagatacctacactaaaaactataaaacactgatgaaggatatcaaagaagacataaactaataaaaacatatcccgtgtttatggattggaagaattaatattgtttaaacgtccatattgccaaaagtgatctacaaagtcagtgcaatctctgtcaacattccaatgacatttttcatgaaaacagaaaaaaaaaaaatcctaaagttcatatggaactacaaaagacctgaaatagccaaagcaattttgaagaaaaagaacaaagctagaggcatcacactgcctgattttaaagtatattacaaagtcatgtgatcaaaactgtacggtattggcataaaaacagagatactaaccaatggaacaaaatagagatctcagaaataagcacacacatatgtcgtcaactaatctttgatgagagtgccaagaatatacggtgaggggaaaaaatcacttcaataaatgatgcttggaaaacaatatccatacgcagaaaaattaaattcttttacttaaaccatatataaaaattaactcaaaatggattaaaaacttcaatgtaagatctgaaaccgtaaaactcatagaagaaaacatagtttaaaagctccctgacattggctttggcaatgattttttggatatgacaacaaaagaacaggcaataaaagcaaacacaaacaaatgggagtacataaaaccaaaaagcttctgcacaacaaagaaaataacctacctagtgaaaaggcagtccatggaatgagagagaatgtttgcaagctagctttataatgaagggttaatatccaaaatgtttaagaaattcatacaactcaatagcaaaaaagacaaatccctgattaaaaagtgcacaaagggcctaagtagacatttttattcaaaggaaacatataaatggctatttgtatgttttctttgaaaaatatgaataggtgctcaacatcactaataatcagaaaaatgaaaaatgaaaccacaatgagataccacttcatacatagtaggatggccattatcaaaaagacaaaaggtaattattggtgaaggtgggaaaaaatgaaacgcttgtccactgttgattggaatgtaaattggtatagccattatgtaagacagtaggaaggctcttaaaaaattaaaagtagaacaacattatatgatccagcaatctcgccctgggactatctccaaaggaaatgaaataagcatcttcaagagataccagaatctccatattcattgcagcattattcacaatagctaagacatggaattaatcaaagtgtccattgctggataaatggataaagaaaattatatatacacacacatacatatataatgtattatacataatgtacacacacacatacatacgtacatacacaagcaatggaacattatacagctttaaaaaggaaatcctgccatatataaaaacatggatgaacttggaggacattatgctaagtgaagtaagccagacacataagggcaaataccgtataatttcacttatatgtagaatcacactcatagaaacaggaagttaccagggactaggggatgcaagaaagtgggaaatgttgatgtaagggtacaaaatatcaattttaagatgaacaaattccagggatcaagtctatggcaagggtggtaatggatttattaattaatttgttataatcattacacaaagtatacacatatcaaataatcacgttgtacacattgagtatatatgatttttatttgccaattaa

SEQ ID NO: 339 - DNA, 10347 bp, Homo sapiens
ctctcagtatcaggaataaagattctcctttttaaccatattttcaatcaaattaaaattatcaatcctagaaatatatgtgtactatatagactgaatgtttatgccctcccctcccaaattcatatgtttaaaccttatacctggcatgatggtgtttagagcagggccttgaggagctcatcaggtcttgggggcagaaccttcgtaaatgggattaataccctgacaaaagaagccccagagatctctctcatcccttctgccatgtgaggatacaaagagaaaatggccatttacgtacaaggaagcaggccctcaccagatacctaatctactagtgaagtgatttggggctcaaggtcccagcctccaggacttcgagaaataattttttgttgtttaaaagccacccagttatggcattctgttatagtagcccaaacagactaagacaggaaactgttacccagaactaggagtgctgctatcccaaacacctaacaatgtccaggtgactttgaaactgggcaatgggtagaggctagaagtgtttggaagtgcctgctagaaaaagcctacattgctgtaaagaacctttaaaagtgattctgggtagaaatctcagaaaaaaagaagagatgcagagaaagcctcaatcttagaaaatacctatgtaatcctgaaattaggaatatgaatggcaaaggtcattctgatgaggtctcagacagaaataaggaacatattactagacagtggaggaaggtaatctttgttataaagtggcagataacttggatgaatggattttgtgtttcagtgctttgtggaaggtagaatttgtgagcaaggcaatcggatactaggctgaggaaatctttaaacaaagcactgaaggagtggcttggctcctcctgactgcttatagttaagtgtgaaagaaatgaggtaacatcagcaaaatagtggaataagagctcacctaattgtatctcccacagcaacaataatttttcagccacccacagacaaaatagcctttgtgggaaccttggattaatttaggaggttgtgaaattccaggggagcccgatattcagtagggccattttgagagggccaactcatgcccagatggcagacttggtgatcatggttctgactgcagacctggaaatggctttatcctcttgtggactcagctatggccccattttctcttggtcttattataaaaatcatcagcaaagaggcccagaaaaattcatgcacactagtacattggcagacaggccagccaaagttgagtctggatgtagaccctgaaacagctctgaaacccagttttagacactcttagctgtggacagagaggaggccttctcatccacgaacgcagagggagaaatgcctgcctgagtccccagggtaggcttgccaaactcagccctacagcagatcttgaaatggcactaaaactcagctacaacccctctgagctgttggttgtgagcaatcctacatgcccaggcatctggagggaaacacacttatctatgatcctagagacaggactgcagaccttagtctcagctgtatatcctgaagcatccttgcatgtactgggctgtccttgcattcctataaagaagtacctgagactggataatttataaagaaaagatgtttaattggctcactgtgctgcaggctttacagaaagcatggtgctggcatctgcttggcttctggtgaagcctcaaggagctttcaatcatggtagaaggcaaaggaggaacaggcatatcacatggcaaaagcagaagcaaacaagagagtagtggtgaggtgccacacacttttaaatgaccagatctcaaaagaactcacccactaccatgaagacagcaccaagccatcaggaatctacccttatgactcaaatacctcccaccaggccccacctcaaacattggggattacaattcaacatgagattcaggcaggaagaaaaatccacactatatcattccaccccagtccctctcaaatctcatgtccttctcatattgcaaaatatgatcatgccttcacaacagtccccccgtcttaactcattctagcatcaactcaaaagtccaaaacccaaagtcttatctgagacaaaggaaatcccttctacttatgagcctgtaacataaaaaaaacaaatttgttacttccaagattcaatgagtgtataggcattggataaacattctcattccaaaagggagaagtcagccaaaagaaaggggctacaggctttatgcaagtttgaaaccagcaaggcagtcattaaatcttaaagctccaaaataatcttctttcactccttgtcccacatccatgggggtgatggtgcaacaggtgagcttccaaaaccctgggcagctctacccttgtggctttgcagggttcagcctgaggctgctctcacagtgtgttgagtgcctgagacttttccaggggcatggtgcaagctgccagtggatcaaccattctggggtctgatgggtggtagcccccttctcacagatccactaggcagtgccacagtgaggactccgtggggggcctctaaccacagatttcccctctgtgctgccctagtagaggttctctgtgagggttacacccctgcagcaggcttctacctgggcacctaggctttctcacacatcctccaaaatctagacggaggccaagcctcctttactcatacactctgtgaatctgcaggcttaacactacatggaagccaccaaggcgtatgacttgcaccctttgaagcagtagcctgagctatatctggggccctctgagccaaggatggagccagaggggctgggatgtggggagcagcatcccaatggtgtggagtacagtgaggccctgggccctgcccctgaaaccattctttccacttagacctctgggcctatgatgagaagggctgccacaaacctctctgaaataccttttccccattctctgggatattaacacttggctcccttttagttatgcaaatttctctagcaagcggttgctacgtagcctgcttgaattcctctcctgagaaagcttatcctttctgtgtcacgtggctaggctgcagattttctaaacttttacattctgtttcctgcttaaatataacatccaactttaagtcatttctttgctcctgcatctgataggtaggctattagaagcagccaggacatatcttgaatactttgctgcttagaaatttcttctgccagataccctaggtcatcaccctcaattccaaacttccacagatctttaggacatagatcacaatacagccaacttcttcagcaaggtataacaagggttcagtttctttgcttcagttcccaaaagctcctaatttccatctgaaacctcggcagcctgaacttcactgtccatatcactaacagcattttggtcacaaccatttaaatagtctgtaggaagttccaaactgtccctcatctttcttttttattctaagccctccagattttttcaacctctgctagttacccagtttcaaagttgcttctagattttcaggtatctttatagcaatacccaactcattagtaccgattttctatattaggccattcttatattgctataaagaaatacctaagacaaggtaatttataaataaaaaaggtttaattggctcacagttcttcatgcttaatagaaagtatggtgcaggcatttgcccagcttccggtgaagcctcagggagctttcaatcatggtggaaggcaaagggggaataggcatgtcacatggcaaacacaagagcaagctagagagttggggaggaggggctacagacttttaaatgactagatctcatgagaactcactcattatcacaaagatagcatcaagccatgagggatccaccctcataaccaaaacctcccaccaactccccccacccccaccaccaccactgcattggggattacaattcaacgtgagatttcagtggtgacaaatatccaaactatatcattgtgacttggttttagtccctttaagccatggctggggtcaggactgcctgcccaggtacatattcagtgacctaggaggagccctcccagggacctggaggaagtcactcccagttgtgcaactggtaacaggcctgctgtctgcataccttcaagtggttcttcatcccagtgccagccctactggccaaggtactaatggtatcttgtccaccaagaggtcagacaaaagccatgcctaccagagacactggtaacaggcctgccaactgtgggtcccctcgtggactcatgtgatccagctcaatcgccacaagactgcaatcctataggcaatcccatcagctcagagtctcaacatgaggaggcttttcctgccaaaactagtctgtaaagactagaagcggtatttgctcctgcaaatgcatagccatcaatgcaaggctacagcgataacaacaaatcaggcaaacatgacaccaccaaaggaaactatgaacattctataattgactccaaagaaatggagatctacaaatttccttaaaaaagaataaaaaataatcatcttaagaagctcaatgaaatgtaagaaaacatagacaatttgatgaaatcagaacaatgcatgaacaaaataaaaagtttaataaagaaatataaaccataataaagaatcaaacagaaatcctagagctgaaggataaaatgacaatattaaaaaattcaacagacaactttaacagcagactccactatgcagaagaaataattagtgaattcaaagacaggccatttgaaattagccaagtccaggaccaaaaagataaaaagatttttaaaagttgaagaaagcattagggacctatgggacaaaaatcaattgtacaaatatataaactgtgtgatttctggaaggagaaaggagagagagtaagagacagagaattatttaaagaaacacttgctgaaaactatccagacctttggagaaatatgagtattcagattcatgaaatttaaaggatcccaactaagatcaacctaaagaagaaactccaggacacattataaatgaattattaaaagtcaaagacaaagaaaatcctgaaagcagcaagagaaaagagacttgtcacatataagaaaatctgcataaggttaacagcagacatctcaacagaagcctttcaggccaaaatggagtaaggtaatatattcaaaatgtcaaaagaaaaactgccaactaacaatattatactcagcaactgtaatgctaaagggattctttcaatttgaaagaaaagagttatttctgtttcatgtaacaacatgaaaacatattaaagtataaagctcactggtaagcttaagtatgtagtcaaattcggaatatcctaatattataatggtggcttgcaaatcacttttaaccctagtataaaagttaaaaagcataaaaaaaaactatagctataataatttgttaatgaacacacaatataaaaagatgaaaatgtgctatcaattttataaaaaaatgggaaatggggcagtacaaacatagagttcttgtatgcaaaataaggtaatttgttatcagctaaactaaaatattataattttaggatgttttacgtatgttccatggtaaggtaaccagaaaggaagaaatctctagtagatacacaaaccataaaaagaaagaaaacaaagcataccaatacaaaaattcaacaaatcacaaaggaaaacagcaagagtggaagaaagaaacaaaggaactacaaaattgtagacaattaaaaaaatgtcaatagtaaatccttatctatcaacaataactttaaatgtaaatgaatgtaactctctaaagatacagagtgtctgaatgggttaaaaaaaatcaacaatatgctacctaaaatagactcacttaagccttaaggacaaacatagactgaaagtaaaaaaatagaaaaaggtattctatgaaaaatggcaaccaaaagagagcatgggtggctatacttatatcagacaacatagattttcagtcaaaatctgttagaagagacaaaaaaggtagctacatgatgataacaattgtaaatatatatgcactcaacactgacgcacctaaacatataaggcaaaaatttcagaaatgaagggagaaatagacagcaatcaaataataataggggacttcaataacccatttttcaacaatggatagatcatccagagagaaaattaataaagaagcagtaggcttgaacaacactataaaacaaatgaacttaccagacttacagcaaacattccatccaacagcaacaactacacgttcttctcaaatgcacatgaactttctccatgatagattatactttgggccacaaaacaattcttaacaaatttgagaagactgaaatcaacccacatatattttctgaccacaatggtataaaactataaatcgatatgagaaataattatgaaaaactcaccaatatgtggaaattaaacaacatactgttgaacaatcaatggttcaaagaaaaaaatcaaaatagaaatgaaaagcatttgagacaaatgaaaataaaatacaacataccaaaatttctgagatgcagcaaaaccagtgctgagagaactatatagtgataaatgccaacatcaaaatgaagaaaaaggccaggcgcggtgccttgcatctgtaatcccagcactttgggaggctgaggcagatggatcacgaggtcaagaggtcaagaccatcatcctggccaacatggtgaaatcctgtctctactaaaaatacaaaaattagcccggcaaggtggtgcgtgcctgtagtcccagctacttgggaggctgaggcaggagaatcgcttgaacccgggaggcggaggttgcagtgagcggagatcacaccactgcactccagcctgggtaacagggcaagactccatctcaaaaaaaaaaaaaaaaaaaggaaaagaaagaactgaaacaacctattgttacacctcaaggaactaggaaaataataaactaggcccaaagtcagcagaaagaaagacataataaagaccagacctgaagtaaatgaaatagagactaaaaagaaaagatcaacaaaactaagagttggtttttttgaaaagatataaatagacaaagctttaactaggttaaccagaaaataaagagagcccaaataaataaaattaaaattataaaagcgacccaaaactggtaatacaaaaatacaaaggatcataagagactacttgagtacagttattcaccaacaaattggataacttagaggaaataaataaattcctagaaacattccacctactaagatgaataatgaataactaggtaatttgaatagacaaataacaagtgagaagattgaatcagtaatcaaaaacctcccaacaaaaaaattccagggtcaattataccaaacgtttaaataattaatgcccatccttctcaaagtctttcaaaaaattaaagaggagaggacatctccaaactaattttatgaggccagcataaccttcaaactaaagccaggtaaggataataccagaaaataaattacagtccagaaaccttgatgaacaaagatagatgcaaaaatcctcaacaaaatactagtgaaacaaactcagaagcacattaaaaggatcatacaccatgtcaaatcagaagaatgattcaacatatgcaaatcaataaatgtgatgcactactttaaaagaacaaaggacaaaaatcatagatagtctcaacatatgcagaaaaagcatctgacaaaattcaacaatcactataaaaactctcaacaaattagatgtagaaggaatttacttcaacatgttaaaggccatacatgacaggcttatgggtagtataatactcaatggtgaaaaaatttaaagcttttcctcaagatcaggaataagacaagcatacacactctcatcacttctactcaacatagtaatggaagtcctagccagaaacattgtgtgataataagaaagaaaatgcatccaaattggaaatgaaaaagttaaattgtatgtttgcaggtgtcataatattatatacagaaaaacttaaacattctaccaaaaacctgtcagaactaataaataaattcagtaaagttacaggaaataatatcgacatacacatgtcagttgcatttctatcacctaacaaacaactatatccaaattgagatacagaaattgagatcccatttacaacagcatcaaaaataagatacttaagataaatttggccaaacaggtgaaagatacctacactaaaaactataaaacactgatgaaggatatcaaagaagacataaactaataaaaacatatcccgtgtttatggattggaagaattaatattgtttaaacgtccatattgccaaaagtgatctacaaagtcagtgcaatctctgtcaacattccaatgacatttttcatgaaaacagaaaaaaaaaaaatcctaaagttcatatggaactacaaaagacctgaaatagccaaagcaattttgaagaaaaagaacaaagctagaggcatcacactgcctgattttaaagtatattacaaagtcatgtgatcaaaactgtacggtattggcataaaaacagagatactaaccaatggaacaaaatagagatctcagaaataagcacacacatatgtcgtcaactaatctttgatgagagtgccaagaatatacggtgaggggaaaaaatcacttcaataaatgatgcttggaaaacaatatccatacgcagaaaaattaaattcttttacttaaaccatatataaaaattaactcaaaatggattaaaaacttcaatgtaagatctgaaaccgtaaaactcatagaagaaaacatagtttaaaagctccctgacattggctttggcaatgattttttggatatgacaacaaaagaacaggcaataaaagcaaacacaaacaaatgggagtacataaaaccaaaaagcttctgcacaacaaagaaaataacctacctagtgaaaaggcagtccatggaatgagagagaatgtttgcaagctagctttataatgaagggttaatatccaaaatgtttaagaaattcatacaactcaatagcaaaaaagacaaatccctgattaaaaagtgcacaaagggcctaagtagacatttttattcaaaggaaacatataaatggctatttgtatgttttctttgaaaaatatgaataggtgctcaacatcactaataatcagaaaaatgaaaaatgaaaccacaatgagataccacttcatacatagtaggatggccattatcaaaaagacaaaaggtaattattggtgaaggtgggaaaaaatgaaacgcttgtccactgttgattggaatgtaaattggtatagccattatgtaagacagtaggaaggctcttaaaaaattaaaagtagaacaacattatatgatccagcaatctcgccctgggactatctccaaaggaaatgaaataagcatcttcaagagataccagaatctccatattcattgcagcattattcacaatagctaagacatggaattaatcaaagtgtccattgctggataaatggataaagaaaattatatatacacacacatacatatataatgtattatacataatgtacacacacacatacatacgtacatacacaagcaatggaacattatacagctttaaaaaggaaatcctgccatatataaaaacatggatgaacttggaggacattatgctaagtgaagtaagccagacacataagggcaaataccgtataatttcacttatatgtagaatcacactcatagaaacaggaagttaccagggactaggggatgcaagaaagtgggaaatgttgatgtaagggtacaaaatatcaattttaagatgaacaaattccagggatcaagtctatggcaagggtggtaatggatttattaattaatttgttataatcattacacaaagtatacacatatcaaataatcacgttgtacacattgagtatatatgatttttatttgccaattaactatttaaaatataaaagaaataatcttgctatcaacagatttattaaatgtcttggtttaattttattccaagagcttggtattaatgaataatcatagaaactatata

SEQ ID NO: 340 - DNA, 4890 bp, Homo sapiens
acctagagaagttctactacttggaatagatctcttctaacaaacattgcttatggctttataattcataatccaagggtggctttttcatccttacatttaacttttttgaaaataagttaacatgaaaactagaattgagttagggaggctctgtagctcccgtttccatgaagagtctcttctggctaggcacggtggcactcgcctataatcccagcattttgggaggctgaggcagaaggatagtttgaggccaggagtttgagaccagcctgggtagcatagccagatgctgtctctacaaaaaatttaaaaaattaaccaggcatggtggtgcacacctgtagtgtcctagctactgaggaggctgaggtgggaggattgcatgaacccaggagtctgaggttacaacatgtgcctctgcactccagcctgggcaacagagtgagacctgtgtcaaaaaaaaaaaaaaaaaaaaaagtctaatctataattgtaccatttttggaaagggatacctggaaggaagttgttctgctgtgcctggccaaataaatcccagcctgtttgcagggataacaagttagaaaaaaagtgagaaaatgcaacctatttaatcgctttcacctaggaatggaggtggtgaccaaaggaaaaagagaagataggtctggctcctgaggccttgggaagactgggaaaacttggaaggatttgggaagaattggaaaaggagtgaaccaaatattggcagatcattgtgcctttctgggtttaaaggaaagactcttgtggctggcaccatttcctgtggctcactgctacttgaaagtgtattgtgtgagggggaaagtgcttatcagcaggtttgatggaatagggagtttgtgaagatttcaggtgaaaagttccattcagtctgtgtggcctgtggtaggataaatctcatcgaagggcaagtcggaagacccgatctagttcctggacccagcctaagtgcttgccttgatgtaaattatcactcctccgtatgtttcactttcatctttaataaaaagaatatgataataactgccctatctctgtggatttctgtattaattgaaataatacattagaaatgctgtttatcagctgggtgtggtggctcacgcctgtaatcccagcactttgggaggctgaggcaggtggatcatttaaggtcaggagttggagaccggcctgggcaacatggcaaaaccctgtctctaccaaaaatacaaaaatttagctgggtgtggtggcgtgcgcctgtaatctcagctactttgggaggttgagggggaggatcacttgggcctgggaggcggatgttgcagtgagccaagatcctttactgcactccagcctgggcgacagagcgagaccctgtctcaagaacaaaaaaaggaaagaaaagaagtgccctttgttgtactgttgaagatcacattacctttgcaatattatctcttgtaaattacctgttccaggaacatggatctagtcactgactccagtaaacctttcactttcagtcagaaactttggtttctgcctagacttcctctcttctctgtttacattcccagtctctccctatttaaacgcctctagtatcctaatgaagcacttttaaactggtgaacagtcttcatttcccttttctaaattaagagcgggatataatttggggtagagtcaccaccagttgtggtgtaagggttaatcaaatttatttcagtatgaatttctgttaatacctgaccatgagacctgcctgtagctagtttctcagatcagaggtcagaattaagctttcaatgttgacttttagagttctccttgagaagatccagattttcagtataaagagttacatagagaaatggaagatccctctgacattttgtcattacagaaattttaataacttcaatgtccaattttacatatgtttgacgtgtaactttgctttccttcaatcatcaaaattaaaaacaatttttcatagtagaaaaaatgggtaagaatttgctagtttgatatggtcaactaatttttgataagggccccaagaggacacaatggggaaaggatagtctcttcaataaataatgctgggaaaatgatttccataggccaaaagaatgaaattggaccttatattacactgtatacaaaaataaactcaaaatggataaaatacctaaatataagaacaaaaactgtaaaactatacccaaaggaaatgaaatcatcgccgtaaaaagatacttgcactcccatgatcattgtagcattattcacaatagccaaaatacagaaacagcctaagtgtctgttaacatatgaatggataaagaaactgtagtatgcacaatggaatattactgagccctaaagaacaaaatcttgccatttaccacaacatggatgagcctgggagacattatgctaagtgaaataagccagacacagaaagagaaatatggtatgatcttgatctcgcgtatacacagaatctgaaaaaaaaattcagagatagagaatgaaactggttatcaggagcagaggggcataaaggggaggaaatgggaagaggcaggtcaaaggatacattacagctttgcaagatgagcaggtctagagatcttatgtacaacctgaggggtataggttaaaaaaattgaactgtaaaatgaatagattttagctgctcttgccacaaaaacaaaaaaatgggtaactatgtgagatgatggatatgttaatttgcttcagtttagtaccgtttccatctatctacatatcccataacatcatgttgtatacataataaaatttatctttaaaaaagaatttactagtttgaaaagaatttactaggttaacagaattgttctctgtaagacactttgggattctttcaaaagattctgggtgggatgtgttgtttttcatttttgtactgtcgtgatgactgcttagttttgtttgccctttcttaaattgtttcacagtttccaagataaacttttaagaacgtgctcactggaactgaatatgatattttatttattttatttttcaagacagggtctcgctctgtcacccaggctggagtacagtggcactcactgctcactgcaccctcgacttccccaggcttgggtgatcctcccacctcagcctcctgagtagctgggactacaagtgtacaccgccgcaccaggctaatttttatatcttttgtagagatggggttcaccatgttgcccaggctggtcttgaacccctgggcttaagcaatctgcccaccttggcctcccaaagtgctaggattataggtgtgagccgccgaacctggactgtgattttctgcttactactagttttcattgatttaattacgatgtgccttgatgggtgtttaaaaaatatttattctgtttggggtttgttgagcttcttggacatgtaggtttatagatttcatcaactttggacatttttcatcatttatttcttcttatatttttcgtgccccatccgctcttttctctttctaagactctagttacatatgtgctagactgctttctgttgtcccaccactcgccgatgcacagttcaattatttttagtcgtttttctttcgtcattttggatagtttccattggtacatgcttattgatcttttcttctgtggtgtttaatatgctgttaatctcacccagtttattttacaattcaaatattgtaattttcatttctggagatttcacttgagtcttttcttccatttctgtttataattttcctgttttcctctactttcttgaacatgtggagcatatttataataactattttgatatcctcatctgctaattctattacttctgttcatattgattctgattgtattctgattatatggattttacttctagttgtcaattatattctcctgcttctttgcatgactggtaattttttactgaatgccaaaccttgtgaattttacctttgggatactagatttttttcccctaagatgtactttatgatggctgtagttaagttgccaggaattacttggatccttttgaggctggattttaagttttgttagggctgtccagagaagccttcagtctagggttaatttatgcctgctggtaaggcagtacacttctgagaactttacccaatgccccaagtattaatgaggctttctgctttgcctggtgggaacatgaatgtcccagccatgtatgagctttgagaattgtctgaccttcaacattgcagtgcttctctccctggcctttgttagtttcatctcattcaggcacagatgagttctcagccgaagacggaaagatacccttccgtaagacgtccacaacttatgctcctctctctgtgcagctctgtcctctcaggcactctgcctcacaaatcctaattgccttgaccttcctgaactttgtgtttctcttaaacacagcatgattgctggactctgttctggtcatgggacctgcactgtggcctggaaactgactctgggaagttagctggagcagtcgcagggctcatctcatttgtttcccttctgtgagggatcacaagcctgcactgcctgtaatgtttgaaaactgttttttgttttttgtttttttaaaaatatattttattgcctttctagttatataaggtgggagagcaaatctagtccctgatactccattgtgaatggaagcagaggttggcagttggcccctaaggtcttttttcacagcaaaaatttaactgagtaatttcaaatctgtggcataatgcatagtattatattaaaa

SEQ ID NO: 341 - DNA, 7300 bp, Homo sapiens
gaacatgttccagaaaaatcagtattttgaggctgtaagtgaaatttgtccagtgagttcagtggatctcagcatgcagctttcacctgatgccagtgccatgctcttgggcttcccaggctccagaaccatgagccaaataagtcttttctttataaattacccagtgtctagtattctgttatagcaacagaaaatggaattacacaactcttatttgaaaaaatgggaggctataattatgaaacaattaatgacttatgtggaattacttcccttggttaaattagatctttactttcattaactaaagatgataatttcaaagctttgctttttaaatttgttctgctacctgtgaaatcatttaaaatcaaggaaactagacaacagaaacagtgcattgttataaagtcatgaacatcattgtcatgtagttccttatatttgtatacctgaggtactaaccatctaatgagcatattttgtacaacagaaggcctatatatttgcaaagactgctttaaccctgaaaaatatttgtagaaggtgtatttttaagggagtaggtaggaatggaatgactggagataggtaggtttgtgtcctttgatttctccctagatgaagttgtaggtggagtaagaggtgtatcaggcagtccttgaaggagggggcatatgagtgctttgctgaattgggtgagaagagtgtttagaaaggaaaaagccatgagacagtattaagtcataaataaacaagaggactttgtgggtggaatggagctggagtatgaaggtgggtgattgagagttatgctgcaaagagactcttatcagtgagtaaagagcttgtggtaagattagtttaggagtggccagaagagctgttcctaaactcatgtgctccttggtgtgctcctaaactaagcccatgaaggctctcccctaaatctcctgtaatacaaatagaaaattatttttgcacaaacacctttattgtcacacttggtccattaattgagggatattggttaaacatatactgtgtgccagagtaatgttctagagtactgggaatgtaggggtgagtgagaaagacacaatccttgccctctctgtgctttaatcagttcagccttagaaaatgaaatatttaaggtgagaaggcaaggaaaagggaagacttaattttggagttttggattgggtatgtggggggcaggtggctttgattagggagaccaagatgaaggtactagtgctgtttctcagtgagttacagggttgtgggcaaggaagaagagaagtagatgcctcctctctcacctcaatctttctccttcagtcactgcgtagttccgtctcttaatatggaaacgttaagattcttatacttatgggcctttttccagagaatgcagagagcatacaggattttgtcagaggtgcagttcacctctggatgttttctggaagagtaaatcatgtgtgaaaattgaataaattaatggactatcagacttgctgtttgcttttttccagtataagctttgtgtctttgagactatggtaggagtgtatgacttcctggctaggatgtcagtttaatttgtttgtgcttctatacgatagttacagtgttgtcagaaagcattgaggaagttttaaaatcataatttagttttatctaatcctgtaatgaatagaatcctatgaataattcaaataactagaaaagctaaaatttcccaaatatgtattttatacagctctttttcagtgtataattgaaaaacaatttaaattttaatcagtgggtttttttttaatgacaaggggttatgattgatttttagtagttattttgttttctagaataaatttatatgaaatttaatatatcaagtaaaattcattgttagggaagctattacttaaattatgatatagccacataattgaataccatgcagtcattaaaaagaatgatgtggatctctgtgtttgacctggaaagagttctgtaacattgttaaatttggatacagtagatattatgaaaactatataattaaaaacgtatttattcatttatttaattatttagagacagggtctcactctgttgccccagctggagtgcagtggctcacttcaacctctgcctcctgggttcaagcaattctcgtgcctcagcctcctgagtagctgggattacaggagtatgccaccacagctggctaatttttggatttttaatagagacagatttttaccatgctggccaggcttgtctcaaactactgacctcaagtgatcagcccaccttggcttcccaaagtgctgggattacaggtgtgaaccaccacatccagccataaaaactttaaatgttagaatggaatattacctagagaagttctactacttggaatagatctcttctaacaaacattgcttatggctttataattcataatccaagggtggctttttcatccttacatttaacttttttgaaaataagttaacatgaaaactagaattgagttagggaggctctgtagctcccgtttccatgaagagtctcttctggctaggcacggtggcactcgcctataatcccagcattttgggaggctgaggcagaaggatagtttgaggccaggagtttgagaccagcctgggtagcatagccagatgctgtctctacaaaaaatttaaaaaattaaccaggcatggtggtgcacacctgtagtgtcctagctactgaggaggctgaggtgggaggattgcatgaacccaggagtctgaggttacaacatgtgcctctgcactccagcctgggcaacagagtgagacctgtgtcaaaaaaaaaaaaaaaaaaaaaagtctaatctataattgtaccatttttggaaagggatacctggaaggaagttgttctgctgtgcctggccaaataaatcccagcctgtttgcagggataacaagttagaaaaaaagtgagaaaatgcaacctatttaatcgctttcacctaggaatggaggtggtgaccaaaggaaaaagagaagataggtctggctcctgaggccttgggaagactgggaaaacttggaaggatttgggaagaattggaaaaggagtgaaccaaatattggcagatcattgtgcctttctgggtttaaaggaaagactcttgtggctggcaccatttcctgtggctcactgctacttgaaagtgtattgtgtgagggggaaagtgcttatcagcaggtttgatggaatagggagtttgtgaagatttcaggtgaaaagttccattcagtctgtgtggcctgtggtaggataaatctcatcgaagggcaagtcggaagacccgatctagttcctggacccagcctaagtgcttgccttgatgtaaattatcactcctccgtatgtttcactttcatctttaataaaaagaatatgataataactgccctatctctgtggatttctgtattaattgaaataatacattagaaatgctgtttatcagctgggtgtggtggctcacgcctgtaatcccagcactttgggaggctgaggcaggtggatcatttaaggtcaggagttggagaccggcctgggcaacatggcaaaaccctgtctctaccaaaaatacaaaaatttagctgggtgtggtggcgtgcgcctgtaatctcagctactttgggaggttgagggggaggatcacttgggcctgggaggcggatgttgcagtgagccaagatcctttactgcactccagcctgggcgacagagcgagaccctgtctcaagaacaaaaaaaggaaagaaaagaagtgccctttgttgtactgttgaagatcacattacctttgcaatattatctcttgtaaattacctgttccaggaacatggatctagtcactgactccagtaaacctttcactttcagtcagaaactttggtttctgcctagacttcctctcttctctgtttacattcccagtctctccctatttaaacgcctctagtatcctaatgaagcacttttaaactggtgaacagtcttcatttcccttttctaaattaagagcgggatataatttggggtagagtcaccaccagttgtggtgtaagggttaatcaaatttatttcagtatgaatttctgttaatacctgaccatgagacctgcctgtagctagtttctcagatcagaggtcagaattaagctttcaatgttgacttttagagttctccttgagaagatccagattttcagtataaagagttacatagagaaatggaagatccctctgacattttgtcattacagaaattttaataacttcaatgtccaattttacatatgtttgacgtgtaactttgctttccttcaatcatcaaaattaaaaacaatttttcatagtagaaaaaatgggtaagaatttgctagtttgatatggtcaactaatttttgataagggccccaagaggacacaatggggaaaggatagtctcttcaataaataatgctgggaaaatgatttccataggccaaaagaatgaaattggaccttatattacactgtatacaaaaataaactcaaaatggataaaatacctaaatataagaacaaaaactgtaaaactatacccaaaggaaatgaaatcatcgccgtaaaaagatacttgcactcccatgatcattgtagcattattcacaatagccaaaatacagaaacagcctaagtgtctgttaacatatgaatggataaagaaactgtagtatgcacaatggaatattactgagccctaaagaacaaaatcttgccatttaccacaacatggatgagcctgggagacattatgctaagtgaaataagccagacacagaaagagaaatatggtatgatcttgatctcgcgtatacacagaatctgaaaaaaaaattcagagatagagaatgaaactggttatcaggagcagaggggcataaaggggaggaaatgggaagaggcaggtcaaaggatacattacagctttgcaagatgagcaggtctagagatcttatgtacaacctgaggggtataggttaaaaaaattgaactgtaaaatgaatagattttagctgctcttgccacaaaaacaaaaaaatgggtaactatgtgagatgatggatatgttaatttgcttcagtttagtaccgtttccatctatctacatatcccataacatcatgttgtatacataataaaatttatctttaaaaaagaatttactagtttgaaaagaatttactaggttaacagaattgttctctgtaagacactttgggattctttcaaaagattctgggtgggatgtgttgtttttcatttttgtactgtcgtgatgactgcttagttttgtttgccctttcttaaattgtttcacagtttccaagataaacttttaagaacgtgctcactggaactgaatatgatattttatttattttatttttcaagacagggtctcgctctgtcacccaggctggagtacagtggcactcactgctcactgcaccctcgacttccccaggcttgggtgatcctcccacctcagcctcctgagtagctgggactacaagtgtacaccgccgcaccaggctaatttttatatcttttgtagagatggggttcaccatgttgcccaggctggtcttgaacccctgggcttaagcaatctgcccaccttggcctcccaaagtgctaggattataggtgtgagccgccgaacctggactgtgattttctgcttactactagttttcattgatttaattacgatgtgccttgatgggtgtttaaaaaatatttattctgtttggggtttgttgagcttcttggacatgtaggtttatagatttcatcaactttggacatttttcatcatttatttcttcttatatttttcgtgccccatccgctcttttctctttctaagactctagttacatatgtgctagactgctttctgttgtcccaccactcgccgatgcacagttcaattatttttagtcgtttttctttcgtcattttggatagtttccattggtacatgcttattgatcttttcttctgtggtgtttaatatgctgttaatctcacccagtttattttacaattcaaatattgtaattttcatttctggagatttcacttgagtcttttcttccatttctgtttataattttcctgttttcctctactttcttgaacatgtggagcatatttataataactattttgatatcctcatctgctaattctattacttctgttcatattgattctgattgtattctgattatatggattttacttctagttgtcaattatattctcctgcttctttgcatgactggtaattttttactgaatgccaaaccttgtgaattttacctttgggatactagatttttttcccctaagatgtactttatgatggctgtagttaagttgccaggaattacttggatccttttgaggctggattttaagttttgttagggctgtccagagaagccttcagtctagggttaatttatgcctgctggtaaggcagtacacttctgagaactttacccaatgccccaagtattaatgaggctttctgctttgcctggtgggaacatgaatgtcccagccatgtatgagctttgagaattgtctgaccttcaacattgcagtgcttctctccctggcctttgttagtttcatctcattcaggcacagatgagttctcagccgaagacggaaagatacccttccgtaagacgtccacaacttatgctcctctctctgtgcagctctgtcctctcaggcactctgcctcacaaatcctaattgccttgaccttcctgaactttgtgtttctcttaaacacagcatgattgctggactctgttctggtcatgggacctgcactgtggcctggaaactgactctgggaagttagctggagcagtcgcagggctcatctcatttgtttcccttctgtgagggatcacaagcctgcactgcctgtaatgtttgaaaactgttttttgttttttgtttttttaaaaatatattttattgcctttctagttatataaggtgggagagcaaatctagtccctgatactccattgtgaatggaagcagaggttggcagttggcccctaaggtcttttttcacagcaaaaatttaactgagtaatttcaaatctgtggcataatgcatagtattatattaaaa

SEQ ID NO: 342 - DNA, 64869 bp, Homo sapiens
tgttttctatgcaagttaggtttttgttaagaaagggtataacacaactaagtaacagtctgcttagaagcatttgcagtagaagatgggggcgagagaagtgggactcgtattcctgcctgctgatccacatctgctggaaggtggacagcgaggccaggatggagccaatgatacacatggagtatttgcactcagcaggagcaataatcttgatcttcatcatgctgggagccagggcagtgatctccttttgcatcctgttgggcgatgccagggtacatggtggtgccgctggacagcactgcattggcgtacaggcctttatggatgtccacgtcacacttcatgatggagttgaaggtagtttcatggatgtcacgggttccatgcccaggaaggaaggctggaggagaggccagggcagtggaactacttgttgcagatgtcgatgacctggctctggagcagcttgtagctcttctccagggagaagctggaggacatggtggccatctcctacttgaagtccagggcaatgtagcgcagcttcttcttgatgtcacgcatgatttcctgctgggccgtggtggtgaagctgtagccacgctcggtgaggatcttcgtgaagtagtcagtcaggtcccagccagccaggtccagacataggatggcactggggagggtgtaccccttgtagtttggtagtgtgggtgaccccatcactggagtccatcgcaatgccagtggtacaaccagaggcatacagcaacagcacagcatggatggcacatatatggcaggggtgttgaaggtctcaaacatgatctgggtcatcttctcgcagttggccttggggttcagaagagcctcagtcagcagcatgggatgttcctcaggagccatgtgcagcttgttgtagaaggtgtggttccagatctccatgtcgtcctagttggtgatgatgctgtgctggatgtggtatttcaggatcaggatgcctttcttgctctgggccttgtcacccacataagagtccttctgagccatgcctgctgtcatgtactggttccgtgggcaccccgtgatggaaggcaagataccctggggggcattgtcactgcaagtgtgaagatatcatcattcatggggagctggcaccaagtttggactggtggaggagtgtcgagcgtgagggtctgtgcttggggcagatacagtcttggtctaatattttaacataaattaaccatatcagaaagagttattaaacttaggactcaaacctatggagtaataatttaatactataattaaattaaacacaatcacatacacctaaccctcaacgatatacagagaaagttttgatactaattttcaattctttatctctatgaagctgatgaaaaattcttaggcagtgtgcctggtgtgggattttgtaaaccaaaaataatattctaggcttcccaatcaactgaatagacctatcctctcagccaagggcattccaaaattaacctgaaaaactagttcagaccatgatgagatgcaggagatggggcatgacttatttacactctcctgtctttggaatgcaggcatgggtgaccagcattaacattaaaatagagatcttaagaataaaacagacttcctgtagcaataagacaccaaattccagcctgactaaaataaatcgaatatatatatatatacatatatgtaaaacactttgatttcttacatatatattattattatatatattttgttatttttttgagatgaagtctcactctgttgccagttcggagtgcagtggtgcgatctcagctcactgcaacctctgactccatggttcaagctattttcctgcctcagccgaccaagtagctgggattacaagcacacaccaccacgcccagctaatttttgtatttttagtagagatggggtttcaccatgttggccaggatggccttgatctcctgacctcatgatctgcccactttggcctcccaaagtactgggattacaggcataagccaccgtgcccagccccaaaatatatttctttcagagatatatatatatatatatatatatatatattatatattatataatgtgtgtgtgtgtgtgtgtgtgtgtgtgtgtatattttttgatacagagtctgttacccaggctggagtgcagtgatgtgatcttggctcattgccacctctgcctcctgagttcaagcaattctagtactttagtttcccaagtagctgggattacaggcgtgtatcaccatgcccaactaatttttgtatttttagtagagatgaggttttgccctgtttgcgaggctggtcttgaactcctggcctcaagtgatccacccaccttggcctcccaaaatgctgggattacagacaagagctaccatgcccagccttctttgatatattttgaaatggtcctgcaaagctttctctcattgggaaaatgtatattctatagagaatccttgattctttcctgatccaggaaggaattaactgagtctgacacctttttgggtctgataaatgtcaggcctgtgagcccaagctaagccatcatatccccagtgacctgcacgtatacatccagatggcctgaagcaactgaagatccacgaaagaagtgaaaatagccttaactgatgacattccatcattgtgatttgtttctgccccaccctaactgatcaatgtactttgtagtctcccccacccttgagaaggttctttgtaattctccccacccttaagaatgtactttgtgagatccacccctgcccgcaaaacattgctcctaactccaccgcctatcccaaaacctgtaagaactaatgataatccaccaccctttgctgactacttttttggactcagcccgcctacacccaggtgaaataaacagccttgttgctcacacaaagcctgtttggtggtctcttcatatggacacgagagacaataagagctctgaggcctgctacctgaaggtttcatatgcatgataaagccttgatctccacaaccccttatcttaacccagaccttcctttgtactgattccaggtctttagataataaactctttctctttttggtagaagatagcttaaaaaacacacactccaaaaaacttctttcaaccaattgtcagttagaaaatctttgaatccacctatgacctggaaggaaccacccctcgccccctctagttgtcccacctttcctgaccgaaccaatgtacatcttacatgtattgagtgatgtcttatgtttccctgaaatgtataaaacccagctgtagcccaactatcctgggcacatgttctctagatctactgcggctgtctcatgggccattggtcactcatatctggctcagaataaatctcttcaaatattttatagagtttgaccttttcatcaataacctctattcttttatcatttgttttcctcatcttttgtgtgtcctgcaatgtccttgcttcttgccactccttccctggttgttacttcattgtattatcagaggagtttgaaccagagtgactccatcttgaataggggctgggtaaaataaggctaacaactactgggctgcattcccaggtggataggtattcttggtcacaggatgagatagaaggtcagcataaggtacacgtcacaaagaccttgttgacaaaagggtatggtaaagaagatggacaaaacccaccaaaaccaaggtggcaacaaaagtgacctctggttgtcctcactgctcattatacactaattacaatggattagcatgctaaaagagacactcaccagcacatgacagtttacagatgccatggcaatgtcaggaagttatcctatatggtctaaaaacgggaggaaccctcatttccacaaattgcccacctcttccccagaaaacttataatccaccccttgtttaacatataatcaagaagtaactataagtataatcagttgagcagcccatgctgctgctctgtctatggagtagccattcttcattcctttactttcttaataaacttgctttcactttagtctatggactcaccctgaattcttgcttgggtgagatccaaaagccctctcttggggtctggatcaggatccctttctggtaatgtcttctggttgaaccacgaagggacaatattgaggaaacctctgacccaaagaaaacagcaataccaattggccgactttgagtaagaggaggggtacatttaacgtgggtaaaggatggaattgggttagaggcccaacttaggagggttagagtccctactaagacagagttaaaggcctccttaataaaaggcaaggacacttgaccaaacttgggttagaggcccaacttaggaaggttagagcccttcctaagattcagggggttacaggttagaggtccctctcagtaaagtccctcttggttaaaaatggatttggaattatgggatgttatctgctattctctttggattaatctgccttgcactgtttgctgatggctgtgggtgacaggattaggcatgtacaggatcaccagatgtgggagcatttttctccctaaagtgggaaagatgagagctgatgggactgttggaagagctcccttcattactgaaaagcaggtgcctgaacttttgattcagcgtcgctgcaatgggtgggtctttctctggcctcccggagctatgtaccctgccacagacaatgcttttctccccttttctcctttctcttttctatcttttctgttactcagagccaactgtctgctgtttcatcttgcccagagaccacatgttgaaactcctggttggaagatcattgtaccccacttttctttttagcatataatcaagaagtaactaagtataatcagttgagcagctgatgccgctgctttgtctttggagtagccattctttactcctttacttttttttttcttttttgagacggagtttttgcttttgtcacccaggctggagtgcagtggcactcttgactcattgcaacctccacctcccaggttcaagcaattctcctgcctcggcctcctgagtagctggaattacaggcacccaccaccacacccagctaatttttgtatttttagtagagacggagtttcactctgttggccaggctggtctcgaactcctgacctcaggtgatctgcccacctcggcctcccaaagtgctgggattacaggcttgagccaccgtgctccatgataacttttcagaaaacttttttctactttttgccacaacttttttacatttttatccgataactttttcaccccaaaacttttttaatcccataccttttttatgttgtgttctttcaataaacacttgcatagttatactacatttttgtaacaatgaaacagattatctcatgccaagcatgcccagtatttgcacaatatcaatacttttaatactatagttttcaagacacgcaaaataaaattttaaggcaaaaacagcactttgcaacaatttaaaaatttattgcattacagtagcatcacatcagcagtcaataatgccactttaagcaaaagtctttcagtatttccgttacacattctgttaacaagaactcatacattggtaaaattcattctaagaaaacttggcaaataacgctttggcctggaattggcatttctttctctacttttccttcccaccatttcttccttttaaactacaggatttatattttaaaatgttttatttcagaacattaagatagcagttacattttttaatatttatattattttaaaatgactctttaagatacagttttaaacccatgggctagaaatcatacgactgttaattagccgcattatttggtctaacattttttatcattctgaaactggatttgtgtaatacattgataaattcatacaatttggaagagtcagttgaagttacaaggacccaatatctgccctctttcagtgaatgccggcaaatctgttattccattggcaaaatcgtattgctgctctcctgttaatctcacatttataaaaggatcatgaggctgccaagtgctaaaaatggagatggtctagtaactagaaaactccccaccccagggagcacacctacatatctccctacaacctaataatgtgatgtgttttggaacacagacattagaacttcatgaagttttaactgttgattctttcccaagcatcatcaagttatgatttaggcaatgtatgattgaaatgcattcattcatcatgcataggcacaatcacagaaatattgcacaaagtatgtccctgactgaaaatgagaggtacaaaaacgtatttcactcttcgtaaagaagtttgtgaggaaatacaactctgcgatcgtatagacatgtttcctgataatacagacattcacaaacagtagattgcaccacagtgtgtaaacattttaagttgcataaacttctccttgattttcaaagataatataatactgtctactaaaattcctttttgtttcaactaagtactctcacatatattagtttataataatgtttgttattactttctaaagtgttttccactcaaggaaaagaagtaaattcctatgtcagagtaaccgaggtggttgaagaataggtattagccagagaggtctagatagtaaaatcaaacttcaagcctcaaagaagctccatgaacagagaggaatgccaggtgtcacacagctttccttcactctaattcattcttgactagagcctgtatgcctgtttcagagacatttaaactcttaaaggatttcttatgatcttcactaaatacattaagaagaatgccaaccagcgccctttcgtgtactgggacaggtagtcatgtgattaaaacagggaacacgaactctgactttaaaatgtattgtagatacaaatgctctaagctaggaaaggtttttcacacccacagccaatgatggcagcctttcattcctcggaaataagccctttttaggtcactgaaaaagagtgcaactgctgcagctcacgatgcaatatcttcatgagcccagagcacatacaaatccaaagggaactgccacagtacactgctcattcttggcaccggaacagatgaaacacactgtatcctgcacatacctgccagagcaggccactttcctcttctgtgagatttagaaagctcccccaaaaggttatcactcccatcaccaatacacagaaaatggaggaaaggctgtttccagttctcggcctttaaacagctctaaatgtcagtactcacagtggcatattacaaagtaataaacagtgcacacttgagggcaaaccgcatattgagctatagaagagctcactgtgattaagatgagatcaaacatcatagcagaacattagcaaattttatctgaattctgtaatggacatccatgctgcaataacattagaaaagcacgggagcctattccaaaccagcgagaacagttttgtgcaaagagtgggtctttgtgtgtttgaactcccaccacgtaagggcaaactcgatatgcatgctaatgacctacaattatgaaatgaaaaaagaaaaatgctgaaggatgccagagtgaacatcagtgagagccacagagacccactctcttttaactttttacaaataaacttaaactataaattagaaacacaaataatcatgagtagctctaacattcaaatgaagtaaatgaattgtgtaggagattaaccccataactttgtttcgtttttaaaaatttcttgagcagctctttgatgatggtggtgtttatctccttcttctcggcagccaagcccagcaaaagcatggcacacagcagttgctgcccaagcctgggtgctcctggtggtcctgcatctcaccaaggagctgcacgactggctgtgcagtagggttgtcctgggaagaaccctccctggcttctccttgtgcaggctccacgctgttggtgaggctcgcctcacaaagatctttggagagagggaggcggggatctgagtggagtgctagccgccccccgctcctgcctgctcaccccgcctgggggctctactcaccaccatgcttgtcggcagccccgagctcctggggggctggggctcctggactgggttcagcagcagggttccgggcagcggccaggaatttgccgtgcccctcgctgtagctgccacaagccgcaacaccatctcctgcagctccagcagcttcacctgaagggacgggtgctcagctgtcaggccgctgctggcgcccaccctcatgcccaccccacccacacccccaccccacccccacccccacagggatgttgcacaccctaccttcctctcctccttgtcctgggccagcctgatgatggcctcctcccggtgacgcatctttggcactgtcccctggctctgttagaaggcgatgtactttcctgcgggaggacagggctcagacgctggggcccctcccatagccctgcagctccccctgccgtgccctggcctcccactcactgatggcatctctctctccggtactggatgaatccaagttccagtttctccacatgctccctcaggtccgccttctcctccaggaggtccataaggccgctctggagccaaaataatggggtcacatctcagcagcgacctgccccagccctgcccttcttggcccatgctaggactcactcccctccagcttctccatgacttcctgcagggcccggagggtctccccactcacagactcgcccccagtccctgaggctgggactgctgcctctggctccttctcggccgaggtgagcgtctccatcacctggcccagcttctcctgcagctcctttacttgctgctccaactgcagtgcgctcttgttctcgtgcttctggacagagagaagcaatcagcagccacccactgcagctggagaccccagaacttggtgtctgcctcccatggcaccgggaagggtggagccaagttagaaaaatactctcctctctcccacagccaccagagcaaagctctggctcacaggtgcctttggaagtaatatttcatgtgagggctacactgccccattttacaggtggggaaacaaaggcctggagggctagggaggagggcaggctccccaggtggggcaacccaccagctcctccaagtcgctctgtggctcggccagctgctgaagcctcttctcccgttcccgaagcctctcctgctgctcctgaagcctctcctcctgctcgcgaagcctctccttttgcccacggttcaggagactgatgcactgattgttttccacctgagcctggagctctcctgccactctctccagctccttcctcaggtcttgcagctccacctcagaggacactgctggggcatccgggggcagtggctcagctgagaaaggaagcagatcataagggcctctggattctcaaaacaaaaatcaaaacagaaaaaacaacaaaacaccctcctgttggcgcacagctcctctcaggctcccaaacttggcttcactgctaacgatccctcgcacccggatggtagccagtcttccaaaccactttcagatagagagcactgcgggtggctgacaacgggccctctttgctcatggggacactgaggctcagggagatgacaagacttgtctcctggcacagacctctttccctctgcctcaaagccctgccatccacccacctccctggggcactctaagccacccccacagccctctgatgccagtcctgctcccaggtcatgccagccccatcttacccatctggtttttgagtctggacaagctcctctccagctcctctacccgatgcgtatcatgcttcttctcctccttcaatgtgcaaacctgcccaaagcacagggggaaagggccctggagagaggggctggtggctggacaggctcccatctccctctctgcccccacctccacaaagcccagacccaggaccacctctggctgcactattcccattttaaagaggcccagaaagatccagtgacctatcttaagttgttggtggggggggggtggggcgggaggctgaagggtcagatctcacctcctgcgacattttcctcatcctctgctgccactgggccctctctccttttatttgttcagcatattgatctctctccagctggacttctttaagcgactccttcaactgcaagaatggccacacaagttaggaagggccgtcactggtcctcacctgctcctggccacctggggtcatcttccttccacatccctccctctgcaaaacctcacctgtgtcacgtgtcctttcagcagtatctgctcccgtatggactgctctaactgccgcttgagaagtgctttactgcggctcgagaactggatggtgaagagtgagaagtttcgatctggggagcctgggccattccacacagtgccccttaaaagggctagggctaggctcaatatacaactcggtcagtaaagatcaaggcatttccaagcccgtggtctggttttgaaaaaaactcagtgaagttggaagggacaaggagagagatcagataatattgctattgttattactcccactgtttgaacctttgtggagtgcttcagcaggtaccttgctagcaatcccatttaatcctcgcaaccaccagaggagacagttactatgatgccctctcttgggtagatgaaaaaacatggagtgtttgaggttaagtgcttgcctaagatcacttaggcagagctaggatttgaacacccaggtctatcagattctctaagcccatttttctgctgggggtgggggcacggttaggaaggggaaaattaatcttttgttcactttttgaaaagatgatacattcacatagtccaaaactcggaaggtatcaaagggaagtatctcccagccaccctgctgctctctcctgagttgtttacgaacacttgcagacatgttttatgtatattatcatactatgtacacacacacacacacacacacacgtttcctctctctacagaaatgggaacatactaaaggtacccttctgtaccttcacagtacaagtacccaataccccacaccccacctaggacttggccaagaccacagccaggtaagggcagggcaggcacttggcctccaagctctgcatccagtgctcgctccccaccgcgccccccgactcacccacagcagctgactcagcctcaggctgcctctaacaaccatacacaaaagcagtgagaaatggccatgctgccttctgggcaggacactccatcctgcagaagggacctttaggctcactcctccatctgtgaagccgggctcccaggggacagggcaggtgactggactcaccccatccggcttcttcttctgtgtggcggcgacagcacagagagaccactctaactctcctatacgctgcgatgaacgttgcaggcggccggccagatccttggactcttctgtaatgacagagttgacatggggctcaaaggactccgccttacagacctgtcaaagtgccaggttgaaggatgacagggtgcccagattcccaccttcaaagtatctgagagaatgtttcatgtgatacaggtccgtatttagtttctttttctctgtgttcaatctctggatttgaccctttgggagaaaagccaagcaagtgctgaaatagaaggaaagaaacattctccggaggacaggaggaaacttcacaccctccactcacctctagctccctttcagctttctgtttctcattgtttgctttcttttcctataggaagaggaagacagagctcttaccagggggaggcagagaaggcacagcaagagatatgcccccagaatgccaccaatgccccaggacaggcccacccatgggaccaggttatcagggaccctgtggggatggggtggaatctgaggggtgagcctccttccccaggctgggagtgggtgagacgagactggggcctctacatctgagtgtcccccaaacccagcagtcatgtcgccagcaaacaaagaaatcacgttacttcttccagctgatgttccacttgtttcttctgttgtttctgtggggagagtcaaattaaagtgatggagggtggccccctcaactctattccccagacaggaagcggcaggcaggggccaggaatggattttaaaggcaaagttctcagacccaatgggaacaggaactgttcccaagctcccaaggacagaggatttgggtctttgttggttttcagccacagcctcacaactcaaagtctgaatcaggaatctcttgagaggacagtaacataaacctctagagatggagtttgagaaaggctcccccttctgccagcttgtgatttagaaaagtgtgttcattcaatagacatttactgagcacgtacgggccagggatggttcttcacagccgatataggatggaaaagaacagacaagagcccttggccctgagctttccattctagggggcctttaaatctcagactctcagagctaacacagacctttgatactcactacctcctctggaaacacgagcccaaaaaggagaggtggcttgtccagaatcaaagagcaaattagggactgagtcatggcagaaatacggggcccctgacaaccagtcaggccagcacttccccaagaggcaacaaccccagggcgtgtgtagcaaggactcgagtaggggtgcctggagaggagagagtcggcaaagagggcagcaaaagaagagccatgctgcatgctctggggtcccgccaggtgaggcctgggcgccccagctccctatctgcccttggcaccaggggcccccagcccccttcttcagggccccaagaggaaaccggagcccaggattggcagcgtggaatcaggggaccccactggactcttaccaaagatttgatggtgtcattcagtcgactgatttttatggacctcgagttcaggactgctgcttgttcttggcacgggctctgacgcgcatgcagagaggaggaggcggaggaggacttgggggagaggtagagagaacgatcattagggctgggttgtgtgtgggctgtctcagctggcagaggggcacccagtccccgctgcgggaggaggttggagggctggcctgcggggtcactgcacctccgcccagagcctcctacctccagatccttcagggtagcagatgatgtagggccctccccgtggatacctgttgctgactataagagatgagactgcacatggagatgttctgtccccctcagtgtctgagccctccgacttcctttcttccccatcaactggcaacattttcttttctgcctatcttggaccctttgtcccataactcctttgtgccaacttctctcacggttcttatctccccaccatcccaccctgggggccttgcagtgactcctgatgggaagtggctgttctcattgtcctggcttccccttgagactggggatgaggaaaatcaaacagcaaagaccatatcctgggtgtcctgggtgttgacagcaggccatgtactagggattaacataaaatcgacaattatcaatctcattgaaacttcacaaatacaagtcaaacaataccacctctatcatacagacgtgaaaacagaggcccaaagagctcaagcaacttgccctaaatcatatccctagcagacggagaggcaggattcaaacccagaattcttttcttttttgaaacggagtctctctctgccttccaggctggagtgcagtggcgtgatcttggctcactgcaagctccgcctcctaggttcacgccattctcctccctcagactccggagcagctgggactgcaggcgcccgccaccacgcccggcttttttttttgtattttttagtatttcaccgtgtttgcctggatggtctcgatctcctgaccttgtgatccacctgcctcggtctcccgaagtgtggggattacaggcgtgagccactgtgcccggccaaatccagaatccttcaccagtacccaacagtccatccacaatcttaacgattgccctctactgctccttgggccccctgtccccaaaagcctgtccaggcaagactcacagcctcagatgagtggcaaccaccagaagcggccgtctcagggctactgccatttgctttcgtgttcctcttcgctgctgctggaacaccagggcggtttctctgccaatattctttgaactgtgggaaagaagagcagtaatactcatgagaactatcagcccctacagccacatcctcctttatagtttttataaaatactcttatataccatctgatttaatgacaccaacaactctataaggtgtcacaatcatttagggactgagagggatcgacatcatggctagaaaaaaagaaaaaagaaaaaagcgatactggaacttggaaactcagtcttcccactctaagctctggggttttgccaggcaccaaacccagaggcagaggtagaaaagtaaacattaagtaggcaggagctgtatgtcatgtggtttagagtcgtacatcttcacacgtctgttattgggaagaagtgcaccagtacctctcaaacttttatatcaatgtgtcctcatggcagaaggcagcctttctgtgaaatctgggaatttatcagaaagaggacaacccaagcctcatttcagagagaagtctggtatactcttagaaacctatgggactgccatccctaagtacattcatgttttttctcttatctcaagatatctcaagagaatcaaaggaaactgatgcttcagaaagatgtcccacatttatcctgtggtactcaaagcaccccagcttgagataatatgaggaagattcaaactgtcaagttcagtctcccaagatctattccacagaagatgaggaaatctcacttcagagaccactgactgaaggtcccagactgaagtctggtcccagaaccatggagaattagaatatgaggtggagaactcggaaaaaaatgttaaaatctctttggaaagtagaagcttgggagaaaaaccaaaccaaacccattctcccatcgccacccagagacactgtcaacgttttgagctcacgggggaagtgtaggcttttcccactgtcaatgtctatggtaagggagtaaggcagcctgaaacctcttgctcccaggtcccatagtctccatttcccttccagctggaaatttctgctgtgaccagaagaaccagaaacggggtgacaacgtttaggggactgggtcataagaccagggccagtcttccagtaatgacagttagtaggcagactgtgacatcactacattccactcctcctagtgcgggggagggaccacatcagcgcgatgtccgagtctccactccacaacgcgggagggaaacacagggttgtgacccaggtccttggagacgccagcacaaagagctcagggaggtcgaccttgaggcagcaggaggggagggcagagtctgcagcagggagccccaggagtcaccagcccaaagtcacccagggacaactggcgagggcggggcctggggctggggggcccaggtccttggatatgcgagcccaaagagcccagggaggtccaacttggggcggcaagaggtgagggcccagtaatggagtggggcgccccaggagtcacccgcccaacgtcaccccggggtgatcggcgagggcagggactgagctgtttgctgaaggggcagggctgactgacaagacttttgtagggggagcccagaagcgccggggttggggggcaaagtccggtgtgcgtcaggagtagtatggactgtggcagcggtcttgtcgtcggaggggatctgtggctgggttagcgggccatgacccggtacgtctttacctttttcttggctgcagctaatttactctgtccagtttcttctgccattgtggggtggggagggaggcggggctggggccacgtcagccaaatcccagcgagcgctgatcaacacatccagtcacctggaagacagctgcgtaactgacccagaggcagcgtaaccagggccacagtagaatgcagaataggggcgtggccttaatgcttcaagcccattggccaacgagaaagatgacagggaaagggggcgtggccaggcggcagtgtgtccagagggacctgtggctcatcaggaaagctgcccatgcaaccgctgtccccacccactctgagagaggggaggggccgcccgctctgggagagtggaggggctggcttttgctttaaaacccttaaaactttaaaaatcatatgtgtgtatactttatatatatgtgtgtgtctctctgtgtgtatccatgtgttcctccagagctgtcttcattaaccagcttctatgcaaggtctgtcattttggcctatatttttcatcttcaaatactgtataaaaattaccagtattacctgaactgagatacagatcctataaaagtgggaaatccacagcatgcttgatgattaatgaagcagactatattatccaacattccaatgagataaaataatcaaaatgatttcttttttggaaaaatgtttctcttattctcctacattgttgctgttttttctttttaaacaggaaacatggttaatatccgtaaaaacacaaagcttttgggctgggtgcggtggctcacacctgtaatcccagcactttggggagcccgagtctggtggatcacctgaggtcaggtagtggaagtgtgagccatcacacccggccggcttcatttcagaactctttccccagcactccatatactatgaataattcctttcttcttctttggatagcattttagtcatatctctattaccccacttgtcacatgataatcagtggctcacccatccatctcccttgattgctcatgagctccttgagaagagtctgattttcagcaccttgaacagtgtgccacacatacatgcttcatacgcagagaaggaaatgatttcactacagtgtaattattcccagaattcaatatctgtatttctaaattgttctagatactctgccaacaacctgagaatgttatgttttttccccaaaacttccatccattattgtgtgtctatggtcatagttaactcaattgtgacgtcacctttggacaagcccattaacagtttctttttttttaggtgatttttaattttaatttttgattttgattgtttcttttctgttttttaaatctagcagtgtttggtaaacttcaacatctctatatccccgtgtctctgccccgctggtctctgcttggaataatgtctcaaggttttagtcacctggaaaaaatttctactcacccttaaagaatcagaaataaataggctgggcatggtggctcatgactgtaatcccagcactttcgggaggccaaagtgggcggatcacctgaggtcagtagttccaagactagcctgcccaacatggtgaaaccccgtctctactaaaaatacaaaaaatagctgagcatggtggcagaggcctgtaatctcagctactcgggtggctgaggcaggataattgcttgaacctgggaggcagaggttgcagtgagctgagatcgtgccattgcactccatcttgggtgacagagtgagacatcatctgaaaaagaaaaagaaaaagaaaaagaaaagcttaaataataccttctctgagaagcctttatatcttcctattctttcaggaagtgttgaaaattcctcaacttttgaaacatttgtgcctctattactgtgtatcaggcagtgaactgagtgcccaggatagaaagatgaaactgtagatcctgcccttacggagctcatggtctagtatggaaaacagccatatgaacaaataaccacactataggtcttcagagctcaagtcctatcctaaatactgtgaaattaatgttctgtgaggttttgaaagtactagggccagagacaatatggctgcttggatgactttccatccaagttaacattcggccctcatcacaaagggaatacatgcgtgcatcttccttgcaacccaccagtgcctaacacatcatatcaccacttttgaaatcaggaaacaggctcagaagtccaagagcttgaccaaagtaactcagctggtaggtagcagagccaggtcagtatgattcttcttcaatatcctgccagccacatgggcaagtggcctcaaaatcaacaaaagacaggtagaggttgacatgcatcaatggagagaggctcaaaaggaggattttatacacaagaatagaacagaaatgttctggaagtatatctgtggatgtgaagcaggagggggcacaccaggtttcaccttggtcaagtgaatctataattccaaccggggcctcgccgccccccacccccccgagctccagacttagctatctgtctttcttactctaatataaaatccacagggcaggaccttaatctctagcttgttcacacagattaaagcagagtctggcttataataaggacttaataaatacatgaatgaataaataaactatcaaagaagctaaagaaacattccacattcttgcgggaagggattaccatgaaacagaccctagcagtcacttacaaatacagttgaccctcatcattggagtatcccatattttcaaattagcttacttgctaaaatgtctttctaagtcccaaattaatacttgtggcactttcaaggtggctcctggatagacatgcagtagtgaaaactctgtcactctttgcacacgtcccaagctaaggtcaaacagtgaccttggtctgcttgtttcaactctcatacaaagatgacctgaggacagagacagtagaggacactgcagggtagcgcaagaagctgtggctctggggccagttgggcggggtctgaatcataacactggcacctgttagtggagtggcctcagacaaatcacttacaattctgtacttcctttattcttttggaaagaaagaaaattcaatctaccaggatgagttgtttttaggaattaagatgataacctatatgacatatgtatttatgtacatatttaccctggaaacaagggtttgctatttgattaattcagtgttccaggcaactttgtagaatattactcctgcaaatagtaagaattggctgtaattaaagaaataacagagatgtagacaaaacaattatttgggtgagctacaggcagtcttcaagaagcttctgaagaaacagaacttcagcaggcacttaagctgtagaaaaggcttgcaaggagatagaacagcacctacagagagaggtccaggtggggtcaggaaatggcatttcaggaagtctagagcagtagaagatgaggccagaacacggcgccacagtgctgctctgcaccctctatacaccctgtactgcagaacctcactctctgcatttagttcttggtttctaattctctcttccattaaactgtgagcccctcaaggtcaaggtctctaagaagaaaccatagctacagtcctctaaatttgaaaacaagttattaaacacagatacacccaagaagaccgtacaaaaataatgttggatttcaattgcagtcatagaaattcacaactggtatacatttgcaatctgtccaggatttttctctgatgactgccgtaactctgtcataaacccttttcattatttgagacaccgagacatttgttagaatgtttgggaaagacattctaaaagggcaagaaagaccttgatcttttttgtgtaactgattgactggttgactgactgagatgggatctcattatgtagcccaggctggtctgaaactcctaggttcaagcgatactcctgcctcagcctctctagtggctgagattacaggcgcacgccaccatgctgggctctagtgtgatgtatttacgaggcttaaacatatggttcattacacaaggctggcacctcagagtaaagattttttaaagttcactctaatagacttatttctctatatgcaagatacaattttaccacagtaaaacacaaggaagcatactgatatacatatatgttacaacaggataaaaaaaagcaatataattttctccacaaaagcttgcaaaatcctggccaaaacacagtaaagaggatgttaatctcacagctcacgtttctccactgagacccaggaaaaacaatgccagtttttgtacagtcacaaaactaagcactgtgagaatttacaagatttggttaacttgtatattctccccaccctgacagacaagtcccaaaggagcctagcagttttaccccaacatttcaatctcctccaacctccaaaataaaaccctcactgtccaatatctcaatttatattttcaaacgtctaaaatcttaatcgaaacaaagagcagtgcattagctttgccgccatagaatgcttggtataattttacttaggcacatcacagattgtgctattgcctaaaaacatatgggtagaaccaacattcctagaaaccaaacgcatatattacgaaggtgaaagggaatagggagtgttgtttttaaacagatagaacgctgtgattgtccactcataggttaggtgtgatcaaatcacatcgtgctgtacagctaagtatgtcctatattgtatgacaaagtagggtaacacattatttattgaggacctgttgggtacacagaggcacaccacaagctgtaaaagacttcattcttgccctcaagaaacttccaagtttctagacagcctgatagaaggtagtcgaaagcaaatacttcaagcactagccatcacaattaccttaggtatttacgctacccttctacgagtctctgaatatttcgaggccccctttcctatttcccatgggctctatggctcaacattctttacagccacaggctttcctggactttacgttattattgaatcaacattgctcactatccgcctcctttgccaattaaaattccactttacatccaaccaccactttggctttgaagccactgcctgatactgacgctctgtcgatgtacaatgactattcttacacgtctctgtctactgaggaggatcctactcttttaacagaaacagtgccattgacttccaatcaactagtttccataatatccaaaatattagataatattccattatactcccaaaacaaataatgagtgatgttctctcaaatacacgtataatcaaatgtgacattgagaagatggggcgacctttgactcagagattgtattcaggcctttgtagatgcatttatttgacataattatgcatttaaaacataagttaaattgtcatcagcctgaaattataggggcttttgttggtgagaaacctattttatatataatcgtttacccatagaaatgtttttgattaatgttatctgttaaagacttcagttcacaatatttcccctgttaatagtatatatgtttttggagttgatctggagaatttgaggaccacgttctaatcgctatctgatgctattctgggaggacaattcattgcctttgggttgctgggggttggaacttgaaggcgggtctgagtctggagaccttgccactgacttttggaaagtctgttgattctacctttggaagtgcctttacatgccttatggaaggccgggcatggtggctcacgcctgtaatcccagcacctcgggattattgatgaataaatcaatttgggaaatgcttggtaaattcaacgggacctctcagaacaatgaatttatatggccacgatgttgttttctggtttgtttgtttttttgtttttgttttttttgcaaagagcattcggaagactttctagtacaccagtttgggaactgttggtggaggagtcagggtaattaggctttggactattccaggtacaggttgtcactgtattcaaggaattgttcttagtctttgtatatatccgaattaactatagcaaattaacaagcagaaatataagaattgggccttggagggagggagagggcgagagagaggggtagatagaagtttcctattttaactatggttcaattctaagcattctaaaatttcattggattcttttaactatgaattacaagggtgtttaatttccaagttcatgaagcctttggttaatctcttcattattaacttctaaccttaactgcttcatatttaaattatcaattttatggtgtggattgtaccaattgtttttcaatcttctgacgtgcttaatggattaatacataattaatgtttctcccacagtccacatatgcttgagaagaatacagaatatctgattattgggtacagaggtctatatttgtccattacatcacgtccattcacgggttattcaaatctatatatgggcattctgtgtaacttacttatggtaagcagggtatgttgaaatctccaaatacaatggcagactcgtcaatttctccctgtggttttatcagtttttcctctgtattttgagtctattttgataggtacataaaatatgaaaattgctacaacctcctaattaacagtcagttggcatcaagctgttactaatgctttgtgttccaacatcctatcttgtttgaaactgaagctccatcagttgttttggttaatgtataccggcatatctttctctctctctctcctttataaaaactttcaatcttttcacatcctcatagtttcaataagatggattagaacagctggatatcgttttattagttccatctgtctaactggtaactttagtccatttacagttgttgtgactcatttatgtggacttccttctgtcacctttagaacttccatttctctcactttccaatataattttaatatctcctcctgggattccactaagacgtattttagacctcattctgatctccctctccccgccaaccccaccaacttctgccctgtcatttatcctcatatctctctgtgtaacatatggacttactttttggagataatggtctaaccaattaatcctttcttctggtgtctaatccatccactcggtttcttatttcaacaattccattttatatttccttatttcattttattctgagacagagtctcactctgtcacccaggctggactgtagtggcacgaacctgcagccctggcctcctgggctcaagtgatcctcccacctcagcctcctgattagctgggagtataggcaggtaggtgccccatacacagcttttttcttcttcttttttttttggtggtggtggggtattttttggagaaacgagttctcaccatgctgcccaggcttgtctccaactcctgggcttatgccatcctcccgcctcagcctctcaaaaagtgctgagattacaggtgtgagacaccatacccagctatatattttatttctgtaagttctatttcatccattttcctttcaggtcttcctcatcattcctggtggtcttactgctcctgctcgctcaattttatgagtccatctttttcttatataatacatttatttcacatgtaactattttctcacaattctaatatttgaagtctgtattctgtatctgataattccaaaacctacagtctttgggaaacattcattgtttctgataattctcaaatatattgggttcactacttgaatgctatgatttcactgaattcatagttgcctgcttttaatctttgggaatcctacaggcttaagttagagatggtttcctagaaaaagtatctgtgcgtgcttctgatgagagctgtggggacaactaacaagagacccctttaccaccgtccgtaatcctgatattctcttggattctcctggagaatgtcaggattacacaaggttctcaaatttggctccccaaccttgctcatttatatacagaagactagactgcttagtataggtgatgactcacttcctcctaccctggaaaaaacaaaacagatctctcatctgaatgtgatcacagactaggaaattctgaaggtgaataactggaggctgtaggcagcagggaaagacaggtgtctttcctgaccatagaaataggtcacaagctgccctaaaggctgtgtgctccaccaggatttcactatttagctcaaccagcagtccctctgtaagagtgaacggaagcttcttagagcaccacgctgcctttaaaccacaaattcttgctaaaagtcatggtcatggtaaaaaacctatggctttgcaaggctttcttggtaatgtcctagaattaaggttaagcctgcgtttcatggtaactgaacaggaaaccagcctgaccaacatccttctccccaatggcttgctctcagctcctcttgcttgggccttgggcagccagacggtctggttttaatccttgctctgccacctgtgaccttggacaagttacctaccttcagttacctcatccacaagatgcagatattagtaataccctctttttaagttattaagaggattgaaagagttaataaaaagtaaaaaaaagacttggtaggcataggcacagaggcgggaaaaaagcaataataaagaaatgatacttctatattttctatagatcatctttgtaacaagaagaaaacaaaccaaatgaaaatgaaacaaattctctcaaaaagaattaagtcaagacaggcagaaggctcacaaagtaatataaaatatatcttatggtttatggaaaattcttaataaaataccttctttgctccaagctgcactctggctttgcctttgagtcacgtggcatttctttgtacgatgaccggttctgtcgagtaggcactgcttcagccctacaggaaggaaaaaacatctctagaaaacagcagcattcctgattcccacttgaggaggcctaacaaaacggcatatgcctcaacagcagcacatcagtgttaaaaagtctggagtcaaggggaaaaagtaaaattggaccatttccagaatctcaccaaaaacaacaaacggatgttgcaagtggcctacatgagcaaattagaaccttaaataaaggtcactcttaatgcctatcccagcatagatgcagcaccaagtacagtgtcattttactgggttacctttttcattcttgaaagtaggagctatgaaaaaaaaaacactaaaatttcttgaagagaaccttctacttacaacctaacttacgtaatcgaaacactctattgagggtgaaaattgagtattataagaaaataatcacctgttttgtgagaagttcaatacgtaatgctcctccacacaatacataccttagaaagaaaaaaggaaacatacaaaactatctcgagaattattcctgcttaaacaatttctacatgccattactaagaaagtatgcacacagtaaacatgagaagagaacatgcaagcatgaacatacttgttagggatacaggactatgggtaacttaaaaactctgttggtattactctcatgtaattgctctgaaattctagtcaactatttgcaatggctcttagaacagaatactttgaatttttatgatatcaaaaactaagaacttagccaagtattcccaagaataggaatagtaagcatacttagtaagtattccaaagaataggggcagaagaacgcatttctttaaagcactacctcagaattcaatttagtaattccgatgctgcctgtaacatcagaaaacaacttccttaaaaacatagcaagttggatttaccaagttgctgaccaggtcgcattccctcctgccctcaatcccatctttgtgttatactttatctccagtaccattttgcttagtattcatggtgctcaagttgtcactgtggacatcagagcctataaatatatattgttctggctccttcctgtacatctttccaagtcatacctgctattctccaaagtctgtgaatcccgacactaataacttggaaattcagtttaaggtcctcttcagaaggtcagttagctcaaggcatcacatttttctcaggactcttaagaaatactccaaccacagaaaaaggcccttctttctggtatcaggagccattggccacaaacacaaatccaatagagtttcagccatttacctcccacatcgtcccttccctgaagttctagctaaagcaggaaaaaataatgaaaacaccacctgcagtcacgaatcctccagtttcctggccaagatttcgtatttccttcaagatacctcccaaagaggacatgacgagggaggggcacacagggtgctacaggtactgataaggttttatttcttttatatatatgtattttttgagacggagtttctctcgtcaccaaggctggagtgcaatggcacaatctcggcccactgcaacccctgcctcctgggttcaagtgattctcccagctcagcctcccacgaagcgggggttacattacaggcgcccgccaccatgcctggctaatatttttgtatttttagtagagaaggggtttcaccatgttggccagcctgctcttcaactcctgaccgcaggtgatctgcctgccttggcctcccaaagtgctaggattataggcatgagccaccacgcccagccaaaggttctatttcttaagtttggtgttgggcatatggatgtatgatttaatgttttaaaaaaggaagataccttcctagtttttttgtgttttgttttttttgttttaggcctgcgtgctttattcgttaccccgtatgaatccataaagaagtagccattagcaaattcaggcaatacataccggattcatacttcaggaagacaacccagttgacaacgacaacagtttctatgataacaaaagtgagagaaaatactgacattagggtcatatcaagaaagttcaatcataagatatatccacaagcaaaaatatacacacaaaaagctaagtacgaagcttttagaaaactactaccatccttagagtaagtacaagaaagtattcttttatgtctgtttttttcatcaaaataccgcatatagccatagattttaaaccattacatcttatctagattccattaacatttcttctagatcactaacatttcttctagattccatcgttattcctttgtaacctttattttcagtatcttaaaaatactttattaaatataacacatacattcagaaagttacataaaatatacctgaaggtataccttaacaagttattgtaaattatttgcccatgtaaccaccaacctggtcctgaaatatattccagccagtatccaagaagcccacagatgtccctttcaggtcacacatccctacctcccacctggatggactccttcccctaacctctatgtgatcacctctttgttcttaatagttttactgcccaagtatgaatccagaaataagtgtttctctgttttcttttcacttttgtccccctaagaagcctttttagaagttttcttcctaattctatccccactccccatggaattttaacaccacagatatactgtatgtcggtttatgttatacggccctttggagggcagcagaccattataataggtaagattttctttcactctaaggaccaattttcactccactgcaggcgatattgcctccactaagaatgtatgccctaaccaacattagttttccctattgttgaactctatatagaggaaattgtacaaaataggttttggggctctggtctctttcgcttaacatagtgttcaaggttcgtccatctttcccacatagctgtaagccattttatgaataccacaattcttcattttcttggaatgaacacctgggttactttctgtttggggttatgatacatgatgctactctgaacattccggtgtctcctggtgcctatgtactcatttcttgtggagtatatatccacaagattcctgaaccatagtgtatgagtatcttccactttaccaaattgttttccaaaacacttgtacaaatatacactcccattagaaaaacagagtcccgtaacaattttattaccttaaaagataagttaagcaaagtatctcctatgccttctttttcttttaagatctgaagatcactgtgcaaaggactagcagggtcaacccgaagaatcacaaaacaaaaaacagttcaaacaaaaagatatttttttttcaactaactcaaaaatgaaccaatctgaaagctaaaatagagcacctagggtaagttcaagaaagagaagatcttaagctgctctatatcctcaggaaaaacagaggtcactatagcttccagctcctttagaatgaatgtccaaaagagatcataatagcctaaatctaatctaataagggggttcagagtttgcagtcattctaaaggaaaacagtcacatgtatataattttctcaagaattcaaaagaagtttaatatgctttcctaaacttgtattattagtcaagcagttcaaggagaacaatttgccatggacggaactatgaaaagttaaatcactaaaaaatcggtatttttccacaactgtcctatatatagatttctaatatgactcccatcccccactcccttttcgtttgtttgtttgtttgtttgttttaagagacaaggtgtctcgctctctcacccagggtggaatataatggtgcaatcacagctcatgtgcagccttaacgtctccaagctcaaaagatcttcctgcctcagcctcccaccatccatagtagcttgtactacaggtgtactacaccgacgtattttaaaagtaataacataactacatctacaataagagttaattatattgctttcaaaactgggggaaaagtcataaaaatcaacttggcaatcattctctgtataatgaaatatattactcttgtttactttccaaccaatattattcaagcttgagctttttcctagaagataaaaatcaagcaagagttcactctatcaagaaaatgacaaaaaaatttcgatggacctataaaaacatttccaacactcaacatttcaagaagtaaaaaaaaaaaaaaaaaagtccaattaaatgaagcattatgaagtttcaagagaatataaaactagacacaagtctggttcgtttcctatttcttatcatctgaaaaactctagccaacatgttcagaccaccatggactccatgatagcacagaatttagtatgagtctattccaaaccccagcaatttttgaaaatgctagaagacactcaaggtgacacattactgactaagagagacttccattcataagactacaagcaagaatattacacagatggtctagttcacacattgacacactgagaaacacgtgtacctacatgcaactggtttcagtttttcagtgtggggacttctctaaagatgaaaacacatcgatatcttatcctaagactaagtagaaatggaactactttttagtcatgtgaaactaaaggttttaaagactgcactatactttgaaaaagaaaaaaaatcaagtttacgaagatctcacttcctagatatgtaaccatgacctcatttcctatctataaaatatgagaagtttctcctatctctaaactatgaagagcacctatttcacacagcggctatgaagactaaatgagagcatctataaagtataaagtacttaacatagtatcggtcatgcaaaagtgttcaataatttatacttgttttgaagataactcaaactggaatcgatcacaagacacggaaagtacagtaacattatttcaaatgctacaaactcagttttttaaataagatatgagaaatggactaaatttctttcctctgggaaaaattactaattaaattaatatataactaagactgaaggagggagagtaatctatctggtttcaacacttggcatctacttgcctaacaattcattccctgttttggagaacctgtgcccaagacaaagtaactggtcctcggctttcatggagttggtaaatagctctaatacaaggcaggaagtagtaagtgttcagacaatcatctgacgtttccctactctgtctgagcatttcatgtatacacacacatcattctcattgatttttcacagcagtcatccaaaaggtatgtactatctatccatactttagagttgagcaaagtgaaaccaaaaaaggtgtgtttgtcaccacactcagtgttcctttcacatcctgccacttcacataaaagagatgttaagtcaaaagagaagaattagttttgatttggtcagagcaggatggaccaaagtcaccttcacgaaggagaaataatttgagttgtgttttgtaggagagaatgaatgtgaatatacagatgccacagaaggaaagtaagcagagaaaacagcataaacaggctggaaaggggcatatacagggatcagcaggtggttccaggatgtgaacagcagatgaacagggtaaaaagtggctgttcatagatgagaaagataaccttgggcaagagaacatatgaccgtggctagggacggtggctcatgcctgtaatcccagcactttggcaggctgaggtaggaggatcgcgtgaactcaggtgttcaagaccagcatgatcaacatagtgagaccccatctctactaaaaatctaaaaaatcagcctggtgtggtggctcatgcccatagtccaagacacttgggagggtgaggcaggaggatcactggagcccgggagatcaaggcttcagtgaactatgattgtgccaccgcactctagcccaggcgacagagcaagaccctgtctcaaaaccaataaacatgtgactgaatctaccactaaggcaggaatggaggagagcagctgagattggcatgttcatgaattgcctgggattaactataattacttaaacaaaaatccaggctctagctatttatacacacttacgcagttaaatgctcttgtctttcagtcttcctaatttctctaatattgccaaattttctttttcaattccttcatcctccaactttttcccactaatgggctctgctttcatctcgtagtgatctaagtcttctatatcctgcaaaaagaagaaaaatgttagcttattcaacctatttttcttcagcagtttcttatgccaaaagttaaattattcttgactcaatgggggacaagaaacagaatatatctatcctacggggagagaggaaaagcccccacattccattcaagaggctcccaccttctatatcctacattttatttaaaagctacactctgggtaaagcagatttcaaagctttacaaagtcataactattaagaaataagccatcatttatttatttacttctttaatttttatttccttttttaaaacagagtctcactctgtcacccaggtgggcgtatacaggggtgatctctgctcactacaaactctgcctcccaggttcaagtgattctcgtgcctcagtctcctgagtagctgggatttcagacacccatcaccacgcccagctaatttgtgtatatttttagtagagacagggttgcaccatgttagtaccagcctatctggggctttataaagttaagaaaagagcctgtatgcatgctgaaggctgtgtgaccacagggcttttaaaggatgcttctgtgttcccacagttaggtgggagctcttggaaggatctcttttatcccagtgctcttgctaagaatggaaagcccctctgcataactgcagtagctggtgccatcctctgttcacttgcatcagagcctgggaggttgtggtctgcaaagctcacctctcataatgggacgccaatcaatagtatccgaagttgatatacccagaaagagagttcaaaaattatttagagaggtggaaaataatcaccagtagaattaaaatcagaaacgacaaagttggccagcggagtggggaagtccagattggggaatgtgatgtttcattataaggtctttcagcatttgcttgctttggtctgagtgaaagaattgtctcatttttttgagggccatgtacagcaaaggactcaccatctgtcagacacactggtcagttctggcaaggcagagttggaggttcctgtcctcaggtgggtgggcagggacggcagcttgccgtaaggtatccaacagcaccagcggcaggaaatgaaaagtgctcagtgattggtgggatagtggtgtctagcacaatgattcctgccaaaatcttaatggtggttgggcatagtggctcaagcttgtaatcccagcactttgggaggccgaggtgggtgggtcacttgaggtcaggagttcaagactagcctggccaacatggtgacactctgtctctactaaaaaaatacaaaaattagccgggcgtggtggcacgcacctgtaatcccagctactcgggaggctgaggcaggagaattgcttgaacctgggaggcagaggttgcagtgagcaaagattgtgccactgcactccaggctggccaacagagtaaaactccatctcaaaaaaaataaacaaataaagccacaaaaacaaacaaacaaaaaaacccaatggtgtgcaataaatgaaaatgctgccccagtcagacgggactagcatttttcagcaactttcaaggtcttgtgtcacaagaatgaagatccgagtatttcccacctgtggagggggctggtgaaggagttttcagtcccgggcaccctgggctgtgctgaaagcctctgcgtcacactgcgtgagttagctgggaaagagagctcccactgttctcttttaacccttgtccttttgtaccacagcaattgctttcctggagatcagaaccgtggctgggtttaacatcatctttggaaatcctaaaaggcaatgaagcaatttttctcttttcatttatatatttttttgatacagctgtgtcagtttgaaattttactttcgtatcagttctaatagtgtgtctgcttgacatagtttctattaaatgggcttgatatgaagttacttaaaaattcaagtatttagagtttcagggcccatcgtcttgatttttggggcaatacctcaatttcatactgtgttattcttttccagagagatgggtcactgaataacttacattttatgattgttttatgagaaactatttctggttacaaatggtaaacatctaggttttgcagtaagaaataatggattatgttagaaaaaaagaaccataagaagatgtgtttttaattttgacttcctgtaagtaccttctggagcagaaggttttctctttgtggattctgcatcttggatttggggactctgttgcactgagctgtgctctgtggggaggagcctgtggcagaacagtttgggttctgctggccgcctttccctctattcacggagtctgggtcccagagaaagatgacagcagttaggtcttgttgggaaaaaaacgcggctaccaaccctggaccattttgcttcccctgaacaaataagatagtcatttgcctacttttggggacggtgcctgtgctttgcacaggacgaggtggcagctggcttgcctgctggcctgcttcctggagataggatgctcagacccaccgctgctcttcaggggtcgtggaaggaattaatgcacttccttctgtcccccaatctctgtccctttacgtgtctctggagctgagcaggtattctttttctttcttcatctcagtagagctgttaaattaaatagatgttgcttaagccattcagaaaggtttcacattttaaaaaacaaaaggtagctgctgccatgattcctttgcccaccgctacaccgtgtcgttgtaggacagtccccacttggctgtgctgagcctgtctggaagtgtttctgattctaatcagaagtggaacagtttcagtgcagactataggttcatgttagtgatgaacttgggtggagatggggacacagcttgttctttcctcctggactctcatccagggtcctgagctgccaggggcctggccactctcaccctgagccctgccctggctgagctgatcaccgctgcatgtcccagctgccggtctgcctgtcacctgcagtgcacatgtgtgcatgtgtgtgcatacgtacatgcaccacacacataccatgcccacctcatacacaccacacacataccccatacacaccacacaccaaccacacacattacacacactgcatacatatcacacaccacaaacactacaccacgcacacaaaacatacatacacgctcaagccttccacactacattacactccacacacaccacacatcacactccacacacaccacacgcacatatcacattcacatcacaccacaccacataccacacaccatacacagtacactccacacaccacaccctccaggacgtcccaccaccatacacacacaaacaccacacacccacaccatactacacatttaccacatacacaccacacacactgtatctcatgaacacaccacacacccccgccacacacatttgcatgcaaactactcattgaatgaaaccgaatgatttagttttccccaaattaatactgcctgcctgtgcacccctggctgtcctggccggcacatcccccggtcctgccctcccttgggtcagcaccgcctcctgtgtctcaggtgtctctggctgtgccctgtggcgtgctcatgtcctgatcttgtgggaggctggctcctctgctccagtggctgccttcctagaggagaccagcttgtttgtcacctctcctgatgcccagagcagcagcccacgggggaagtcctgcttcctcccttcgctgtctgcccttccccacaggttgttttgtctcagtgctgatatctccccagctagaagaggagaccctcaaaggtgcacaggtggatttgattataatgcaggtgaatattaaatgcgttttggtgaaacactcaaccactacatacatctttaataaagtaaaatgtccaggccccctctgctcccacctctctctcccctcccacctctctcccccctcccacctctctcccccctcccctccccagaggacgtggctgacaagcctttgaggggtttcccctttctgtgtgcctttgcgtgtatgtatgggctgggcggtgtgtgtattctctagacatcttgacggacctgtaactgggatctacacacgtgcgcttgctgtagctcacttgccattttccctcaaaaataggcctgtaaaatccctcactgtagtacgtgttgccctgcctctttaaaaatgccaccaactcttccagcacgtgaactctgccgtcatttttttaaacattctcttatttatgggtacttaggttgtttccagttttttaagagattgcggcaatgaaaatcttcagctatcatttttcacagtgctgtgggagaacgtggttggaggtgctgtggcggtggagtggccccacacgtggccaggctttgtggggttctgactctgtccttgccaatgttcctccacacagtggctgcctctggggaatgatggctgtgtgagcgcccgccatgccccaccagaagagtctaccatggcccaccggaagcgtctaccatggcccaccagaagcgtcagagcgcggggagcagcatgttggaccacagggcaaggccgggtcctgtcccccaccaccaggagcccgagagcgaggacgtggagctgcccttggaggactatgtgcccgagggcctggagctggtcaccctgcggccagagagccccacgcccaagaagcaggagtgccacaaccacagccccgatggggactccagttccgactacgtgaacgacacctctgaggaggacgactatgatgagggcctccctgaggaggaggagggcatcccctactacatccgctactgccctgaggaccaaagctacctggagggcatggactgcaatgggcaggtgtacctggcccacggcgcgcatcctatggacactgacgggtgccaggatgcagtggactggacggcctgggcgggcctgcacccccatggtcacggggctaaaggtagccaggactaccctgatggccaactgcccatcacggaggatgtgtcctccgtcctggaggcccacgaccaggaagaagacggtcactactgtcccagcaaagagggctaccaggactactaccctgtggaggctaacgggaacaccagcgcttctgcctaccccctgaggtgcggggacggggacctggaggaccaggaggaggacatcgaccagatcgtggcagagatcaagataagcttgagtatgaccagcatcaccagcaccagtgaggccatccccgagcatggacctgagccagggcctgcggactctgcagagggctgcccacccatcaaggccagctgcagccccagcaggcaagaggcgaggcccaagtcgctgaacctccttcccgaggccaagcaccccggagacccccagagaggcttcaagtccaagaccagaccccagaagagaggctgaagtggcctcacgagcaggtaggactctagctgtcccggggaagggagcagaggggccctagagcaagggacctcagggtacaggcctcgcagatgctgaagcgaggcggtggggggtgctgggtgccttacagttctaatggtggctgagctcttcattggtccagttgggagacatgttgcgtggatgctccggccactcttaagctcaccgctcagactcaggactaaagccggttgagggctgaggggcaactcgtgtctcgcagaagacacccctcctcccaccctagaagacaggttcaatttcttgcccactgccctgggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtgtctgaaagctggggggccttggcctgacgggcaatcagctgtgaatacctatttggaaaaggattttttgacggtgtgacaaaacctcggggaagaaacgcatgctaatgagggcagtggatgtcagcataactgtattttaattatagcaaagtcagcgtgcattctaataaacacatttgaaaagccgccttccaaaaaaaagcctcactgtgagtatatattatagaagatgtgattattggactcgggtgaaggaacttctatttggccaattatgtggactgctttcatattttttaaagctttaactactatttttttctgagaagaattcatgaatgtgtgtgtgtgtgtgtgtgtgtgtgtgtgtgtgtctgtgtactgagagcttgggtttggaatggaaatcatattgactcctggattttcagcacttgtatcttaatgtcttgtcttctctctagaacacattgtgtcagttgacttcactttggggctgttcctgtcattcacagcaattctgtgtttacagggggctgtgggatgcataggaagtcctatggtgatggcaggcatgggaattttaccccaagggactatggtaatagggggctgaccaagaataactcctaatcctatgtcacataataccatgagcagctcaggaaaactacgcacaactcagacatgtgcagaaaggagatgtggaatgaaatggagccccctggccttatagaggcctccaagacctgccacacccacgtctgcccccaactccccagtcaaccttcagagaagagaaggtgatctctctccagctgagaccaagccaaggcccaaactgttgtagctgaaggatgtttgggctaggctcatagaagctgttccactcctgcagtgtcaacagctgcctgtggtccaggcttctgtctggtcctgggtttttttttttttttttttgagatggagtcttgctgtgttgcccaggctggagtgcaatggcgtgatctcagctcactgcaatctctgcctcccgggctcaagcagttcttctgtctcaacctcccgagtagctgggattacaggcacccgcaatcatgctcggctaattttcatatttttgtagagacagggtctcaccatgttggccaggctggtctagaactcctgacctcaggtgatccacccacctcagcctcccaaaatgctggggttacaggtgttagccaccgcactcagccttgaagagacactgggccttttaagagacactgggtgctgactcacttctgggtctgccccatgggtggcccaccgggtctgctctgggtgcagccaggctgtgcacgtcagggagcctgagctggacttaaggtggggagacatcgctccccaagagctgctcgggtgcgacatcagggtggaggctgttgctgtgtgtggcggcatcactcatttaccctcgtctcatcagcctctgtccttcggctcatctgcttgcaggtggcctctgattctgcctctggagcctgtctgccccctcttgattcattcattgggtcccaaatatgtgaacaatagcatgctagccacttttagaaatatttgtgttcatcttcaagagaggggggtcatccagccattccccagccctcaaaacccactccacagacaaagcagtggcgggtcagggctcctcttgctcttctgagccgctggcatagcgaacacggtacaaaagaaaaggatttcacatgcaatagaatttcattcaccctgaaaagggaaggaaattctgacacaggctacaatatggataaaccttgaggacatcctgctagagccagtcacaaaaggacaagtactgtgtgattccacttctctgaggcacccacagtagagtcacagagacaggaagtagaatgcgggtggccaggggctggagagagcagggagtggggagctggtgtttaatgggtgcagaggttccgttgtgaagatggaaaagttctggagatgcatggtggtgaagacggcacaacagtgtgaatgtacttaatgccactgaactctacacctaaaaatggttaagatgataaattttacattatgtatatttaccacaataaaagaaataagaaataaaaggtttttggatgatgaacgggctcgagccaatttggaccctctaaagctaagttgagccaggctgaacccatgtagccagaatcatactggattaggctgttctagcacttcacgtggtgagaatgggggagagagagagagattgattgatcagggggctgtgcagggggcgtgctacacacttgtaaacagccagatctcttgtgaactcagagcaagagttcacctatcaccaagaggatggcccaagtcattcatgagagatttgccccatgatccagacacttacctcccaccaggccccaccaccagcattggggattgcatttcaatatgagattgaggtggggacaaatatccaaactgtatcacccacaaagaagcaaaaacattttgggccaaatcaaaactattttgatgtagccacagtagggatgagctgtgattacacccattcaggcctgtggacctgcggacctggcgtgtgtggtcgtggggcggtgggtgggcacatccctgggaggtttcaggaggacattcaagaccaaaatgagccatgagtaaataatacaaccacatcctgagtgggagtgggggagcctccccttctctcctaggtcttgtatgggtcatgatcccaccttggcaggagtggaaggaacacagatcctacaggttgtggcttatagtaaagtgactgtggtcatgccttgtgagtgtcattaaaataaacagatatcgttaaatccactatcaaataacagcgatttctgctatcctttcaccttttccacaagtttaaatatcccagatattctactgtgtatattcctaaaagtagacaggtagatttagtgaagttaactggatcattggtatcttctttatagatcatctggtgaaacttgttttgcaaattatgagttgtaggcctttgttttaatgtctgtagccttaggcagttccattgagactaactcagtttttttcttattaggactaatcttattgaccggaactgtggactccccgtattaggagaacagagatctggcctgtgtaaatgagtggaagttaaatactgtagaaaatgccctctggaaactgaaatctaatgctgacttactattggtcatttaatttccttctggcttgggcaccatcgttacattcatttttcagatgtcaagctagttttctcagaatgtgtgcagggctcgaggccgagtgtggaggccactgggtgaatacaggagaggtcacaggtcaagcctcctgcgagaactgcaggcttgagccttcgatagagccacgtgaatgatttttagccccactaggttgctgtcattaaactatgcacacagggcttcttgcttttaagttagcaggatggaaaaattgcaggtgtttgcagcaaacatgaagaaccagccatgctggcccctaagcaatggtattacaaagggttggtgaagattttctcatttgagaactgaacaaaaccaaatggaattctccctagttctgcagctctgggggctgtaagcggcggagcttccaccttccctacaaacggacccagagtggcacctggtatgtgaggcaggtgaccaggagaagggggtgtcagtggttgatgggcagctgcctctgctgcctggttgacccagccccttcctgggtcatctcccactttgcctgggtgtcagtcactggagggttagcgcagtacaagctggcgggtgacctccgtagagcttaggtgaaggggctctcacagggcagtatgtttgagacccttagagggctctccttactcttgcttctcccattatttttaaattgtagtaatacacttgtaacataaagtttaccactttaaagtgtacaattcagtggcatttagtacaatgttgtgcaaccacctctgatatttagttccagaacattttcactgcccccagaggagaccctgtacttattaagcagtcactcctcattcttccctctccccgcagcccccacaatgaaaaatctgttttctcactttggatttgcctattccggatattccataaagacgggatcagacaatatgtgccctttagtgtctggcttatttcaccaacataatgttttcagggttcatccctgttgtagcacgtgtcagtacttcgttcatttctgtggctgaatgatattccactgaatggctatgtttttattttcatttttactttttgagatggagtttcactcgtcgcccaggctggagtgcagtggtgtgatctcggctcactgcagctgaagggctatattaagtttcatttatccattcatccactgagggacatttgagttgtttctaccttttgattaatgtgaattctgctgctgtgaccatgtgtatacaagcttttgggaaattttatttggctagtcgtaactttaagttttgttttggctatttattgttgcttaaccaattatcccaaaacttaatggcataaaacggcaaatttgtctctctctcactattgtatgggttaatgggctagctggacagtttttctgctggtctcatttggcagctctcactgtgcagttagacagtgtcagggactggtcgtctggatgctcagctgcagtggaacgtctgagacggcttcttcacccacaggtctgctgccttggtgtttcttcatgtggcctttctacatagcatctcatactcttggccctcttcatgtagcttctctttctccaagaggatagtcagttcttctttttggcttccagaagcacaaaagtgcaagctgtcagatgttcttaaggcttagacctagaacaggtccagtttcatttctaccacattctataggttaaaggaagtctcggagccaaccttgattcactgtggaatgggcccttccgaggacctgaatgacaggagttgtggctcattggggaccaactccaaagatgaagcctgagttctgagaactttttcttctctgattactccttattcatattttatgttttgttttatagatgtaatatattcacaagtgtctttaaggagctattttgatactcttttgtcctctccctagcaggtcttttttctttaataatttttttcttagtttattttggtcttagttttctttcaaaagcctttcccaaaatatctattctatgttgctcatcatttgtcatcttttttaaaatgcccccttttgttcattcatatttgagagaaggactaaaagactgactgggaggctgggtgtggtagctcacatctataatctcagtgctttgggaggctgaggtgggaggatcacttgagcccaggagctcaagactagcctgggcaacacagtgagacccccatctctagaaaaaataaaaattagccggatgtggtggtgcccgcctgtagtcccagctactcaggaggctgaggtgggaggactgcttaagcccaggagattgaggctgcagtgagctatgatcatgccactgcattccagcctgggcgaaagagtgagacattgtctcaaaaaataaataaataaataaataaataaaaaagaagtttgggagttctttctggccaagacttgtcaactgatagcttttaggggaaagggtttttagggggaatttatgctgattcccaattgttatccccacccctctatcttatctctttgcgcaatcataaatgatggcaggaactactccattcctctggaggtgaaatctacgttctcttgcctgaggtagatacatgtttgctggggttctgcttaaggaaatgtgggagaacaatgtgtttcagggcctggaaaatgtgttctgtatgtaggcttttggttaatctgttttcagtcttgcctatcagtcccactctccggggtacctggtgtcggagtctagtgcctctgcagggtactgtgggacaaattagcctccttgttatcggtatccccctaacctccacctttgtttgctttgcttcattaattaaccatttcccatttactgtcattgtctattggaggtgaattctcttctcttggtaaccccatccctttttttttgtaattgtgtgtgtttatacaatctttattcttcactgtaattcccatggagcctcaggaaaaagagcagatgggagaaatacgtgttcagtgttcagttttccttctgtaagacacctgcaacctgtgtttttcacagaatagaccatggacttaaagcataaagagctactttgtttttcatgattgtgccttcaattctatgtagaaatataatctgtgaattacctgatgaaattttcctaattttgaatcatccttgtatttctataataaacactgttagaatgcatacggtagtgttttatttttgcatttttacttttatattaaataagattatagttttgtttccttccttctaggctcttatttcatttccgtaccaatggtatgcagggctgacttgggaagcttacatgtttttctaagatctaggatgtagctctagtttacacagtaattttcaactgaaggagatttttgccccccatgggatgtttggaaataatctggagacattttcggttgtcacaactggtcatgatgggaggtgctattggcatctcttgggtagagggggtgttactaaacgtcctacaacacacaggagaaccctccacaaattgtctggcccagtatatacacatcgctgaggctgagaaaccctggtttaaataaatgtccaatttggagagtgagtctttgactgccatttttcttcttctatgtgttggtctccagatttcccactttttcagttagttgtagtaactgtagattctttaaaaaaaaaaaaaaaaaggattgcttcatctttacttctaggctgctgtaaagatgtataaggttttcactttttgcatcatattcacattagaaacagctgagttttggagggaacacattcaaacggtagcaaatttagtagagcaaattccaaagacattgagtctaggccagttgtcagtcctgggtataattttagatgttttcaggctctgaagctttccatttaaatgcaaatttcggaacaaagatctgtgtctctgcactgaccaaatagaaggtatgtgaatgttatggtcttgattgttttacaagattttttctgcaggtacttttgcaagtgtgtagggagagatgagaagttccaaggaaaagggtgtgaggtctttggggccagctttgagctggcaaggctaaattataggaagaaggcagagaggtgggcagagaccagatgtgggaggacttcctgtgtcatgccacggagtctggactccaccctgtaggtgacgggagccaagacagggcttggcacaaacacatggcacatttgtggttaagaaacgtcttccttgcttccttgtggccttgagggatgaattaaggggctggaaaaccgggagcaggacggcctgtgcccatggttcaggtgagagccgggtgggtggcaggggctacggagaaggcggttgagtttagccccagttcccaacaggtgctgtggggaggaagaatttccagctgccaggtcagcctcttagatccatttctctttttttttttttttttgagacggagtctcactcttgtcgcccaggctggagtgcaatggtgtgatcttggctcactgcaacctccgcctcccaggttcaagcaattctgtggcctcagcctccctagtagcagggattacaggcgtccgccaccacgcctggctaatttttgtatttttgtagagacagggtttccccatgttggccaggctggtctcgaactcctgacctcaggtgatccacccgcctcggcctcccaaagtgctgggaatacaggcttgagccaccgcgcccggcccttggattaatttcttcatgcttaaaatgaaggaaacgtgaatcattgataaggtgtcccctctttaacaaagcaacagatggtttatcagggcctctcttcgcaggcagtggggcctcatccacaaccctggaaaagaactggaaagcgttgctcagccaggtacggagggcagggccatgtgggactcccgtctccaggccccctctccccagctcccgtttctttctttctttctttctttcttttttttctgagacggagtttctctcttgttgcccaggctggagtgcatgttgctgtgcactttgagggcaggaactggctcctgctccagtttgcatcctctgcgcccggcaccaggcccgtctgctcaatgcaggataagcaggtagcttcgggctgtccacccagcccttgcagagggtggagctacagagagcatgagtggccaagatgaagccctcattggattctttgactctttctactatgtgagatattcttgatgtctgagggatgaacggcaaacaaagtgtggcctacccatacaatggggacagtagttagccctaagaaggaaggaagttctgacgcacgctacaacacaggtgggccttgagaacgtcacgctaagtcaaagaagccagttggaaaaagacaaatgattgtatgatttcactcacatgtggcacctggagtcgtcaaattcagagacagaaagtagaatggtggctgccaggggctgggggaggcggaaaggggagttagcggacacagagtttcagattgcaagatgaagaaagttctggagatggatggtggtgatggctgcacaacactgtgagtgtatttaatgccacagaatcatacacgtagaagtatttcagatggtaaatttcatcttttgtgtatttaccataatttttaaaaactaagaaaattaagatatccttgatgtcagatgccaggagagcggtgtcaggcatctcaccagccgattctcccagaagttttcctccatcgggtaaccacgagcctggggtatcacaaagagaagcctcagtgtaaaatcaacaatctcagtggagtggcttcatcagggagtgacaggggcgtgatttactactggaggacaaggcagcaggcagggaagatggcccaagcctgctttgaactgtaaggagcacgcagaacctcttatccagacccggagggctgccctgttgacagcacaagcagctcagggccagcggcgcaggaaaaccccagggtccagccaggtcacgggcacaggcctgcactcacgggtcactgcagtgaggatggaggtgtcactgcaaatgcgtaagaggatattttcagcaatagtaaaatttttaacagattttagaaatgaaagggttccccctgcatatgtcaagaacctgagtttctttctgaaacttgggtgggaccctttagagttgcttcaaatagaaaacacaccatcggcggccactcccctgaggaaaggcagacttcatggctgaaagcgtcacccgagtgctcccggttttcagcatcacacggagtggctcaggtgcccattcattttatgagtcagcctggggagagtacccacagattcggagtcacatctctgatgggacacaagctctaccctttccaagcattgatgatcctgaggttgatcaatactgagcattgatgtctgtgaaaacaaatcacttaggtgcagagacaccgcaatgaccatcccgccgggggcaaccgcctgattccttccacatcctggtcaacatccctggccaacagggcagcccacggacagctgctctgcctggctcctgctgaaaagccaacagcacaacaactctgccctccatacaaaaccacatgggccctcgagatcacactggggcgccccctttgcccccacttccttgggctgtggctggcctgtctgacatttgctctgggagatgagccagggtctgcccaggccaccacgggggcagagacgtgaaacaggcttcagctactaattttccattaaacgacaagaaaatcggctattgtgagaagagtcacatgaaggtacccaaaagttgtcacagtccactcactcgaaataaaacccatcccattaggaacactgtcattgcagcccatctccagcactctgctctgtataaaagactgactgtggcaagataagggtttaaaattgaaaatcaaagagccattcctcagtgatacccaggaaatgacgcacacgggctgatattaaacccacccacaccaagaatcctaaaagttaacgtacagattactcgttttcaagcaacacacaatgatacaagtaagtcctcaagaagactgcatgggttgaggcactggacttctaatcatgccatctctcagctcaggggtccacgacaaagctaaccccactgagatgaaaagccacttacccctttttcatcactcgcaatacaaatttcagaacccatcccaaactggaaggaaggatacgactgaaactcaactcatgcccagctaacctgggaagtacaccctcctcagataatggagacccaccaattcccgggtgtcagacgtcacacaacctcttctcccaccagggctggggaccctcaggaaagtcaggtgtccctgagaaacacccggcaacatgcagaaccacagagacaggaggcaaggttccagacaaatacacccagtagacagttaaagatttcagagctggagagagcttaggacaccccgattctcagactgcagacagcaggtggacaccactgagctggcgacagccccaaaagaggtcagcttgactgcgacgaggggacgtcttcattatctgtccagtgctctctgacatcaccccaccccgcctcctgtagcagtgttctatctacatgaaattaacctcacgtataaaacatattcctggttcattggcaaacaggcagctctgagcagcacattcagaagttgccaactttgggaggcagaggagttcgagatcagcctgggcaacatggtgaaaccccatctctaggaaacatttataagtcagctggatatggaggcacgtgcctgtgatcccagctactctggaggctgaggtgagaggatcacttgagctcaagtggtcaaggctgcagtgagccaagatcacaccactgcactccagtctgagcaacatagtgagatcccgtctcaaaaagaaaagaggttgccagattaatccagtacacacttctttaatcccgtagtaaattttctctttatagccaattcccaaagtcaagtatattgactcataaaaataccttctgggaagcatgtgactgatttccagctgagaggccctgccactggatggttaagttcataggccccagagtcagaagggggttggaatctcccctctgccatgcctgctacttggccttgtgtacgctcgcgctcgtgcgcttgtgcgctctctctcgctctcgctctctctctctcatgctgattctgcaggcattctacaggcctcccatgtcccaggagccagctctgtccacagtgctcttcctgctcctgctcctggccaaccctccaaccaaggtgtctaggagccacagggaagagcgggttctcttgctagttgctcttccactaggctgtgacacgctggccgagctccgcctccaccggctctgaagacagcacagacaactgttccacctcttccacttccactgagcagaggaactgcgtctgaatgaagccagaaatggggcatttggggaccgcaacagagaacggatgcctagcagatgggaagacgacaaactaacaaacacccaggccttggacccacgcctcccggtaggctccctctcctctccctctcccctccatcacacttcgaaccttcctgggcctggatcaccttcctggaaagctgaccacccccatgcctctgggcgccactcccctgccctaccaccacagggcaacatggggccacatcacgccaccctgcagctcctgttggaagaggctgaattcctggcaacacccacccatcagtcccaagccccgagcatcagtaccttcatgcaaaaggcactaggttggctgctttatctcataagatgagaaaatgatgcccatcaccataaacacattgttagctggtattgatagctgttaacaccctgaacaaagactaaatgaaaatgatggaaactagtgtaaaaagtctatgatgtgcaaaataacaaaatctaacctagcagtagccactccctaccacttgtcacaaggaagcacgaggaactcacagcaactggcagctcctgcagggcggacactgcaaggtcaacgctagaacataaatgacagggaacaactgaggatgaccctgagcttcacagactccagggcctcccctggggccatgggtcccagtggaaatttggtggcacgggcagcacctcctggcacagtcagggtgggggctcccctcaaccagtttggtccacctccatggaccctttggccactgagtcacacatgctggccccaccacctgctttgagaaccagggctgtgccctaccctcttctccctaccccctcatctgcctgtgcacccagggggccaccaccactgcctgggggtcctcacgtttggaggaagcagctgaggctaccagcggctgccagcttgctggcatgggtcccagacattgccaccaccacagccactgatagcacctgaggagaccctctgagccccctgcctgaggccaagcagcagagaaagccacatcctctaaggcccccatgggtgagtacccatgtgacagcccccgccagaccactgcccttgcctggagaaaccactccctaagacccctctcctccagcttgcccagccacacagggaaaaaaactcacttaaactgtccaccggcctgcttccactctgtgacacagcggctgccctggggactgctgagctacagggacccccagtcaaagagccaacccactgaccatgaagcagaaaggccctcctgaggagggccccagggatcgcagagtggactagtatcaaacacccctccacgatggaccccataacaaaaggcataaataacaaaaaagaaaggtcgacgatggcaaatgattctccaataaaaaaatacgagaggaagaatgacaaaccatttacatcaccagagagactgaagcaaggtgggcaggcagtccacaaatttaaaaggcaacaacttttctacagaccagccatgatcagctagaaaacaaggcaagaggaggggatgatcccagtgacaacagcagcagaagtgagagacgcacaaacatgcatgaataaagcaatgaagctccagtgatggaggcaaaggactttttacataaatcaaaatctggatgagaagaaaatacaaaagctctctcctctccccacccccaacccccaccataaaacccacagagcaaccttaatcaaaatcccaatcagaatatgggatgaatttagtttattctaaagtttatctagcggccgggtagggtggctcatgcctgtaatcccagaactttgggaggccaaggcaagaggatcacttaagctcagcagttcaagaccagcctgggaaacttggaaaaaccccacctctacaaaaaacacaaaaattagccaggcgtggtggaccccgctacttgggaggctgaggtgggaggatcacttgagaccaggaagtcaaggctgcaatgagccgtgttcgcaccgctgcaatccagcctgggtgacaaagtaagacagtctcaaaaaataaataaaataaataaaataaggcttatctattcaaaggaatataggagaaaggttggcggagaatgaaaaaagaagaggaatgaagaggtaatggccctttaagataactaagtcttaccaaaagccaccgtaacttacacggtagatagtggcacaacaataaagcagtaaattagaatggagaatccagaaacacaggagaaacactcagaacacagcagctacttaacccatgacaaacctgccaaaacagagaggtcaaagtggctgactaggaaattaggttggaatcctataaaaaaaaaaaaactacatccacaaatcacaccgtatctaaaatacattttagatcaaagaagagatgtaaatgtaaaaaaatcgagactatcaagtattagcagaatatgcaggagggtggttatatacattagggtacagaaacccattctctaagtaagatacaaaattcaggagtaattaaagcaagcttgatagttttaacaatgtaaaatttccaaatttttacattgccagagatgtctttaaacaaattcaaaggacaagtggcatctgagagaaaatatccgcaatatatatagaaaatgaggaataaccctgtgtaccaagaacacctagaaatcaacaaggaaaagcttcacaaatcaagagaaaaacaggcaaggatgaaaaagagaattagaaagagaaattcaaattagtagtaagcacagaagaaacagcttcttataattcacaatttttacaaacacaaaatgaaataagctatcactttacacccacttgactgaatgaaacacaaagactgatcatgtccagagagcgtcgatgtccagagagtgtcgatgtccagagagtgtcagtggggacaccgctgccccacacactagcatcatttagaatggtcaccacctgtcaagagagcaatctggcaatatctgttgacactctgaatgcccaaaccattcagccccgcaagtccacttctaggaatctatgctacgaaaacaaccccatgcagatgcaagggtttaatgtacgagactccacctgtcagcattctccgtgagtgtgaaaaacggaacaacccaaaagttcaataaataaacagtcacatattatgcaagcgtcagaataacgctgcttgcgcaaaggacaagggaccatctctaagacacacagctggtgagcggatcgaactgcaaatcttatttacagtaggatcccactttgttgaaaaatacttttaaaatatgtatgtatttaaaagacaagtaaaatacgtccacagacagaaaaagaaaacgggaggaatcgccaccaaactgtgaacaatgattatctttgtgggcactgaatggggcagtggtgaagttagggggaagctttcattttctattctacatgatgcatttctgtaaagttctaatctttataattagtacatttgaatttcataatcagaaacagatatttaaaggatctcaagatctatgttatatagctctatcatatgttaggcgccacccccgttgatggagccagggtccttctcaactccaaattccactgccagaaaaatggcacctttcttctccagagatacaagataattgcgagaaggcaaaatttttttaaaacagagacatcaagccaggtacagtggcatgtacctgtagtcccagctactcaggagaccgaggcaggaggattgcctgagcccaggagttcaagtccagcctagagacaacatagcaacacctccatctcaaaacgcaaaacaaaaactacagatggcagatctatttaatgattagctctggtggggagcactgcccctcagaccttgacctacccaagcagcctctagttgttaaagacttctcagtattggagaataaaacaaaatagacaagcactttaaaattcaccagaagttaggccgggcacggtggctcacgcctgtaattgcagcactttgggaggctgaagcaggcagatcacgagatcaggagatcaagaccatcctggctaacacggtgaaacctcgtctgtactaaaaatacaaaagttagccgggagtggtggcgggcgcctgtagtcccagctactcgggaagctgaggaaggagaatggcgtgaacccaggaggtggagcttacagtaagccgagattgtgccactgcactccagcctgggtgacagagtgagactccgtcacaaaaaaaaaaaaaaaaaaaaaattcaccagaagttcccaaggaatttgcttccacacatagaaaataatcgagtccgttttttctgaaaacttgctttaaagtccaattgtggggatttgatgtagatggttccattttaacttcttcagccagaggaaatctaaaaattcttccttccagctcaacagagcaaatccacctactgctctgcaaaaggaggacaaagatcctcctggggccgcagaattcagcagcttttccttggattcctaggacaaccaacagctgtgggacactaggccaagcttcaaaaggcagcctgccagccatcggactcccaggcacctgtggagtcctaggcggttgaggaactgggggagggcttggtttcaacctatttgccaaatcaccagcaaaacaagacatgttcaaaagaaacaagtgcacataaataagccagggctctactccccagcccatcaggtcaccggcccagcccctcagtgtgctggtgagcaggacaatcagaaaaggcctctcttcctggaataactaacagtctctcaccatccccactcccactgcccgatgtgtcatgggaagtctctgaaattcaggtttgggaaatcagttgacatgaactacagcataatattagatgtctgattaaaatcatcaagatgatacaaaggtctaatcgcagaggtgctctccactcccaacccccacatcaaatggagctttctctccttcaaatcagacttctttttttttttttgagagagagaagttctcactctgtcacccaggggagggcagtgacaccctcacaactcactgcagcctcaacctcctgggcttaagcgatcctcccacctcagcctcccaagtagctaggaccacacccgtgagccaccacatctggctaatttttctatttttttgtagaggtgaggtctccctgtgttgcccaggctgatctcaaactcctgggcttaagcgatcctccctcctcagcctcacaaagtgctgggattacagcatgaaccaccgtgcccagccttcaaatcacatttctaaggagcctaacaagcagcaggcctttccagttacagcgcatggaagtaacaaaggcagcctcagccagcatccagcgcagtcccagcagacagggataatgaagcggacgtgggcctcacgggagggaatactgtcccccacctccacaccatgctagtgagaaaaacagactgcctgcagctccaaaacatacagcaacttacctatcaaacagggacctctgacgcttcacattatcacgtaagaaatgtttcttgcccagcagcccccagaggatgaacagctccctccacctgaaaggggaagagggcccaagctgcaggcgccctggcctatcgaggccgtggacaggaggcacccgaatgtctccccagaccccaccctgctgcagaggcctctgcagcccatcaccctgcagcgctgctgttcccgctgcttcttggagaacaggggcaatttaatctacaaatcctgtaaatccttgttaaaaaaaaaaaaaaaaaaaaagaagggtaaaataaaacgtctgcactagcaaggctgggacttggcatcagctgccacctcctacagaacccagtggggagtgggctccagagcctccccgtgatgctggcagtgcctcggccagacacctgcccccgccaccctcctgcgtcctcactgcacccctccccaccccatgtcacatcttctgctcatacctccccacaccctcctctcgcctctggatgcacctctcaacacgcccctgaccgcgtcttcctcccatgctctgaactgtccactagggaagccagctgcagaaatcactctcctagaattcacttggtaaaatatgtgttgttattggcccacctactttgctcccaacccacagcaagggctctccagggctaccaagcccctaatggtcaggaactgccccccaacccccatctccagctctgacctacacaaactacataatcctgctgccaaaaacttggccctccctatgcccagggtgccacactccaggctggcccttctgccgagagggctcttctggcctgggctctgaacgggcaaacccacccactcttctaggatggggtccatgatccaccccaacctaccgtggggctctcacatcttccagactgtgcctctctaggagggccttggacccagagccagaatggggctctgatgccactgcacattctccagcaaccccttccatgcccttcctcctgatcccacccagctctaaactgggaacaagaaagctggaatatagtagcttctcagaaaatacctactgagtacacggctggatagatggacagtgctccaggcaaagggactcgggggtaagaaaagtgaagggtacctgctcccggttgtaccactgcagagtccttgagtgtcaaaggactgagaggtgaatgacgggcaaggtgagacctaccaggttagtgtcccgcacccctttgtttccactattagattaagccaccctatgtgacagataaaaggagcaacacatacaaggagttaggccggggttgccaaagtgaggagtgggaatgctgccagtccaggggtcccccacggcagctccccaaatgaaaccaagacaagttggagatgaggctgcctctaggtgtatcaaatcaactgaagtagcaccagtcctcagtgctgattaagcacaggcacgcctgtgatcaagaagaaaaccattacttaataaaatgcagttaatttagaagctgaaatctgtgaaagctcaagggaaagacacaatcaggagttcttggtctggaggggcttctgctctcaaagcttccaacccaacacagcacaaagacgtcttccccaacaaccgcacatcccacctgcaaaacgatgacacgctcctctccaggtacctgaaccttaggactcaaagggtagagaaagttcacaggcagaatcttcacaatacatgcacaaaacaaaggcacttctagtaggagctgtgggtcaggaaaatctcgacttcacccaatgccattcccgagacaatcagccatcaatctgacccactcagtcctgcctcaggggctcagaatctagcagtcaggccaggtgggaagtgcagggacctgtggccaaaatcggcccactcatcactcagctgacagctttcacgcgtactagccagaatcagttagaggctggaggtagtgccaggtgtctgaaacccagcaggcaggttggtaaaacactcacacatcctaaccctggtgactgcactgactgcgtgctttactgtagcagaacagttgcacacatctcatctcctccatccatagtaactcagtggctggtgaggaatgggacacagacctccacgtgcccttctcgggatgagtcaagacaaactctgagcagtgacgctctacagctggctcacacgtggaggcagagcctggcttcccagagcttccagttcctaacacacgcctggccccactgcaccacacccgtgacagctgccaccagctccggataattcagacagatgctagagcacatggctcacttattacaccaaaagactgagaaacagaaactgtgttttaattgtacaatgcacacacttgcttccagagagacctgagaaatccatcatccctaaatgcatgcggttactcaactagtggctttactatttttgaaacaatggatttttccaagacagttgataatcaaaccaactgcgggaaaccataaacgatacttgtttattaaattaagaacagatacaacagttcagaggaattcatatttagagctgccttgctggagaatcaattccaggaatgccaaaccaaccaaatgaaaaaaaattatatatatatatatatatacatatatatatatatatatatatatatatatatatctcacacacacacactcgtgtcacttaacgacaggcatatatatgtatatatatatcacacacacactcatgcgtcacttaacgacagggatgtattctgagaaatttatcattaggcaatttcatcattgtgagaacatcatagaacatacgttatacaaacctactacaacacactaggttatagggtacagtctactgctcctaggctgcaaagctaggcagcatgttactgtgctgaatgtgtgtatctaaacatagaaaaggcacaacgttaaaatatgctataaaagataaaacatggtgcccctgtctagggcactttccatgaatggaccttccatgaatggaagttgctcgggtgagtcagtccgtacactagtgcagactttatagacattgtatacctaggctacattttaaaaaaatatatttttattttttaaatattttatatatttttttaaaataaagtaactgcactacaactttaccacaatgtcactaggcaataggaatttttgagccccatgatattcttatgggacctctgtcatatatgctatcattcaccaaaacaatgtcatgtgatgcatgacagtacatatgtatctcaactgaaaatcctaaatgtcaatagtgttctccgactcactatttactaataagagtttcctcagaactgtctttgcctgagagtttcacgaccaaacgtctctctgcacagttgattctagggacaagaagtgctaagaatccatgttggcttcaagtgcaaaatggaaaacaccttagtgtcccaccaaccacgtcagccaccttcctggagggctagctcccagacccttttcccatcgctgtatagggcccacgtcatctgtggcatttccacgactctccgatgccagccatcagtctctcggcttgtgttgaaaattagcacctttacgtgcccaccagtggtcatgagtcctagtcatgcccaccctgttaaaaacaaatctgatacaaaatgggccccagcaggagacagggacagaacacggacctcacactctctccagctcagactcaaaggccagcactgccccatcacagccgagtgctcttaggcaacccacagctcagctacctgtccccagcctcctcgttgcaaagttaagacaagacctgccttctagatttgtcgggaaattatttaaaatgataaacaaagagggatggaactcaacacacagaattgcccgatgatgtgtgtttcattccagtggtttcgccatcaaaaccatctttaaatgttggagtgtttccgtttccagacaactagagatgaaaatattttcacagtcactcaacgcaggtacctcaaccacgtattttttctcttaattttgatccttgaaacacaaaacaacagatgcaccaccttacattaaaacagccctttagagtttagagtttatgacaggccgcctctgcattctctcactaggccgtagctgtaactcacaaacctgacccttaaaactcccaggacaataagagaagccacaccatggagctcttgctgtcataaaatatctcgcatcagttcaatattgcatctcgtctgtgcctcaaaacaaccacaggcaagaggcctcacgcgggtattgcagatgctgagaaagactctcaagccagaagactggtcctgggccccagggattagtggcagggccaggctggaactgagctcctgttactccaaatcccatcctcttttctgacctcccagtccctttctcataaaaccaaagcatcttctccaaccaggccaggacacacgcaggagagagtcaggcaggaggaggcttctggaagggaaagcagagtggctgagagccctgggacagagtctgacattaggtacaggacaagtttggaaagatccagatggagcgggaagggaatctgggcgtgggggtgcctccttccaaagtgcatccacatccgaggtgactgcagggagacgcagcgctgactttggcagcagggaccacccgggtgcagagaacccaaacaactgaaaatccaaaaaggaatctcagtgcacagtaagaaagctcattctttgggctggttaccttcccaaacacgttctcctctggcctatgtgaaaccgacgttgcactgtacaactctgaagctctttcttgactgcccactgaatgagggtctgtgctacattccaggaggatccaaatgtgaacacagctaggttccagctctgggactcgggaaaaggaggcacaggcagcaggacatgtgctgcaaggagactactgctcccgtgtttcattcactcactcatccaacaacagcactaaggctctgctgtgtgccaggcacttttctagctactggggatccagaggtgaacaaagtcttttacaattgagtggtaagagactgacaataaacaaacaagtatataaataacacactgaatgttgagtactaaggagaaacacaaagcaaggttaacaagagaaggggaagtaacgctaatttatgtagggctgtcagggagccggcaataagtgaggggccggccaggtgggcatctgggggtggctgatgccaagggggtgggaacagcaggtgcaaaggcctggaggcaagagtggcctggcaaatccgaggaccaagggataagatgaaagagcctacattcagttaggatctccgggatggacatgggccaagatgacaggtggggatggggtggggacaacccagggcagatctgggcaatgagcctgtctgcctggagccaggagagcctggaggggccattcttgggagcgagcgggggaacttgagaaaaatcaggccgagacacatggatgtggagggagcactggaaagccactgaaggcctgggcaatggtgacacacctggcctgggccaacttgcagactcaggggtaccccacagcccaacctgggaaacctcacagccggcacagaaatcataaagcacacagcaatggcaccccaccagtacgcagggttccacatagagagcctggctgcatgatcttgaggtcacctaactcccgggcctcccttgtgtgtctggacagggagagaggggaggattggcttcaggagaggcgagaaacgacagtgcccatgacagctgactcagcctgtgccagcaggctgctctgagacatgagctggacccaacccaggcggtgggcagcaggggggtggggaggaactctgggaaaggaaggagccagagaagtctccctgtgggcgctcgggccaaccaccacccaagggaacaatgagcacccccagcccccgatgggcacacaggctgcctcctggtgagcaagcgtctcaaacctgacctacatctgggaggcctgcctggtcaccagggactaccttacaccctacctgtgcctccacgtccccagtgctcacggccacctggcaagggtgaggaactgagactgcgttgaggacacacagcctgtgagtggtacagccagggccgctgcccaggcccagagctctctccgtttctctaaggaccaggctgcaaggcagggcatgtgatctctgccgaagacattcaagccacccagtgatgtgtgctgggcctcgatccccaccgaccgccagtcctctcctcccctggacagtaaaggtttctccaagacttcagacgacggtgtcacctgaggccctcacctattaagtcaccggggcaggtatgcatggcagaggacacggaggagtgccggagaggagctgaggcctggagggggcctctgcagccaggctcaacccccactctccccactccaacagccctcactgcagccaccgcggcccaatccaaacaaagcccagcctgatgccaatctcaccatcaactgtttttcctctgacttcctcagttttgtctaggaaaaatcaaagtgtcttatcccatctctaagcttccaggggtgtgatcagtgtcttttacaattaccttttacttttatccagcatttcttagctcggttggcaaactggatatttatgcacctccatttcacaatccatctccaccgattattcctgtaaaacatttttttttttaaagtttagagttacttaagaaggttatgtaaacaagttaaccagcaagccacaacttgggtctgcggtgtcagagaaaacatgcaaggtgcaagagaatgaggagctgatggtcaccagctttacctccttccagcacccactcctgctcacacacactcacaccccgtgggactcagcctgcagcttctcccagcccaagagccagacagtggggaggagcacagaccacacttcctaacaaatgagagggaagacttcgtgccccattgctactgccatcacccagtcccagcccagagagggagcccactccaagggcccccctgccagtactgctagagcccaccgagggctgccagcacacagctacgagctccagctttatctactcacgccctggacactgcccggagccccagcaggttccacgtgtccttgtcaccccagccctcctgccccgcggatcctaagctcaggagaccctctccagcccaggctgtgggggaaggcagcccccacggtcacccaggaatcagcgcagagtgcagggcatcctggactccccggactgggaaacccagttcctgtccccctgcgtagtggccacacctctgggaggggagaaacccctgcctcacctcactggagggaccctgacccagaggcctgagaaaaagccaccggcaggctcctggcacctgccaacctgcaccttaggaaaacttgtcccacttcaacctgcaaagctctcaggtcattacttctaaaaccactgtcctttctgaaacaggaaggaaaatagaaaaacaaacaaaaacaaagaggcacagaaggctgaagacgccagaggcagtttagcccaaaaacaaagtgccagacacaagatgccaagtttggggcgcttcctccaccgcatgcctgtttaggagctgactgcactcaaccacagatttacgtctggtgcctgccaggtcgttatctgaagagatctgaaaaagtaagcctttcttctgccagtaaatactaagttaagactagcaggcccctctaaggctctgctctccactggggtgctgcaggacaggcccctccgcgggcgttccccgcaccctccctccgcgtcggcccggagaaaaggaagttcgcccctagcctgggcttaccaaggcccgccgcccgacccatggagccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgctcgggagctcttggcccgcagcttacgcgccgccccccacgcgtccgggtccccgcggcgccgcgggcggcccaaggctgccgccgccagcgagtcaggcagccgaggttccccagcttacctggccagggcgcggggctgccccggtccgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgctgccgggtctctcccgggggctgagctcccgcagagctcgcgcctagccgcacacctcgactgctgattagcccgacagctgaatagcggcgggagcctaccgcgagcggagtacggaaagcccgcagggccgcgccacatggcgcacgcgcactgagctgcatacctaggtgacaaacgtgcacgttttgcacgtgtatcccagaacttaaagcatgacaaaatttttttttaaaaaaccctgatgccattattaggaacaatttgaatagatcagtcacaacctatatgctggcttctggtgtctcaatttgtcctgggaaaactgttgtaaagcaatagtatgtcagtccttatatacttatccatctccaatctggaaagacaaggcttatatgtttcctttttagtcccctaatttctctttatgacacaaatccagttggcagtattaaagatggggctgattctcctttacttatctggaatatgctaccattccagataagtaatagtaaaatggccatttcctcttgctaatcaaatgtcgtttttgaacacaaaagccactgggtttggagtatgaaacataaacataaaacatatcatacactatctgtgacgtt

SEQ ID NO: 343 - DNA, 139907 bp, Homo sapiens
cacaatcacatacacctaaccctcaacgatatacagagaaagttttgatactaattttcaattctttatctctatgaagctgatgaaaaattcttaggcagtgtgcctggtgtgggattttgtaaaccaaaaataatattctaggcttcccaatcaactgaatagacctatcctctcagccaagggcattccaaaattaacctgaaaaactagttcagaccatgatgagatgcaggagatggggcatgacttatttacactctcctgtctttggaatgcaggcatgggtgaccagcattaacattaaaatagagatcttaagaataaaacagacttcctgtagcaataagacaccaaattccagcctgactaaaataaatcgaatatatatatatatacatatatgtaaaacactttgatttcttacatatatattattattatatatattttgttatttttttgagatgaagtctcactctgttgccagttcggagtgcagtggtgcgatctcagctcactgcaacctctgactccatggttcaagctattttcctgcctcagccgaccaagtagctgggattacaagcacacaccaccacgcccagctaatttttgtatttttagtagagatggggtttcaccatgttggccaggatggccttgatctcctgacctcatgatctgcccactttggcctcccaaagtactgggattacaggcataagccaccgtgcccagccccaaaatatatttctttcagagatatatatatatatatatatatatatatattatatattatataatgtgtgtgtgtgtgtgtgtgtgtgtgtgtgtatattttttgatacagagtctgttacccaggctggagtgcagtgatgtgatcttggctcattgccacctctgcctcctgagttcaagcaattctagtactttagtttcccaagtagctgggattacaggcgtgtatcaccatgcccaactaatttttgtatttttagtagagatgaggttttgccctgtttgcgaggctggtcttgaactcctggcctcaagtgatccacccaccttggcctcccaaaatgctgggattacagacaagagctaccatgcccagccttctttgatatattttgaaatggtcctgcaaagctttctctcattgggaaaatgtatattctatagagaatccttgattctttcctgatccaggaaggaattaactgagtctgacacctttttgggtctgataaatgtcaggcctgtgagcccaagctaagccatcatatccccagtgacctgcacgtatacatccagatggcctgaagcaactgaagatccacgaaagaagtgaaaatagccttaactgatgacattccatcattgtgatttgtttctgccccaccctaactgatcaatgtactttgtagtctcccccacccttgagaaggttctttgtaattctccccacccttaagaatgtactttgtgagatccacccctgcccgcaaaacattgctcctaactccaccgcctatcccaaaacctgtaagaactaatgataatccaccaccctttgctgactacttttttggactcagcccgcctacacccaggtgaaataaacagccttgttgctcacacaaagcctgtttggtggtctcttcatatggacacgagagacaataagagctctgaggcctgctacctgaaggtttcatatgcatgataaagccttgatctccacaaccccttatcttaacccagaccttcctttgtactgattccaggtctttagataataaactctttctctttttggtagaagatagcttaaaaaacacacactccaaaaaacttctttcaaccaattgtcagttagaaaatctttgaatccacctatgacctggaaggaaccacccctcgccccctctagttgtcccacctttcctgaccgaaccaatgtacatcttacatgtattgagtgatgtcttatgtttccctgaaatgtataaaacccagctgtagcccaactatcctgggcacatgttctctagatctactgcggctgtctcatgggccattggtcactcatatctggctcagaataaatctcttcaaatattttatagagtttgaccttttcatcaataacctctattcttttatcatttgttttcctcatcttttgtgtgtcctgcaatgtccttgcttcttgccactccttccctggttgttacttcattgtattatcagaggagtttgaaccagagtgactccatcttgaataggggctgggtaaaataaggctaacaactactgggctgcattcccaggtggataggtattcttggtcacaggatgagatagaaggtcagcataaggtacacgtcacaaagaccttgttgacaaaagggtatggtaaagaagatggacaaaacccaccaaaaccaaggtggcaacaaaagtgacctctggttgtcctcactgctcattatacactaattacaatggattagcatgctaaaagagacactcaccagcacatgacagtttacagatgccatggcaatgtcaggaagttatcctatatggtctaaaaacgggaggaaccctcatttccacaaattgcccacctcttccccagaaaacttataatccaccccttgtttaacatataatcaagaagtaactataagtataatcagttgagcagcccatgctgctgctctgtctatggagtagccattcttcattcctttactttcttaataaacttgctttcactttagtctatggactcaccctgaattcttgcttgggtgagatccaaaagccctctcttggggtctggatcaggatccctttctggtaatgtcttctggttgaaccacgaagggacaatattgaggaaacctctgacccaaagaaaacagcaataccaattggccgactttgagtaagaggaggggtacatttaacgtgggtaaaggatggaattgggttagaggcccaacttaggagggttagagtccctactaagacagagttaaaggcctccttaataaaaggcaaggacacttgaccaaacttgggttagaggcccaacttaggaaggttagagcccttcctaagattcagggggttacaggttagaggtccctctcagtaaagtccctcttggttaaaaatggatttggaattatgggatgttatctgctattctctttggattaatctgccttgcactgtttgctgatggctgtgggtgacaggattaggcatgtacaggatcaccagatgtgggagcatttttctccctaaagtgggaaagatgagagctgatgggactgttggaagagctcccttcattactgaaaagcaggtgcctgaacttttgattcagcgtcgctgcaatgggtgggtctttctctggcctcccggagctatgtaccctgccacagacaatgcttttctccccttttctcctttctcttttctatcttttctgttactcagagccaactgtctgctgtttcatcttgcccagagaccacatgttgaaactcctggttggaagatcattgtaccccacttttctttttagcatataatcaagaagtaactaagtataatcagttgagcagctgatgccgctgctttgtctttggagtagccattctttactcctttacttttttttttcttttttgagacggagtttttgcttttgtcacccaggctggagtgcagtggcactcttgactcattgcaacctccacctcccaggttcaagcaattctcctgcctcggcctcctgagtagctggaattacaggcacccaccaccacacccagctaatttttgtatttttagtagagacggagtttcactctgttggccaggctggtctcgaactcctgacctcaggtgatctgcccacctcggcctcccaaagtgctgggattacaggcttgagccaccgtgctccatgataacttttcagaaaacttttttctactttttgccacaacttttttacatttttatccgataactttttcaccccaaaacttttttaatcccataccttttttatgttgtgttctttcaataaacacttgcatagttatactacatttttgtaacaatgaaacagattatctcatgccaagcatgcccagtatttgcacaatatcaatacttttaatactatagttttcaagacacgcaaaataaaattttaaggcaaaaacagcactttgcaacaatttaaaaatttattgcattacagtagcatcacatcagcagtcaataatgccactttaagcaaaagtctttcagtatttccgttacacattctgttaacaagaactcatacattggtaaaattcattctaagaaaacttggcaaataacgctttggcctggaattggcatttctttctctacttttccttcccaccatttcttccttttaaactacaggatttatattttaaaatgttttatttcagaacattaagatagcagttacattttttaatatttatattattttaaaatgactctttaagatacagttttaaacccatgggctagaaatcatacgactgttaattagccgcattatttggtctaacattttttatcattctgaaactggatttgtgtaatacattgataaattcatacaatttggaagagtcagttgaagttacaaggacccaatatctgccctctttcagtgaatgccggcaaatctgttattccattggcaaaatcgtattgctgctctcctgttaatctcacatttataaaaggatcatgaggctgccaagtgctaaaaatggagatggtctagtaactagaaaactccccaccccagggagcacacctacatatctccctacaacctaataatgtgatgtgttttggaacacagacattagaacttcatgaagttttaactgttgattctttcccaagcatcatcaagttatgatttaggcaatgtatgattgaaatgcattcattcatcatgcataggcacaatcacagaaatattgcacaaagtatgtccctgactgaaaatgagaggtacaaaaacgtatttcactcttcgtaaagaagtttgtgaggaaatacaactctgcgatcgtatagacatgtttcctgataatacagacattcacaaacagtagattgcaccacagtgtgtaaacattttaagttgcataaacttctccttgattttcaaagataatataatactgtctactaaaattcctttttgtttcaactaagtactctcacatatattagtttataataatgtttgttattactttctaaagtgttttccactcaaggaaaagaagtaaattcctatgtcagagtaaccgaggtggttgaagaataggtattagccagagaggtctagatagtaaaatcaaacttcaagcctcaaagaagctccatgaacagagaggaatgccaggtgtcacacagctttccttcactctaattcattcttgactagagcctgtatgcctgtttcagagacatttaaactcttaaaggatttcttatgatcttcactaaatacattaagaagaatgccaaccagcgccctttcgtgtactgggacaggtagtcatgtgattaaaacagggaacacgaactctgactttaaaatgtattgtagatacaaatgctctaagctaggaaaggtttttcacacccacagccaatgatggcagcctttcattcctcggaaataagccctttttaggtcactgaaaaagagtgcaactgctgcagctcacgatgcaatatcttcatgagcccagagcacatacaaatccaaagggaactgccacagtacactgctcattcttggcaccggaacagatgaaacacactgtatcctgcacatacctgccagagcaggccactttcctcttctgtgagatttagaaagctcccccaaaaggttatcactcccatcaccaatacacagaaaatggaggaaaggctgtttccagttctcggcctttaaacagctctaaatgtcagtactcacagtggcatattacaaagtaataaacagtgcacacttgagggcaaaccgcatattgagctatagaagagctcactgtgattaagatgagatcaaacatcatagcagaacattagcaaattttatctgaattctgtaatggacatccatgctgcaataacattagaaaagcacgggagcctattccaaaccagcgagaacagttttgtgcaaagagtgggtctttgtgtgtttgaactcccaccacgtaagggcaaactcgatatgcatgctaatgacctacaattatgaaatgaaaaaagaaaaatgctgaaggatgccagagtgaacatcagtgagagccacagagacccactctcttttaactttttacaaataaacttaaactataaattagaaacacaaataatcatgagtagctctaacattcaaatgaagtaaatgaattgtgtaggagattaaccccataactttgtttcgtttttaaaaatttcttgagcagctctttgatgatggtggtgtttatctccttcttctcggcagccaagcccagcaaaagcatggcacacagcagttgctgcccaagcctgggtgctcctggtggtcctgcatctcaccaaggagctgcacgactggctgtgcagtagggttgtcctgggaagaaccctccctggcttctccttgtgcaggctccacgctgttggtgaggctcgcctcacaaagatctttggagagagggaggcggggatctgagtggagtgctagccgccccccgctcctgcctgctcaccccgcctgggggctctactcaccaccatgcttgtcggcagccccgagctcctggggggctggggctcctggactgggttcagcagcagggttccgggcagcggccaggaatttgccgtgcccctcgctgtagctgccacaagccgcaacaccatctcctgcagctccagcagcttcacctgaagggacgggtgctcagctgtcaggccgctgctggcgcccaccctcatgcccaccccacccacacccccaccccacccccacccccacagggatgttgcacaccctaccttcctctcctccttgtcctgggccagcctgatgatggcctcctcccggtgacgcatctttggcactgtcccctggctctgttagaaggcgatgtactttcctgcgggaggacagggctcagacgctggggcccctcccatagccctgcagctccccctgccgtgccctggcctcccactcactgatggcatctctctctccggtactggatgaatccaagttccagtttctccacatgctccctcaggtccgccttctcctccaggaggtccataaggccgctctggagccaaaataatggggtcacatctcagcagcgacctgccccagccctgcccttcttggcccatgctaggactcactcccctccagcttctccatgacttcctgcagggcccggagggtctccccactcacagactcgcccccagtccctgaggctgggactgctgcctctggctccttctcggccgaggtgagcgtctccatcacctggcccagcttctcctgcagctcctttacttgctgctccaactgcagtgcgctcttgttctcgtgcttctggacagagagaagcaatcagcagccacccactgcagctggagaccccagaacttggtgtctgcctcccatggcaccgggaagggtggagccaagttagaaaaatactctcctctctcccacagccaccagagcaaagctctggctcacaggtgcctttggaagtaatatttcatgtgagggctacactgccccattttacaggtggggaaacaaaggcctggagggctagggaggagggcaggctccccaggtggggcaacccaccagctcctccaagtcgctctgtggctcggccagctgctgaagcctcttctcccgttcccgaagcctctcctgctgctcctgaagcctctcctcctgctcgcgaagcctctccttttgcccacggttcaggagactgatgcactgattgttttccacctgagcctggagctctcctgccactctctccagctccttcctcaggtcttgcagctccacctcagaggacactgctggggcatccgggggcagtggctcagctgagaaaggaagcagatcataagggcctctggattctcaaaacaaaaatcaaaacagaaaaaacaacaaaacaccctcctgttggcgcacagctcctctcaggctcccaaacttggcttcactgctaacgatccctcgcacccggatggtagccagtcttccaaaccactttcagatagagagcactgcgggtggctgacaacgggccctctttgctcatggggacactgaggctcagggagatgacaagacttgtctcctggcacagacctctttccctctgcctcaaagccctgccatccacccacctccctggggcactctaagccacccccacagccctctgatgccagtcctgctcccaggtcatgccagccccatcttacccatctggtttttgagtctggacaagctcctctccagctcctctacccgatgcgtatcatgcttcttctcctccttcaatgtgcaaacctgcccaaagcacagggggaaagggccctggagagaggggctggtggctggacaggctcccatctccctctctgcccccacctccacaaagcccagacccaggaccacctctggctgcactattcccattttaaagaggcccagaaagatccagtgacctatcttaagttgttggtggggggggggtggggcgggaggctgaagggtcagatctcacctcctgcgacattttcctcatcctctgctgccactgggccctctctccttttatttgttcagcatattgatctctctccagctggacttctttaagcgactccttcaactgcaagaatggccacacaagttaggaagggccgtcactggtcctcacctgctcctggccacctggggtcatcttccttccacatccctccctctgcaaaacctcacctgtgtcacgtgtcctttcagcagtatctgctcccgtatggactgctctaactgccgcttgagaagtgctttactgcggctcgagaactggatggtgaagagtgagaagtttcgatctggggagcctgggccattccacacagtgccccttaaaagggctagggctaggctcaatatacaactcggtcagtaaagatcaaggcatttccaagcccgtggtctggttttgaaaaaaactcagtgaagttggaagggacaaggagagagatcagataatattgctattgttattactcccactgtttgaacctttgtggagtgcttcagcaggtaccttgctagcaatcccatttaatcctcgcaaccaccagaggagacagttactatgatgccctctcttgggtagatgaaaaaacatggagtgtttgaggttaagtgcttgcctaagatcacttaggcagagctaggatttgaacacccaggtctatcagattctctaagcccatttttctgctgggggtgggggcacggttaggaaggggaaaattaatcttttgttcactttttgaaaagatgatacattcacatagtccaaaactcggaaggtatcaaagggaagtatctcccagccaccctgctgctctctcctgagttgtttacgaacacttgcagacatgttttatgtatattatcatactatgtacacacacacacacacacacacacgtttcctctctctacagaaatgggaacatactaaaggtacccttctgtaccttcacagtacaagtacccaataccccacaccccacctaggacttggccaagaccacagccaggtaagggcagggcaggcacttggcctccaagctctgcatccagtgctcgctccccaccgcgccccccgactcacccacagcagctgactcagcctcaggctgcctctaacaaccatacacaaaagcagtgagaaatggccatgctgccttctgggcaggacactccatcctgcagaagggacctttaggctcactcctccatctgtgaagccgggctcccaggggacagggcaggtgactggactcaccccatccggcttcttcttctgtgtggcggcgacagcacagagagaccactctaactctcctatacgctgcgatgaacgttgcaggcggccggccagatccttggactcttctgtaatgacagagttgacatggggctcaaaggactccgccttacagacctgtcaaagtgccaggttgaaggatgacagggtgcccagattcccaccttcaaagtatctgagagaatgtttcatgtgatacaggtccgtatttagtttctttttctctgtgttcaatctctggatttgaccctttgggagaaaagccaagcaagtgctgaaatagaaggaaagaaacattctccggaggacaggaggaaacttcacaccctccactcacctctagctccctttcagctttctgtttctcattgtttgctttcttttcctataggaagaggaagacagagctcttaccagggggaggcagagaaggcacagcaagagatatgcccccagaatgccaccaatgccccaggacaggcccacccatgggaccaggttatcagggaccctgtggggatggggtggaatctgaggggtgagcctccttccccaggctgggagtgggtgagacgagactggggcctctacatctgagtgtcccccaaacccagcagtcatgtcgccagcaaacaaagaaatcacgttacttcttccagctgatgttccacttgtttcttctgttgtttctgtggggagagtcaaattaaagtgatggagggtggccccctcaactctattccccagacaggaagcggcaggcaggggccaggaatggattttaaaggcaaagttctcagacccaatgggaacaggaactgttcccaagctcccaaggacagaggatttgggtctttgttggttttcagccacagcctcacaactcaaagtctgaatcaggaatctcttgagaggacagtaacataaacctctagagatggagtttgagaaaggctcccccttctgccagcttgtgatttagaaaagtgtgttcattcaatagacatttactgagcacgtacgggccagggatggttcttcacagccgatataggatggaaaagaacagacaagagcccttggccctgagctttccattctagggggcctttaaatctcagactctcagagctaacacagacctttgatactcactacctcctctggaaacacgagcccaaaaaggagaggtggcttgtccagaatcaaagagcaaattagggactgagtcatggcagaaatacggggcccctgacaaccagtcaggccagcacttccccaagaggcaacaaccccagggcgtgtgtagcaaggactcgagtaggggtgcctggagaggagagagtcggcaaagagggcagcaaaagaagagccatgctgcatgctctggggtcccgccaggtgaggcctgggcgccccagctccctatctgcccttggcaccaggggcccccagcccccttcttcagggccccaagaggaaaccggagcccaggattggcagcgtggaatcaggggaccccactggactcttaccaaagatttgatggtgtcattcagtcgactgatttttatggacctcgagttcaggactgctgcttgttcttggcacgggctctgacgcgcatgcagagaggaggaggcggaggaggacttgggggagaggtagagagaacgatcattagggctgggttgtgtgtgggctgtctcagctggcagaggggcacccagtccccgctgcgggaggaggttggagggctggcctgcggggtcactgcacctccgcccagagcctcctacctccagatccttcagggtagcagatgatgtagggccctccccgtggatacctgttgctgactataagagatgagactgcacatggagatgttctgtccccctcagtgtctgagccctccgacttcctttcttccccatcaactggcaacattttcttttctgcctatcttggaccctttgtcccataactcctttgtgccaacttctctcacggttcttatctccccaccatcccaccctgggggccttgcagtgactcctgatgggaagtggctgttctcattgtcctggcttccccttgagactggggatgaggaaaatcaaacagcaaagaccatatcctgggtgtcctgggtgttgacagcaggccatgtactagggattaacataaaatcgacaattatcaatctcattgaaacttcacaaatacaagtcaaacaataccacctctatcatacagacgtgaaaacagaggcccaaagagctcaagcaacttgccctaaatcatatccctagcagacggagaggcaggattcaaacccagaattcttttcttttttgaaacggagtctctctctgccttccaggctggagtgcagtggcgtgatcttggctcactgcaagctccgcctcctaggttcacgccattctcctccctcagactccggagcagctgggactgcaggcgcccgccaccacgcccggcttttttttttgtattttttagtatttcaccgtgtttgcctggatggtctcgatctcctgaccttgtgatccacctgcctcggtctcccgaagtgtggggattacaggcgtgagccactgtgcccggccaaatccagaatccttcaccagtacccaacagtccatccacaatcttaacgattgccctctactgctccttgggccccctgtccccaaaagcctgtccaggcaagactcacagcctcagatgagtggcaaccaccagaagcggccgtctcagggctactgccatttgctttcgtgttcctcttcgctgctgctggaacaccagggcggtttctctgccaatattctttgaactgtgggaaagaagagcagtaatactcatgagaactatcagcccctacagccacatcctcctttatagtttttataaaatactcttatataccatctgatttaatgacaccaacaactctataaggtgtcacaatcatttagggactgagagggatcgacatcatggctagaaaaaaagaaaaaagaaaaaagcgatactggaacttggaaactcagtcttcccactctaagctctggggttttgccaggcaccaaacccagaggcagaggtagaaaagtaaacattaagtaggcaggagctgtatgtcatgtggtttagagtcgtacatcttcacacgtctgttattgggaagaagtgcaccagtacctctcaaacttttatatcaatgtgtcctcatggcagaaggcagcctttctgtgaaatctgggaatttatcagaaagaggacaacccaagcctcatttcagagagaagtctggtatactcttagaaacctatgggactgccatccctaagtacattcatgttttttctcttatctcaagatatctcaagagaatcaaaggaaactgatgcttcagaaagatgtcccacatttatcctgtggtactcaaagcaccccagcttgagataatatgaggaagattcaaactgtcaagttcagtctcccaagatctattccacagaagatgaggaaatctcacttcagagaccactgactgaaggtcccagactgaagtctggtcccagaaccatggagaattagaatatgaggtggagaactcggaaaaaaatgttaaaatctctttggaaagtagaagcttgggagaaaaaccaaaccaaacccattctcccatcgccacccagagacactgtcaacgttttgagctcacgggggaagtgtaggcttttcccactgtcaatgtctatggtaagggagtaaggcagcctgaaacctcttgctcccaggtcccatagtctccatttcccttccagctggaaatttctgctgtgaccagaagaaccagaaacggggtgacaacgtttaggggactgggtcataagaccagggccagtcttccagtaatgacagttagtaggcagactgtgacatcactacattccactcctcctagtgcgggggagggaccacatcagcgcgatgtccgagtctccactccacaacgcgggagggaaacacagggttgtgacccaggtccttggagacgccagcacaaagagctcagggaggtcgaccttgaggcagcaggaggggagggcagagtctgcagcagggagccccaggagtcaccagcccaaagtcacccagggacaactggcgagggcggggcctggggctggggggcccaggtccttggatatgcgagcccaaagagcccagggaggtccaacttggggcggcaagaggtgagggcccagtaatggagtggggcgccccaggagtcacccgcccaacgtcaccccggggtgatcggcgagggcagggactgagctgtttgctgaaggggcagggctgactgacaagacttttgtagggggagcccagaagcgccggggttggggggcaaagtccggtgtgcgtcaggagtagtatggactgtggcagcggtcttgtcgtcggaggggatctgtggctgggttagcgggccatgacccggtacgtctttacctttttcttggctgcagctaatttactctgtccagtttcttctgccattgtggggtggggagggaggcggggctggggccacgtcagccaaatcccagcgagcgctgatcaacacatccagtcacctggaagacagctgcgtaactgacccagaggcagcgtaaccagggccacagtagaatgcagaataggggcgtggccttaatgcttcaagcccattggccaacgagaaagatgacagggaaagggggcgtggccaggcggcagtgtgtccagagggacctgtggctcatcaggaaagctgcccatgcaaccgctgtccccacccactctgagagaggggaggggccgcccgctctgggagagtggaggggctggcttttgctttaaaacccttaaaactttaaaaatcatatgtgtgtatactttatatatatgtgtgtgtctctctgtgtgtatccatgtgttcctccagagctgtcttcattaaccagcttctatgcaaggtctgtcattttggcctatatttttcatcttcaaatactgtataaaaattaccagtattacctgaactgagatacagatcctataaaagtgggaaatccacagcatgcttgatgattaatgaagcagactatattatccaacattccaatgagataaaataatcaaaatgatttcttttttggaaaaatgtttctcttattctcctacattgttgctgttttttctttttaaacaggaaacatggttaatatccgtaaaaacacaaagcttttgggctgggtgcggtggctcacacctgtaatcccagcactttggggagcccgagtctggtggatcacctgaggtcaggtagtggaagtgtgagccatcacacccggccggcttcatttcagaactctttccccagcactccatatactatgaataattcctttcttcttctttggatagcattttagtcatatctctattaccccacttgtcacatgataatcagtggctcacccatccatctcccttgattgctcatgagctccttgagaagagtctgattttcagcaccttgaacagtgtgccacacatacatgcttcatacgcagagaaggaaatgatttcactacagtgtaattattcccagaattcaatatctgtatttctaaattgttctagatactctgccaacaacctgagaatgttatgttttttccccaaaacttccatccattattgtgtgtctatggtcatagttaactcaattgtgacgtcacctttggacaagcccattaacagtttctttttttttaggtgatttttaattttaatttttgattttgattgtttcttttctgttttttaaatctagcagtgtttggtaaacttcaacatctctatatccccgtgtctctgccccgctggtctctgcttggaataatgtctcaaggttttagtcacctggaaaaaatttctactcacccttaaagaatcagaaataaataggctgggcatggtggctcatgactgtaatcccagcactttcgggaggccaaagtgggcggatcacctgaggtcagtagttccaagactagcctgcccaacatggtgaaaccccgtctctactaaaaatacaaaaaatagctgagcatggtggcagaggcctgtaatctcagctactcgggtggctgaggcaggataattgcttgaacctgggaggcagaggttgcagtgagctgagatcgtgccattgcactccatcttgggtgacagagtgagacatcatctgaaaaagaaaaagaaaaagaaaaagaaaagcttaaataataccttctctgagaagcctttatatcttcctattctttcaggaagtgttgaaaattcctcaacttttgaaacatttgtgcctctattactgtgtatcaggcagtgaactgagtgcccaggatagaaagatgaaactgtagatcctgcccttacggagctcatggtctagtatggaaaacagccatatgaacaaataaccacactataggtcttcagagctcaagtcctatcctaaatactgtgaaattaatgttctgtgaggttttgaaagtactagggccagagacaatatggctgcttggatgactttccatccaagttaacattcggccctcatcacaaagggaatacatgcgtgcatcttccttgcaacccaccagtgcctaacacatcatatcaccacttttgaaatcaggaaacaggctcagaagtccaagagcttgaccaaagtaactcagctggtaggtagcagagccaggtcagtatgattcttcttcaatatcctgccagccacatgggcaagtggcctcaaaatcaacaaaagacaggtagaggttgacatgcatcaatggagagaggctcaaaaggaggattttatacacaagaatagaacagaaatgttctggaagtatatctgtggatgtgaagcaggagggggcacaccaggtttcaccttggtcaagtgaatctataattccaaccggggcctcgccgccccccacccccccgagctccagacttagctatctgtctttcttactctaatataaaatccacagggcaggaccttaatctctagcttgttcacacagattaaagcagagtctggcttataataaggacttaataaatacatgaatgaataaataaactatcaaagaagctaaagaaacattccacattcttgcgggaagggattaccatgaaacagaccctagcagtcacttacaaatacagttgaccctcatcattggagtatcccatattttcaaattagcttacttgctaaaatgtctttctaagtcccaaattaatacttgtggcactttcaaggtggctcctggatagacatgcagtagtgaaaactctgtcactctttgcacacgtcccaagctaaggtcaaacagtgaccttggtctgcttgtttcaactctcatacaaagatgacctgaggacagagacagtagaggacactgcagggtagcgcaagaagctgtggctctggggccagttgggcggggtctgaatcataacactggcacctgttagtggagtggcctcagacaaatcacttacaattctgtacttcctttattcttttggaaagaaagaaaattcaatctaccaggatgagttgtttttaggaattaagatgataacctatatgacatatgtatttatgtacatatttaccctggaaacaagggtttgctatttgattaattcagtgttccaggcaactttgtagaatattactcctgcaaatagtaagaattggctgtaattaaagaaataacagagatgtagacaaaacaattatttgggtgagctacaggcagtcttcaagaagcttctgaagaaacagaacttcagcaggcacttaagctgtagaaaaggcttgcaaggagatagaacagcacctacagagagaggtccaggtggggtcaggaaatggcatttcaggaagtctagagcagtagaagatgaggccagaacacggcgccacagtgctgctctgcaccctctatacaccctgtactgcagaacctcactctctgcatttagttcttggtttctaattctctcttccattaaactgtgagcccctcaaggtcaaggtctctaagaagaaaccatagctacagtcctctaaatttgaaaacaagttattaaacacagatacacccaagaagaccgtacaaaaataatgttggatttcaattgcagtcatagaaattcacaactggtatacatttgcaatctgtccaggatttttctctgatgactgccgtaactctgtcataaacccttttcattatttgagacaccgagacatttgttagaatgtttgggaaagacattctaaaagggcaagaaagaccttgatcttttttgtgtaactgattgactggttgactgactgagatgggatctcattatgtagcccaggctggtctgaaactcctaggttcaagcgatactcctgcctcagcctctctagtggctgagattacaggcgcacgccaccatgctgggctctagtgtgatgtatttacgaggcttaaacatatggttcattacacaaggctggcacctcagagtaaagattttttaaagttcactctaatagacttatttctctatatgcaagatacaattttaccacagtaaaacacaaggaagcatactgatatacatatatgttacaacaggataaaaaaaagcaatataattttctccacaaaagcttgcaaaatcctggccaaaacacagtaaagaggatgttaatctcacagctcacgtttctccactgagacccaggaaaaacaatgccagtttttgtacagtcacaaaactaagcactgtgagaatttacaagatttggttaacttgtatattctccccaccctgacagacaagtcccaaaggagcctagcagttttaccccaacatttcaatctcctccaacctccaaaataaaaccctcactgtccaatatctcaatttatattttcaaacgtctaaaatcttaatcgaaacaaagagcagtgcattagctttgccgccatagaatgcttggtataattttacttaggcacatcacagattgtgctattgcctaaaaacatatgggtagaaccaacattcctagaaaccaaacgcatatattacgaaggtgaaagggaatagggagtgttgtttttaaacagatagaacgctgtgattgtccactcataggttaggtgtgatcaaatcacatcgtgctgtacagctaagtatgtcctatattgtatgacaaagtagggtaacacattatttattgaggacctgttgggtacacagaggcacaccacaagctgtaaaagacttcattcttgccctcaagaaacttccaagtttctagacagcctgatagaaggtagtcgaaagcaaatacttcaagcactagccatcacaattaccttaggtatttacgctacccttctacgagtctctgaatatttcgaggccccctttcctatttcccatgggctctatggctcaacattctttacagccacaggctttcctggactttacgttattattgaatcaacattgctcactatccgcctcctttgccaattaaaattccactttacatccaaccaccactttggctttgaagccactgcctgatactgacgctctgtcgatgtacaatgactattcttacacgtctctgtctactgaggaggatcctactcttttaacagaaacagtgccattgacttccaatcaactagtttccataatatccaaaatattagataatattccattatactcccaaaacaaataatgagtgatgttctctcaaatacacgtataatcaaatgtgacattgagaagatggggcgacctttgactcagagattgtattcaggcctttgtagatgcatttatttgacataattatgcatttaaaacataagttaaattgtcatcagcctgaaattataggggcttttgttggtgagaaacctattttatatataatcgtttacccatagaaatgtttttgattaatgttatctgttaaagacttcagttcacaatatttcccctgttaatagtatatatgtttttggagttgatctggagaatttgaggaccacgttctaatcgctatctgatgctattctgggaggacaattcattgcctttgggttgctgggggttggaacttgaaggcgggtctgagtctggagaccttgccactgacttttggaaagtctgttgattctacctttggaagtgcctttacatgccttatggaaggccgggcatggtggctcacgcctgtaatcccagcacctcgggattattgatgaataaatcaatttgggaaatgcttggtaaattcaacgggacctctcagaacaatgaatttatatggccacgatgttgttttctggtttgtttgtttttttgtttttgttttttttgcaaagagcattcggaagactttctagtacaccagtttgggaactgttggtggaggagtcagggtaattaggctttggactattccaggtacaggttgtcactgtattcaaggaattgttcttagtctttgtatatatccgaattaactatagcaaattaacaagcagaaatataagaattgggccttggagggagggagagggcgagagagaggggtagatagaagtttcctattttaactatggttcaattctaagcattctaaaatttcattggattcttttaactatgaattacaagggtgtttaatttccaagttcatgaagcctttggttaatctcttcattattaacttctaaccttaactgcttcatatttaaattatcaattttatggtgtggattgtaccaattgtttttcaatcttctgacgtgcttaatggattaatacataattaatgtttctcccacagtccacatatgcttgagaagaatacagaatatctgattattgggtacagaggtctatatttgtccattacatcacgtccattcacgggttattcaaatctatatatgggcattctgtgtaacttacttatggtaagcagggtatgttgaaatctccaaatacaatggcagactcgtcaatttctccctgtggttttatcagtttttcctctgtattttgagtctattttgataggtacataaaatatgaaaattgctacaacctcctaattaacagtcagttggcatcaagctgttactaatgctttgtgttccaacatcctatcttgtttgaaactgaagctccatcagttgttttggttaatgtataccggcatatctttctctctctctctcctttataaaaactttcaatcttttcacatcctcatagtttcaataagatggattagaacagctggatatcgttttattagttccatctgtctaactggtaactttagtccatttacagttgttgtgactcatttatgtggacttccttctgtcacctttagaacttccatttctctcactttccaatataattttaatatctcctcctgggattccactaagacgtattttagacctcattctgatctccctctccccgccaaccccaccaacttctgccctgtcatttatcctcatatctctctgtgtaacatatggacttactttttggagataatggtctaaccaattaatcctttcttctggtgtctaatccatccactcggtttcttatttcaacaattccattttatatttccttatttcattttattctgagacagagtctcactctgtcacccaggctggactgtagtggcacgaacctgcagccctggcctcctgggctcaagtgatcctcccacctcagcctcctgattagctgggagtataggcaggtaggtgccccatacacagcttttttcttcttcttttttttttggtggtggtggggtattttttggagaaacgagttctcaccatgctgcccaggcttgtctccaactcctgggcttatgccatcctcccgcctcagcctctcaaaaagtgctgagattacaggtgtgagacaccatacccagctatatattttatttctgtaagttctatttcatccattttcctttcaggtcttcctcatcattcctggtggtcttactgctcctgctcgctcaattttatgagtccatctttttcttatataatacatttatttcacatgtaactattttctcacaattctaatatttgaagtctgtattctgtatctgataattccaaaacctacagtctttgggaaacattcattgtttctgataattctcaaatatattgggttcactacttgaatgctatgatttcactgaattcatagttgcctgcttttaatctttgggaatcctacaggcttaagttagagatggtttcctagaaaaagtatctgtgcgtgcttctgatgagagctgtggggacaactaacaagagacccctttaccaccgtccgtaatcctgatattctcttggattctcctggagaatgtcaggattacacaaggttctcaaatttggctccccaaccttgctcatttatatacagaagactagactgcttagtataggtgatgactcacttcctcctaccctggaaaaaacaaaacagatctctcatctgaatgtgatcacagactaggaaattctgaaggtgaataactggaggctgtaggcagcagggaaagacaggtgtctttcctgaccatagaaataggtcacaagctgccctaaaggctgtgtgctccaccaggatttcactatttagctcaaccagcagtccctctgtaagagtgaacggaagcttcttagagcaccacgctgcctttaaaccacaaattcttgctaaaagtcatggtcatggtaaaaaacctatggctttgcaaggctttcttggtaatgtcctagaattaaggttaagcctgcgtttcatggtaactgaacaggaaaccagcctgaccaacatccttctccccaatggcttgctctcagctcctcttgcttgggccttgggcagccagacggtctggttttaatccttgctctgccacctgtgaccttggacaagttacctaccttcagttacctcatccacaagatgcagatattagtaataccctctttttaagttattaagaggattgaaagagttaataaaaagtaaaaaaaagacttggtaggcataggcacagaggcgggaaaaaagcaataataaagaaatgatacttctatattttctatagatcatctttgtaacaagaagaaaacaaaccaaatgaaaatgaaacaaattctctcaaaaagaattaagtcaagacaggcagaaggctcacaaagtaatataaaatatatcttatggtttatggaaaattcttaataaaataccttctttgctccaagctgcactctggctttgcctttgagtcacgtggcatttctttgtacgatgaccggttctgtcgagtaggcactgcttcagccctacaggaaggaaaaaacatctctagaaaacagcagcattcctgattcccacttgaggaggcctaacaaaacggcatatgcctcaacagcagcacatcagtgttaaaaagtctggagtcaaggggaaaaagtaaaattggaccatttccagaatctcaccaaaaacaacaaacggatgttgcaagtggcctacatgagcaaattagaaccttaaataaaggtcactcttaatgcctatcccagcatagatgcagcaccaagtacagtgtcattttactgggttacctttttcattcttgaaagtaggagctatgaaaaaaaaaacactaaaatttcttgaagagaaccttctacttacaacctaacttacgtaatcgaaacactctattgagggtgaaaattgagtattataagaaaataatcacctgttttgtgagaagttcaatacgtaatgctcctccacacaatacataccttagaaagaaaaaaggaaacatacaaaactatctcgagaattattcctgcttaaacaatttctacatgccattactaagaaagtatgcacacagtaaacatgagaagagaacatgcaagcatgaacatacttgttagggatacaggactatgggtaacttaaaaactctgttggtattactctcatgtaattgctctgaaattctagtcaactatttgcaatggctcttagaacagaatactttgaatttttatgatatcaaaaactaagaacttagccaagtattcccaagaataggaatagtaagcatacttagtaagtattccaaagaataggggcagaagaacgcatttctttaaagcactacctcagaattcaatttagtaattccgatgctgcctgtaacatcagaaaacaacttccttaaaaacatagcaagttggatttaccaagttgctgaccaggtcgcattccctcctgccctcaatcccatctttgtgttatactttatctccagtaccattttgcttagtattcatggtgctcaagttgtcactgtggacatcagagcctataaatatatattgttctggctccttcctgtacatctttccaagtcatacctgctattctccaaagtctgtgaatcccgacactaataacttggaaattcagtttaaggtcctcttcagaaggtcagttagctcaaggcatcacatttttctcaggactcttaagaaatactccaaccacagaaaaaggcccttctttctggtatcaggagccattggccacaaacacaaatccaatagagtttcagccatttacctcccacatcgtcccttccctgaagttctagctaaagcaggaaaaaataatgaaaacaccacctgcagtcacgaatcctccagtttcctggccaagatttcgtatttccttcaagatacctcccaaagaggacatgacgagggaggggcacacagggtgctacaggtactgataaggttttatttcttttatatatatgtattttttgagacggagtttctctcgtcaccaaggctggagtgcaatggcacaatctcggcccactgcaacccctgcctcctgggttcaagtgattctcccagctcagcctcccacgaagcgggggttacattacaggcgcccgccaccatgcctggctaatatttttgtatttttagtagagaaggggtttcaccatgttggccagcctgctcttcaactcctgaccgcaggtgatctgcctgccttggcctcccaaagtgctaggattataggcatgagccaccacgcccagccaaaggttctatttcttaagtttggtgttgggcatatggatgtatgatttaatgttttaaaaaaggaagataccttcctagtttttttgtgttttgttttttttgttttaggcctgcgtgctttattcgttaccccgtatgaatccataaagaagtagccattagcaaattcaggcaatacataccggattcatacttcaggaagacaacccagttgacaacgacaacagtttctatgataacaaaagtgagagaaaatactgacattagggtcatatcaagaaagttcaatcataagatatatccacaagcaaaaatatacacacaaaaagctaagtacgaagcttttagaaaactactaccatccttagagtaagtacaagaaagtattcttttatgtctgtttttttcatcaaaataccgcatatagccatagattttaaaccattacatcttatctagattccattaacatttcttctagatcactaacatttcttctagattccatcgttattcctttgtaacctttattttcagtatcttaaaaatactttattaaatataacacatacattcagaaagttacataaaatatacctgaaggtataccttaacaagttattgtaaattatttgcccatgtaaccaccaacctggtcctgaaatatattccagccagtatccaagaagcccacagatgtccctttcaggtcacacatccctacctcccacctggatggactccttcccctaacctctatgtgatcacctctttgttcttaatagttttactgcccaagtatgaatccagaaataagtgtttctctgttttcttttcacttttgtccccctaagaagcctttttagaagttttcttcctaattctatccccactccccatggaattttaacaccacagatatactgtatgtcggtttatgttatacggccctttggagggcagcagaccattataataggtaagattttctttcactctaaggaccaattttcactccactgcaggcgatattgcctccactaagaatgtatgccctaaccaacattagttttccctattgttgaactctatatagaggaaattgtacaaaataggttttggggctctggtctctttcgcttaacatagtgttcaaggttcgtccatctttcccacatagctgtaagccattttatgaataccacaattcttcattttcttggaatgaacacctgggttactttctgtttggggttatgatacatgatgctactctgaacattccggtgtctcctggtgcctatgtactcatttcttgtggagtatatatccacaagattcctgaaccatagtgtatgagtatcttccactttaccaaattgttttccaaaacacttgtacaaatatacactcccattagaaaaacagagtcccgtaacaattttattaccttaaaagataagttaagcaaagtatctcctatgccttctttttcttttaagatctgaagatcactgtgcaaaggactagcagggtcaacccgaagaatcacaaaacaaaaaacagttcaaacaaaaagatatttttttttcaactaactcaaaaatgaaccaatctgaaagctaaaatagagcacctagggtaagttcaagaaagagaagatcttaagctgctctatatcctcaggaaaaacagaggtcactatagcttccagctcctttagaatgaatgtccaaaagagatcataatagcctaaatctaatctaataagggggttcagagtttgcagtcattctaaaggaaaacagtcacatgtatataattttctcaagaattcaaaagaagtttaatatgctttcctaaacttgtattattagtcaagcagttcaaggagaacaatttgccatggacggaactatgaaaagttaaatcactaaaaaatcggtatttttccacaactgtcctatatatagatttctaatatgactcccatcccccactcccttttcgtttgtttgtttgtttgtttgttttaagagacaaggtgtctcgctctctcacccagggtggaatataatggtgcaatcacagctcatgtgcagccttaacgtctccaagctcaaaagatcttcctgcctcagcctcccaccatccatagtagcttgtactacaggtgtactacaccgacgtattttaaaagtaataacataactacatctacaataagagttaattatattgctttcaaaactgggggaaaagtcataaaaatcaacttggcaatcattctctgtataatgaaatatattactcttgtttactttccaaccaatattattcaagcttgagctttttcctagaagataaaaatcaagcaagagttcactctatcaagaaaatgacaaaaaaatttcgatggacctataaaaacatttccaacactcaacatttcaagaagtaaaaaaaaaaaaaaaaaagtccaattaaatgaagcattatgaagtttcaagagaatataaaactagacacaagtctggttcgtttcctatttcttatcatctgaaaaactctagccaacatgttcagaccaccatggactccatgatagcacagaatttagtatgagtctattccaaaccccagcaatttttgaaaatgctagaagacactcaaggtgacacattactgactaagagagacttccattcataagactacaagcaagaatattacacagatggtctagttcacacattgacacactgagaaacacgtgtacctacatgcaactggtttcagtttttcagtgtggggacttctctaaagatgaaaacacatcgatatcttatcctaagactaagtagaaatggaactactttttagtcatgtgaaactaaaggttttaaagactgcactatactttgaaaaagaaaaaaaatcaagtttacgaagatctcacttcctagatatgtaaccatgacctcatttcctatctataaaatatgagaagtttctcctatctctaaactatgaagagcacctatttcacacagcggctatgaagactaaatgagagcatctataaagtataaagtacttaacatagtatcggtcatgcaaaagtgttcaataatttatacttgttttgaagataactcaaactggaatcgatcacaagacacggaaagtacagtaacattatttcaaatgctacaaactcagttttttaaataagatatgagaaatggactaaatttctttcctctgggaaaaattactaattaaattaatatataactaagactgaaggagggagagtaatctatctggtttcaacacttggcatctacttgcctaacaattcattccctgttttggagaacctgtgcccaagacaaagtaactggtcctcggctttcatggagttggtaaatagctctaatacaaggcaggaagtagtaagtgttcagacaatcatctgacgtttccctactctgtctgagcatttcatgtatacacacacatcattctcattgatttttcacagcagtcatccaaaaggtatgtactatctatccatactttagagttgagcaaagtgaaaccaaaaaaggtgtgtttgtcaccacactcagtgttcctttcacatcctgccacttcacataaaagagatgttaagtcaaaagagaagaattagttttgatttggtcagagcaggatggaccaaagtcaccttcacgaaggagaaataatttgagttgtgttttgtaggagagaatgaatgtgaatatacagatgccacagaaggaaagtaagcagagaaaacagcataaacaggctggaaaggggcatatacagggatcagcaggtggttccaggatgtgaacagcagatgaacagggtaaaaagtggctgttcatagatgagaaagataaccttgggcaagagaacatatgaccgtggctagggacggtggctcatgcctgtaatcccagcactttggcaggctgaggtaggaggatcgcgtgaactcaggtgttcaagaccagcatgatcaacatagtgagaccccatctctactaaaaatctaaaaaatcagcctggtgtggtggctcatgcccatagtccaagacacttgggagggtgaggcaggaggatcactggagcccgggagatcaaggcttcagtgaactatgattgtgccaccgcactctagcccaggcgacagagcaagaccctgtctcaaaaccaataaacatgtgactgaatctaccactaaggcaggaatggaggagagcagctgagattggcatgttcatgaattgcctgggattaactataattacttaaacaaaaatccaggctctagctatttatacacacttacgcagttaaatgctcttgtctttcagtcttcctaatttctctaatattgccaaattttctttttcaattccttcatcctccaactttttcccactaatgggctctgctttcatctcgtagtgatctaagtcttctatatcctgcaaaaagaagaaaaatgttagcttattcaacctatttttcttcagcagtttcttatgccaaaagttaaattattcttgactcaatgggggacaagaaacagaatatatctatcctacggggagagaggaaaagcccccacattccattcaagaggctcccaccttctatatcctacattttatttaaaagctacactctgggtaaagcagatttcaaagctttacaaagtcataactattaagaaataagccatcatttatttatttacttctttaatttttatttccttttttaaaacagagtctcactctgtcacccaggtgggcgtatacaggggtgatctctgctcactacaaactctgcctcccaggttcaagtgattctcgtgcctcagtctcctgagtagctgggatttcagacacccatcaccacgcccagctaatttgtgtatatttttagtagagacagggttgcaccatgttagtaccagcctatctggggctttataaagttaagaaaagagcctgtatgcatgctgaaggctgtgtgaccacagggcttttaaaggatgcttctgtgttcccacagttaggtgggagctcttggaaggatctcttttatcccagtgctcttgctaagaatggaaagcccctctgcataactgcagtagctggtgccatcctctgttcacttgcatcagagcctgggaggttgtggtctgcaaagctcacctctcataatgggacgccaatcaatagtatccgaagttgatatacccagaaagagagttcaaaaattatttagagaggtggaaaataatcaccagtagaattaaaatcagaaacgacaaagttggccagcggagtggggaagtccagattggggaatgtgatgtttcattataaggtctttcagcatttgcttgctttggtctgagtgaaagaattgtctcatttttttgagggccatgtacagcaaaggactcaccatctgtcagacacactggtcagttctggcaaggcagagttggaggttcctgtcctcaggtgggtgggcagggacggcagcttgccgtaaggtatccaacagcaccagcggcaggaaatgaaaagtgctcagtgattggtgggatagtggtgtctagcacaatgattcctgccaaaatcttaatggtggttgggcatagtggctcaagcttgtaatcccagcactttgggaggccgaggtgggtgggtcacttgaggtcaggagttcaagactagcctggccaacatggtgacactctgtctctactaaaaaaatacaaaaattagccgggcgtggtggcacgcacctgtaatcccagctactcgggaggctgaggcaggagaattgcttgaacctgggaggcagaggttgcagtgagcaaagattgtgccactgcactccaggctggccaacagagtaaaactccatctcaaaaaaaataaacaaataaagccacaaaaacaaacaaacaaaaaaacccaatggtgtgcaataaatgaaaatgctgccccagtcagacgggactagcatttttcagcaactttcaaggtcttgtgtcacaagaatgaagatccgagtatttcccacctgtggagggggctggtgaaggagttttcagtcccgggcaccctgggctgtgctgaaagcctctgcgtcacactgcgtgagttagctgggaaagagagctcccactgttctcttttaacccttgtccttttgtaccacagcaattgctttcctggagatcagaaccgtggctgggtttaacatcatctttggaaatcctaaaaggcaatgaagcaatttttctcttttcatttatatatttttttgatacagctgtgtcagtttgaaattttactttcgtatcagttctaatagtgtgtctgcttgacatagtttctattaaatgggcttgatatgaagttacttaaaaattcaagtatttagagtttcagggcccatcgtcttgatttttggggcaatacctcaatttcatactgtgttattcttttccagagagatgggtcactgaataacttacattttatgattgttttatgagaaactatttctggttacaaatggtaaacatctaggttttgcagtaagaaataatggattatgttagaaaaaaagaaccataagaagatgtgtttttaattttgacttcctgtaagtaccttctggagcagaaggttttctctttgtggattctgcatcttggatttggggactctgttgcactgagctgtgctctgtggggaggagcctgtggcagaacagtttgggttctgctggccgcctttccctctattcacggagtctgggtcccagagaaagatgacagcagttaggtcttgttgggaaaaaaacgcggctaccaaccctggaccattttgcttcccctgaacaaataagatagtcatttgcctacttttggggacggtgcctgtgctttgcacaggacgaggtggcagctggcttgcctgctggcctgcttcctggagataggatgctcagacccaccgctgctcttcaggggtcgtggaaggaattaatgcacttccttctgtcccccaatctctgtccctttacgtgtctctggagctgagcaggtattctttttctttcttcatctcagtagagctgttaaattaaatagatgttgcttaagccattcagaaaggtttcacattttaaaaaacaaaaggtagctgctgccatgattcctttgcccaccgctacaccgtgtcgttgtaggacagtccccacttggctgtgctgagcctgtctggaagtgtttctgattctaatcagaagtggaacagtttcagtgcagactataggttcatgttagtgatgaacttgggtggagatggggacacagcttgttctttcctcctggactctcatccagggtcctgagctgccaggggcctggccactctcaccctgagccctgccctggctgagctgatcaccgctgcatgtcccagctgccggtctgcctgtcacctgcagtgcacatgtgtgcatgtgtgtgcatacgtacatgcaccacacacataccatgcccacctcatacacaccacacacataccccatacacaccacacaccaaccacacacattacacacactgcatacatatcacacaccacaaacactacaccacgcacacaaaacatacatacacgctcaagccttccacactacattacactccacacacaccacacatcacactccacacacaccacacgcacatatcacattcacatcacaccacaccacataccacacaccatacacagtacactccacacaccacaccctccaggacgtcccaccaccatacacacacaaacaccacacacccacaccatactacacatttaccacatacacaccacacacactgtatctcatgaacacaccacacacccccgccacacacatttgcatgcaaactactcattgaatgaaaccgaatgatttagttttccccaaattaatactgcctgcctgtgcacccctggctgtcctggccggcacatcccccggtcctgccctcccttgggtcagcaccgcctcctgtgtctcaggtgtctctggctgtgccctgtggcgtgctcatgtcctgatcttgtgggaggctggctcctctgctccagtggctgccttcctagaggagaccagcttgtttgtcacctctcctgatgcccagagcagcagcccacgggggaagtcctgcttcctcccttcgctgtctgcccttccccacaggttgttttgtctcagtgctgatatctccccagctagaagaggagaccctcaaaggtgcacaggtggatttgattataatgcaggtgaatattaaatgcgttttggtgaaacactcaaccactacatacatctttaataaagtaaaatgtccaggccccctctgctcccacctctctctcccctcccacctctctcccccctcccacctctctcccccctcccctccccagaggacgtggctgacaagcctttgaggggtttcccctttctgtgtgcctttgcgtgtatgtatgggctgggcggtgtgtgtattctctagacatcttgacggacctgtaactgggatctacacacgtgcgcttgctgtagctcacttgccattttccctcaaaaataggcctgtaaaatccctcactgtagtacgtgttgccctgcctctttaaaaatgccaccaactcttccagcacgtgaactctgccgtcatttttttaaacattctcttatttatgggtacttaggttgtttccagttttttaagagattgcggcaatgaaaatcttcagctatcatttttcacagtgctgtgggagaacgtggttggaggtgctgtggcggtggagtggccccacacgtggccaggctttgtggggttctgactctgtccttgccaatgttcctccacacagtggctgcctctggggaatgatggctgtgtgagcgcccgccatgccccaccagaagagtctaccatggcccaccggaagcgtctaccatggcccaccagaagcgtcagagcgcggggagcagcatgttggaccacagggcaaggccgggtcctgtcccccaccaccaggagcccgagagcgaggacgtggagctgcccttggaggactatgtgcccgagggcctggagctggtcaccctgcggccagagagccccacgcccaagaagcaggagtgccacaaccacagccccgatggggactccagttccgactacgtgaacgacacctctgaggaggacgactatgatgagggcctccctgaggaggaggagggcatcccctactacatccgctactgccctgaggaccaaagctacctggagggcatggactgcaatgggcaggtgtacctggcccacggcgcgcatcctatggacactgacgggtgccaggatgcagtggactggacggcctgggcgggcctgcacccccatggtcacggggctaaaggtagccaggactaccctgatggccaactgcccatcacggaggatgtgtcctccgtcctggaggcccacgaccaggaagaagacggtcactactgtcccagcaaagagggctaccaggactactaccctgtggaggctaacgggaacaccagcgcttctgcctaccccctgaggtgcggggacggggacctggaggaccaggaggaggacatcgaccagatcgtggcagagatcaagataagcttgagtatgaccagcatcaccagcaccagtgaggccatccccgagcatggacctgagccagggcctgcggactctgcagagggctgcccacccatcaaggccagctgcagccccagcaggcaagaggcgaggcccaagtcgctgaacctccttcccgaggccaagcaccccggagacccccagagaggcttcaagtccaagaccagaccccagaagagaggctgaagtggcctcacgagcaggtaggactctagctgtcccggggaagggagcagaggggccctagagcaagggacctcagggtacaggcctcgcagatgctgaagcgaggcggtggggggtgctgggtgccttacagttctaatggtggctgagctcttcattggtccagttgggagacatgttgcgtggatgctccggccactcttaagctcaccgctcagactcaggactaaagccggttgagggctgaggggcaactcgtgtctcgcagaagacacccctcctcccaccctagaagacaggttcaatttcttgcccactgccctgggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtgtctgaaagctggggggccttggcctgacgggcaatcagctgtgaatacctatttggaaaaggattttttgacggtgtgacaaaacctcggggaagaaacgcatgctaatgagggcagtggatgtcagcataactgtattttaattatagcaaagtcagcgtgcattctaataaacacatttgaaaagccgccttccaaaaaaaagcctcactgtgagtatatattatagaagatgtgattattggactcgggtgaaggaacttctatttggccaattatgtggactgctttcatattttttaaagctttaactactatttttttctgagaagaattcatgaatgtgtgtgtgtgtgtgtgtgtgtgtgtgtgtgtgtctgtgtactgagagcttgggtttggaatggaaatcatattgactcctggattttcagcacttgtatcttaatgtcttgtcttctctctagaacacattgtgtcagttgacttcactttggggctgttcctgtcattcacagcaattctgtgtttacagggggctgtgggatgcataggaagtcctatggtgatggcaggcatgggaattttaccccaagggactatggtaatagggggctgaccaagaataactcctaatcctatgtcacataataccatgagcagctcaggaaaactacgcacaactcagacatgtgcagaaaggagatgtggaatgaaatggagccccctggccttatagaggcctccaagacctgccacacccacgtctgcccccaactccccagtcaaccttcagagaagagaaggtgatctctctccagctgagaccaagccaaggcccaaactgttgtagctgaaggatgtttgggctaggctcatagaagctgttccactcctgcagtgtcaacagctgcctgtggtccaggcttctgtctggtcctgggtttttttttttttttttttgagatggagtcttgctgtgttgcccaggctggagtgcaatggcgtgatctcagctcactgcaatctctgcctcccgggctcaagcagttcttctgtctcaacctcccgagtagctgggattacaggcacccgcaatcatgctcggctaattttcatatttttgtagagacagggtctcaccatgttggccaggctggtctagaactcctgacctcaggtgatccacccacctcagcctcccaaaatgctggggttacaggtgttagccaccgcactcagccttgaagagacactgggccttttaagagacactgggtgctgactcacttctgggtctgccccatgggtggcccaccgggtctgctctgggtgcagccaggctgtgcacgtcagggagcctgagctggacttaaggtggggagacatcgctccccaagagctgctcgggtgcgacatcagggtggaggctgttgctgtgtgtggcggcatcactcatttaccctcgtctcatcagcctctgtccttcggctcatctgcttgcaggtggcctctgattctgcctctggagcctgtctgccccctcttgattcattcattgggtcccaaatatgtgaacaatagcatgctagccacttttagaaatatttgtgttcatcttcaagagaggggggtcatccagccattccccagccctcaaaacccactccacagacaaagcagtggcgggtcagggctcctcttgctcttctgagccgctggcatagcgaacacggtacaaaagaaaaggatttcacatgcaatagaatttcattcaccctgaaaagggaaggaaattctgacacaggctacaatatggataaaccttgaggacatcctgctagagccagtcacaaaaggacaagtactgtgtgattccacttctctgaggcacccacagtagagtcacagagacaggaagtagaatgcgggtggccaggggctggagagagcagggagtggggagctggtgtttaatgggtgcagaggttccgttgtgaagatggaaaagttctggagatgcatggtggtgaagacggcacaacagtgtgaatgtacttaatgccactgaactctacacctaaaaatggttaagatgataaattttacattatgtatatttaccacaataaaagaaataagaaataaaaggtttttggatgatgaacgggctcgagccaatttggaccctctaaagctaagttgagccaggctgaacccatgtagccagaatcatactggattaggctgttctagcacttcacgtggtgagaatgggggagagagagagagattgattgatcagggggctgtgcagggggcgtgctacacacttgtaaacagccagatctcttgtgaactcagagcaagagttcacctatcaccaagaggatggcccaagtcattcatgagagatttgccccatgatccagacacttacctcccaccaggccccaccaccagcattggggattgcatttcaatatgagattgaggtggggacaaatatccaaactgtatcacccacaaagaagcaaaaacattttgggccaaatcaaaactattttgatgtagccacagtagggatgagctgtgattacacccattcaggcctgtggacctgcggacctggcgtgtgtggtcgtggggcggtgggtgggcacatccctgggaggtttcaggaggacattcaagaccaaaatgagccatgagtaaataatacaaccacatcctgagtgggagtgggggagcctccccttctctcctaggtcttgtatgggtcatgatcccaccttggcaggagtggaaggaacacagatcctacaggttgtggcttatagtaaagtgactgtggtcatgccttgtgagtgtcattaaaataaacagatatcgttaaatccactatcaaataacagcgatttctgctatcctttcaccttttccacaagtttaaatatcccagatattctactgtgtatattcctaaaagtagacaggtagatttagtgaagttaactggatcattggtatcttctttatagatcatctggtgaaacttgttttgcaaattatgagttgtaggcctttgttttaatgtctgtagccttaggcagttccattgagactaactcagtttttttcttattaggactaatcttattgaccggaactgtggactccccgtattaggagaacagagatctggcctgtgtaaatgagtggaagttaaatactgtagaaaatgccctctggaaactgaaatctaatgctgacttactattggtcatttaatttccttctggcttgggcaccatcgttacattcatttttcagatgtcaagctagttttctcagaatgtgtgcagggctcgaggccgagtgtggaggccactgggtgaatacaggagaggtcacaggtcaagcctcctgcgagaactgcaggcttgagccttcgatagagccacgtgaatgatttttagccccactaggttgctgtcattaaactatgcacacagggcttcttgcttttaagttagcaggatggaaaaattgcaggtgtttgcagcaaacatgaagaaccagccatgctggcccctaagcaatggtattacaaagggttggtgaagattttctcatttgagaactgaacaaaaccaaatggaattctccctagttctgcagctctgggggctgtaagcggcggagcttccaccttccctacaaacggacccagagtggcacctggtatgtgaggcaggtgaccaggagaagggggtgtcagtggttgatgggcagctgcctctgctgcctggttgacccagccccttcctgggtcatctcccactttgcctgggtgtcagtcactggagggttagcgcagtacaagctggcgggtgacctccgtagagcttaggtgaaggggctctcacagggcagtatgtttgagacccttagagggctctccttactcttgcttctcccattatttttaaattgtagtaatacacttgtaacataaagtttaccactttaaagtgtacaattcagtggcatttagtacaatgttgtgcaaccacctctgatatttagttccagaacattttcactgcccccagaggagaccctgtacttattaagcagtcactcctcattcttccctctccccgcagcccccacaatgaaaaatctgttttctcactttggatttgcctattccggatattccataaagacgggatcagacaatatgtgccctttagtgtctggcttatttcaccaacataatgttttcagggttcatccctgttgtagcacgtgtcagtacttcgttcatttctgtggctgaatgatattccactgaatggctatgtttttattttcatttttactttttgagatggagtttcactcgtcgcccaggctggagtgcagtggtgtgatctcggctcactgcagctgaagggctatattaagtttcatttatccattcatccactgagggacatttgagttgtttctaccttttgattaatgtgaattctgctgctgtgaccatgtgtatacaagcttttgggaaattttatttggctagtcgtaactttaagttttgttttggctatttattgttgcttaaccaattatcccaaaacttaatggcataaaacggcaaatttgtctctctctcactattgtatgggttaatgggctagctggacagtttttctgctggtctcatttggcagctctcactgtgcagttagacagtgtcagggactggtcgtctggatgctcagctgcagtggaacgtctgagacggcttcttcacccacaggtctgctgccttggtgtttcttcatgtggcctttctacatagcatctcatactcttggccctcttcatgtagcttctctttctccaagaggatagtcagttcttctttttggcttccagaagcacaaaagtgcaagctgtcagatgttcttaaggcttagacctagaacaggtccagtttcatttctaccacattctataggttaaaggaagtctcggagccaaccttgattcactgtggaatgggcccttccgaggacctgaatgacaggagttgtggctcattggggaccaactccaaagatgaagcctgagttctgagaactttttcttctctgattactccttattcatattttatgttttgttttatagatgtaatatattcacaagtgtctttaaggagctattttgatactcttttgtcctctccctagcaggtcttttttctttaataatttttttcttagtttattttggtcttagttttctttcaaaagcctttcccaaaatatctattctatgttgctcatcatttgtcatcttttttaaaatgcccccttttgttcattcatatttgagagaaggactaaaagactgactgggaggctgggtgtggtagctcacatctataatctcagtgctttgggaggctgaggtgggaggatcacttgagcccaggagctcaagactagcctgggcaacacagtgagacccccatctctagaaaaaataaaaattagccggatgtggtggtgcccgcctgtagtcccagctactcaggaggctgaggtgggaggactgcttaagcccaggagattgaggctgcagtgagctatgatcatgccactgcattccagcctgggcgaaagagtgagacattgtctcaaaaaataaataaataaataaataaataaaaaagaagtttgggagttctttctggccaagacttgtcaactgatagcttttaggggaaagggtttttagggggaatttatgctgattcccaattgttatccccacccctctatcttatctctttgcgcaatcataaatgatggcaggaactactccattcctctggaggtgaaatctacgttctcttgcctgaggtagatacatgtttgctggggttctgcttaaggaaatgtgggagaacaatgtgtttcagggcctggaaaatgtgttctgtatgtaggcttttggttaatctgttttcagtcttgcctatcagtcccactctccggggtacctggtgtcggagtctagtgcctctgcagggtactgtgggacaaattagcctccttgttatcggtatccccctaacctccacctttgtttgctttgcttcattaattaaccatttcccatttactgtcattgtctattggaggtgaattctcttctcttggtaaccccatccctttttttttgtaattgtgtgtgtttatacaatctttattcttcactgtaattcccatggagcctcaggaaaaagagcagatgggagaaatacgtgttcagtgttcagttttccttctgtaagacacctgcaacctgtgtttttcacagaatagaccatggacttaaagcataaagagctactttgtttttcatgattgtgccttcaattctatgtagaaatataatctgtgaattacctgatgaaattttcctaattttgaatcatccttgtatttctataataaacactgttagaatgcatacggtagtgttttatttttgcatttttacttttatattaaataagattatagttttgtttccttccttctaggctcttatttcatttccgtaccaatggtatgcagggctgacttgggaagcttacatgtttttctaagatctaggatgtagctctagtttacacagtaattttcaactgaaggagatttttgccccccatgggatgtttggaaataatctggagacattttcggttgtcacaactggtcatgatgggaggtgctattggcatctcttgggtagagggggtgttactaaacgtcctacaacacacaggagaaccctccacaaattgtctggcccagtatatacacatcgctgaggctgagaaaccctggtttaaataaatgtccaatttggagagtgagtctttgactgccatttttcttcttctatgtgttggtctccagatttcccactttttcagttagttgtagtaactgtagattctttaaaaaaaaaaaaaaaaaggattgcttcatctttacttctaggctgctgtaaagatgtataaggttttcactttttgcatcatattcacattagaaacagctgagttttggagggaacacattcaaacggtagcaaatttagtagagcaaattccaaagacattgagtctaggccagttgtcagtcctgggtataattttagatgttttcaggctctgaagctttccatttaaatgcaaatttcggaacaaagatctgtgtctctgcactgaccaaatagaaggtatgtgaatgttatggtcttgattgttttacaagattttttctgcaggtacttttgcaagtgtgtagggagagatgagaagttccaaggaaaagggtgtgaggtctttggggccagctttgagctggcaaggctaaattataggaagaaggcagagaggtgggcagagaccagatgtgggaggacttcctgtgtcatgccacggagtctggactccaccctgtaggtgacgggagccaagacagggcttggcacaaacacatggcacatttgtggttaagaaacgtcttccttgcttccttgtggccttgagggatgaattaaggggctggaaaaccgggagcaggacggcctgtgcccatggttcaggtgagagccgggtgggtggcaggggctacggagaaggcggttgagtttagccccagttcccaacaggtgctgtggggaggaagaatttccagctgccaggtcagcctcttagatccatttctctttttttttttttttttgagacggagtctcactcttgtcgcccaggctggagtgcaatggtgtgatcttggctcactgcaacctccgcctcccaggttcaagcaattctgtggcctcagcctccctagtagcagggattacaggcgtccgccaccacgcctggctaatttttgtatttttgtagagacagggtttccccatgttggccaggctggtctcgaactcctgacctcaggtgatccacccgcctcggcctcccaaagtgctgggaatacaggcttgagccaccgcgcccggcccttggattaatttcttcatgcttaaaatgaaggaaacgtgaatcattgataaggtgtcccctctttaacaaagcaacagatggtttatcagggcctctcttcgcaggcagtggggcctcatccacaaccctggaaaagaactggaaagcgttgctcagccaggtacggagggcagggccatgtgggactcccgtctccaggccccctctccccagctcccgtttctttctttctttctttctttcttttttttctgagacggagtttctctcttgttgcccaggctggagtgcatgttgctgtgcactttgagggcaggaactggctcctgctccagtttgcatcctctgcgcccggcaccaggcccgtctgctcaatgcaggataagcaggtagcttcgggctgtccacccagcccttgcagagggtggagctacagagagcatgagtggccaagatgaagccctcattggattctttgactctttctactatgtgagatattcttgatgtctgagggatgaacggcaaacaaagtgtggcctacccatacaatggggacagtagttagccctaagaaggaaggaagttctgacgcacgctacaacacaggtgggccttgagaacgtcacgctaagtcaaagaagccagttggaaaaagacaaatgattgtatgatttcactcacatgtggcacctggagtcgtcaaattcagagacagaaagtagaatggtggctgccaggggctgggggaggcggaaaggggagttagcggacacagagtttcagattgcaagatgaagaaagttctggagatggatggtggtgatggctgcacaacactgtgagtgtatttaatgccacagaatcatacacgtagaagtatttcagatggtaaatttcatcttttgtgtatttaccataatttttaaaaactaagaaaattaagatatccttgatgtcagatgccaggagagcggtgtcaggcatctcaccagccgattctcccagaagttttcctccatcgggtaaccacgagcctggggtatcacaaagagaagcctcagtgtaaaatcaacaatctcagtggagtggcttcatcagggagtgacaggggcgtgatttactactggaggacaaggcagcaggcagggaagatggcccaagcctgctttgaactgtaaggagcacgcagaacctcttatccagacccggagggctgccctgttgacagcacaagcagctcagggccagcggcgcaggaaaaccccagggtccagccaggtcacgggcacaggcctgcactcacgggtcactgcagtgaggatggaggtgtcactgcaaatgcgtaagaggatattttcagcaatagtaaaatttttaacagattttagaaatgaaagggttccccctgcatatgtcaagaacctgagtttctttctgaaacttgggtgggaccctttagagttgcttcaaatagaaaacacaccatcggcggccactcccctgaggaaaggcagacttcatggctgaaagcgtcacccgagtgctcccggttttcagcatcacacggagtggctcaggtgcccattcattttatgagtcagcctggggagagtacccacagattcggagtcacatctctgatgggacacaagctctaccctttccaagcattgatgatcctgaggttgatcaatactgagcattgatgtctgtgaaaacaaatcacttaggtgcagagacaccgcaatgaccatcccgccgggggcaaccgcctgattccttccacatcctggtcaacatccctggccaacagggcagcccacggacagctgctctgcctggctcctgctgaaaagccaacagcacaacaactctgccctccatacaaaaccacatgggccctcgagatcacactggggcgccccctttgcccccacttccttgggctgtggctggcctgtctgacatttgctctgggagatgagccagggtctgcccaggccaccacgggggcagagacgtgaaacaggcttcagctactaattttccattaaacgacaagaaaatcggctattgtgagaagagtcacatgaaggtacccaaaagttgtcacagtccactcactcgaaataaaacccatcccattaggaacactgtcattgcagcccatctccagcactctgctctgtataaaagactgactgtggcaagataagggtttaaaattgaaaatcaaagagccattcctcagtgatacccaggaaatgacgcacacgggctgatattaaacccacccacaccaagaatcctaaaagttaacgtacagattactcgttttcaagcaacacacaatgatacaagtaagtcctcaagaagactgcatgggttgaggcactggacttctaatcatgccatctctcagctcaggggtccacgacaaagctaaccccactgagatgaaaagccacttacccctttttcatcactcgcaatacaaatttcagaacccatcccaaactggaaggaaggatacgactgaaactcaactcatgcccagctaacctgggaagtacaccctcctcagataatggagacccaccaattcccgggtgtcagacgtcacacaacctcttctcccaccagggctggggaccctcaggaaagtcaggtgtccctgagaaacacccggcaacatgcagaaccacagagacaggaggcaaggttccagacaaatacacccagtagacagttaaagatttcagagctggagagagcttaggacaccccgattctcagactgcagacagcaggtggacaccactgagctggcgacagccccaaaagaggtcagcttgactgcgacgaggggacgtcttcattatctgtccagtgctctctgacatcaccccaccccgcctcctgtagcagtgttctatctacatgaaattaacctcacgtataaaacatattcctggttcattggcaaacaggcagctctgagcagcacattcagaagttgccaactttgggaggcagaggagttcgagatcagcctgggcaacatggtgaaaccccatctctaggaaacatttataagtcagctggatatggaggcacgtgcctgtgatcccagctactctggaggctgaggtgagaggatcacttgagctcaagtggtcaaggctgcagtgagccaagatcacaccactgcactccagtctgagcaacatagtgagatcccgtctcaaaaagaaaagaggttgccagattaatccagtacacacttctttaatcccgtagtaaattttctctttatagccaattcccaaagtcaagtatattgactcataaaaataccttctgggaagcatgtgactgatttccagctgagaggccctgccactggatggttaagttcataggccccagagtcagaagggggttggaatctcccctctgccatgcctgctacttggccttgtgtacgctcgcgctcgtgcgcttgtgcgctctctctcgctctcgctctctctctctcatgctgattctgcaggcattctacaggcctcccatgtcccaggagccagctctgtccacagtgctcttcctgctcctgctcctggccaaccctccaaccaaggtgtctaggagccacagggaagagcgggttctcttgctagttgctcttccactaggctgtgacacgctggccgagctccgcctccaccggctctgaagacagcacagacaactgttccacctcttccacttccactgagcagaggaactgcgtctgaatgaagccagaaatggggcatttggggaccgcaacagagaacggatgcctagcagatgggaagacgacaaactaacaaacacccaggccttggacccacgcctcccggtaggctccctctcctctccctctcccctccatcacacttcgaaccttcctgggcctggatcaccttcctggaaagctgaccacccccatgcctctgggcgccactcccctgccctaccaccacagggcaacatggggccacatcacgccaccctgcagctcctgttggaagaggctgaattcctggcaacacccacccatcagtcccaagccccgagcatcagtaccttcatgcaaaaggcactaggttggctgctttatctcataagatgagaaaatgatgcccatcaccataaacacattgttagctggtattgatagctgttaacaccctgaacaaagactaaatgaaaatgatggaaactagtgtaaaaagtctatgatgtgcaaaataacaaaatctaacctagcagtagccactccctaccacttgtcacaaggaagcacgaggaactcacagcaactggcagctcctgcagggcggacactgcaaggtcaacgctagaacataaatgacagggaacaactgaggatgaccctgagcttcacagactccagggcctcccctggggccatgggtcccagtggaaatttggtggcacgggcagcacctcctggcacagtcagggtgggggctcccctcaaccagtttggtccacctccatggaccctttggccactgagtcacacatgctggccccaccacctgctttgagaaccagggctgtgccctaccctcttctccctaccccctcatctgcctgtgcacccagggggccaccaccactgcctgggggtcctcacgtttggaggaagcagctgaggctaccagcggctgccagcttgctggcatgggtcccagacattgccaccaccacagccactgatagcacctgaggagaccctctgagccccctgcctgaggccaagcagcagagaaagccacatcctctaaggcccccatgggtgagtacccatgtgacagcccccgccagaccactgcccttgcctggagaaaccactccctaagacccctctcctccagcttgcccagccacacagggaaaaaaactcacttaaactgtccaccggcctgcttccactctgtgacacagcggctgccctggggactgctgagctacagggacccccagtcaaagagccaacccactgaccatgaagcagaaaggccctcctgaggagggccccagggatcgcagagtggactagtatcaaacacccctccacgatggaccccataacaaaaggcataaataacaaaaaagaaaggtcgacgatggcaaatgattctccaataaaaaaatacgagaggaagaatgacaaaccatttacatcaccagagagactgaagcaaggtgggcaggcagtccacaaatttaaaaggcaacaacttttctacagaccagccatgatcagctagaaaacaaggcaagaggaggggatgatcccagtgacaacagcagcagaagtgagagacgcacaaacatgcatgaataaagcaatgaagctccagtgatggaggcaaaggactttttacataaatcaaaatctggatgagaagaaaatacaaaagctctctcctctccccacccccaacccccaccataaaacccacagagcaaccttaatcaaaatcccaatcagaatatgggatgaatttagtttattctaaagtttatctagcggccgggtagggtggctcatgcctgtaatcccagaactttgggaggccaaggcaagaggatcacttaagctcagcagttcaagaccagcctgggaaacttggaaaaaccccacctctacaaaaaacacaaaaattagccaggcgtggtggaccccgctacttgggaggctgaggtgggaggatcacttgagaccaggaagtcaaggctgcaatgagccgtgttcgcaccgctgcaatccagcctgggtgacaaagtaagacagtctcaaaaaataaataaaataaataaaataaggcttatctattcaaaggaatataggagaaaggttggcggagaatgaaaaaagaagaggaatgaagaggtaatggccctttaagataactaagtcttaccaaaagccaccgtaacttacacggtagatagtggcacaacaataaagcagtaaattagaatggagaatccagaaacacaggagaaacactcagaacacagcagctacttaacccatgacaaacctgccaaaacagagaggtcaaagtggctgactaggaaattaggttggaatcctataaaaaaaaaaaaactacatccacaaatcacaccgtatctaaaatacattttagatcaaagaagagatgtaaatgtaaaaaaatcgagactatcaagtattagcagaatatgcaggagggtggttatatacattagggtacagaaacccattctctaagtaagatacaaaattcaggagtaattaaagcaagcttgatagttttaacaatgtaaaatttccaaatttttacattgccagagatgtctttaaacaaattcaaaggacaagtggcatctgagagaaaatatccgcaatatatatagaaaatgaggaataaccctgtgtaccaagaacacctagaaatcaacaaggaaaagcttcacaaatcaagagaaaaacaggcaaggatgaaaaagagaattagaaagagaaattcaaattagtagtaagcacagaagaaacagcttcttataattcacaatttttacaaacacaaaatgaaataagctatcactttacacccacttgactgaatgaaacacaaagactgatcatgtccagagagcgtcgatgtccagagagtgtcgatgtccagagagtgtcagtggggacaccgctgccccacacactagcatcatttagaatggtcaccacctgtcaagagagcaatctggcaatatctgttgacactctgaatgcccaaaccattcagccccgcaagtccacttctaggaatctatgctacgaaaacaaccccatgcagatgcaagggtttaatgtacgagactccacctgtcagcattctccgtgagtgtgaaaaacggaacaacccaaaagttcaataaataaacagtcacatattatgcaagcgtcagaataacgctgcttgcgcaaaggacaagggaccatctctaagacacacagctggtgagcggatcgaactgcaaatcttatttacagtaggatcccactttgttgaaaaatacttttaaaatatgtatgtatttaaaagacaagtaaaatacgtccacagacagaaaaagaaaacgggaggaatcgccaccaaactgtgaacaatgattatctttgtgggcactgaatggggcagtggtgaagttagggggaagctttcattttctattctacatgatgcatttctgtaaagttctaatctttataattagtacatttgaatttcataatcagaaacagatatttaaaggatctcaagatctatgttatatagctctatcatatgttaggcgccacccccgttgatggagccagggtccttctcaactccaaattccactgccagaaaaatggcacctttcttctccagagatacaagataattgcgagaaggcaaaatttttttaaaacagagacatcaagccaggtacagtggcatgtacctgtagtcccagctactcaggagaccgaggcaggaggattgcctgagcccaggagttcaagtccagcctagagacaacatagcaacacctccatctcaaaacgcaaaacaaaaactacagatggcagatctatttaatgattagctctggtggggagcactgcccctcagaccttgacctacccaagcagcctctagttgttaaagacttctcagtattggagaataaaacaaaatagacaagcactttaaaattcaccagaagttaggccgggcacggtggctcacgcctgtaattgcagcactttgggaggctgaagcaggcagatcacgagatcaggagatcaagaccatcctggctaacacggtgaaacctcgtctgtactaaaaatacaaaagttagccgggagtggtggcgggcgcctgtagtcccagctactcgggaagctgaggaaggagaatggcgtgaacccaggaggtggagcttacagtaagccgagattgtgccactgcactccagcctgggtgacagagtgagactccgtcacaaaaaaaaaaaaaaaaaaaaaattcaccagaagttcccaaggaatttgcttccacacatagaaaataatcgagtccgttttttctgaaaacttgctttaaagtccaattgtggggatttgatgtagatggttccattttaacttcttcagccagaggaaatctaaaaattcttccttccagctcaacagagcaaatccacctactgctctgcaaaaggaggacaaagatcctcctggggccgcagaattcagcagcttttccttggattcctaggacaaccaacagctgtgggacactaggccaagcttcaaaaggcagcctgccagccatcggactcccaggcacctgtggagtcctaggcggttgaggaactgggggagggcttggtttcaacctatttgccaaatcaccagcaaaacaagacatgttcaaaagaaacaagtgcacataaataagccagggctctactccccagcccatcaggtcaccggcccagcccctcagtgtgctggtgagcaggacaatcagaaaaggcctctcttcctggaataactaacagtctctcaccatccccactcccactgcccgatgtgtcatgggaagtctctgaaattcaggtttgggaaatcagttgacatgaactacagcataatattagatgtctgattaaaatcatcaagatgatacaaaggtctaatcgcagaggtgctctccactcccaacccccacatcaaatggagctttctctccttcaaatcagacttctttttttttttttgagagagagaagttctcactctgtcacccaggggagggcagtgacaccctcacaactcactgcagcctcaacctcctgggcttaagcgatcctcccacctcagcctcccaagtagctaggaccacacccgtgagccaccacatctggctaatttttctatttttttgtagaggtgaggtctccctgtgttgcccaggctgatctcaaactcctgggcttaagcgatcctccctcctcagcctcacaaagtgctgggattacagcatgaaccaccgtgcccagccttcaaatcacatttctaaggagcctaacaagcagcaggcctttccagttacagcgcatggaagtaacaaaggcagcctcagccagcatccagcgcagtcccagcagacagggataatgaagcggacgtgggcctcacgggagggaatactgtcccccacctccacaccatgctagtgagaaaaacagactgcctgcagctccaaaacatacagcaacttacctatcaaacagggacctctgacgcttcacattatcacgtaagaaatgtttcttgcccagcagcccccagaggatgaacagctccctccacctgaaaggggaagagggcccaagctgcaggcgccctggcctatcgaggccgtggacaggaggcacccgaatgtctccccagaccccaccctgctgcagaggcctctgcagcccatcaccctgcagcgctgctgttcccgctgcttcttggagaacaggggcaatttaatctacaaatcctgtaaatccttgttaaaaaaaaaaaaaaaaaaaaagaagggtaaaataaaacgtctgcactagcaaggctgggacttggcatcagctgccacctcctacagaacccagtggggagtgggctccagagcctccccgtgatgctggcagtgcctcggccagacacctgcccccgccaccctcctgcgtcctcactgcacccctccccaccccatgtcacatcttctgctcatacctccccacaccctcctctcgcctctggatgcacctctcaacacgcccctgaccgcgtcttcctcccatgctctgaactgtccactagggaagccagctgcagaaatcactctcctagaattcacttggtaaaatatgtgttgttattggcccacctactttgctcccaacccacagcaagggctctccagggctaccaagcccctaatggtcaggaactgccccccaacccccatctccagctctgacctacacaaactacataatcctgctgccaaaaacttggccctccctatgcccagggtgccacactccaggctggcccttctgccgagagggctcttctggcctgggctctgaacgggcaaacccacccactcttctaggatggggtccatgatccaccccaacctaccgtggggctctcacatcttccagactgtgcctctctaggagggccttggacccagagccagaatggggctctgatgccactgcacattctccagcaaccccttccatgcccttcctcctgatcccacccagctctaaactgggaacaagaaagctggaatatagtagcttctcagaaaatacctactgagtacacggctggatagatggacagtgctccaggcaaagggactcgggggtaagaaaagtgaagggtacctgctcccggttgtaccactgcagagtccttgagtgtcaaaggactgagaggtgaatgacgggcaaggtgagacctaccaggttagtgtcccgcacccctttgtttccactattagattaagccaccctatgtgacagataaaaggagcaacacatacaaggagttaggccggggttgccaaagtgaggagtgggaatgctgccagtccaggggtcccccacggcagctccccaaatgaaaccaagacaagttggagatgaggctgcctctaggtgtatcaaatcaactgaagtagcaccagtcctcagtgctgattaagcacaggcacgcctgtgatcaagaagaaaaccattacttaataaaatgcagttaatttagaagctgaaatctgtgaaagctcaagggaaagacacaatcaggagttcttggtctggaggggcttctgctctcaaagcttccaacccaacacagcacaaagacgtcttccccaacaaccgcacatcccacctgcaaaacgatgacacgctcctctccaggtacctgaaccttaggactcaaagggtagagaaagttcacaggcagaatcttcacaatacatgcacaaaacaaaggcacttctagtaggagctgtgggtcaggaaaatctcgacttcacccaatgccattcccgagacaatcagccatcaatctgacccactcagtcctgcctcaggggctcagaatctagcagtcaggccaggtgggaagtgcagggacctgtggccaaaatcggcccactcatcactcagctgacagctttcacgcgtactagccagaatcagttagaggctggaggtagtgccaggtgtctgaaacccagcaggcaggttggtaaaacactcacacatcctaaccctggtgactgcactgactgcgtgctttactgtagcagaacagttgcacacatctcatctcctccatccatagtaactcagtggctggtgaggaatgggacacagacctccacgtgcccttctcgggatgagtcaagacaaactctgagcagtgacgctctacagctggctcacacgtggaggcagagcctggcttcccagagcttccagttcctaacacacgcctggccccactgcaccacacccgtgacagctgccaccagctccggataattcagacagatgctagagcacatggctcacttattacaccaaaagactgagaaacagaaactgtgttttaattgtacaatgcacacacttgcttccagagagacctgagaaatccatcatccctaaatgcatgcggttactcaactagtggctttactatttttgaaacaatggatttttccaagacagttgataatcaaaccaactgcgggaaaccataaacgatacttgtttattaaattaagaacagatacaacagttcagaggaattcatatttagagctgccttgctggagaatcaattccaggaatgccaaaccaaccaaatgaaaaaaaattatatatatatatatatatacatatatatatatatatatatatatatatatatatctcacacacacacactcgtgtcacttaacgacaggcatatatatgtatatatatatcacacacacactcatgcgtcacttaacgacagggatgtattctgagaaatttatcattaggcaatttcatcattgtgagaacatcatagaacatacgttatacaaacctactacaacacactaggttatagggtacagtctactgctcctaggctgcaaagctaggcagcatgttactgtgctgaatgtgtgtatctaaacatagaaaaggcacaacgttaaaatatgctataaaagataaaacatggtgcccctgtctagggcactttccatgaatggaccttccatgaatggaagttgctcgggtgagtcagtccgtacactagtgcagactttatagacattgtatacctaggctacattttaaaaaaatatatttttattttttaaatattttatatatttttttaaaataaagtaactgcactacaactttaccacaatgtcactaggcaataggaatttttgagccccatgatattcttatgggacctctgtcatatatgctatcattcaccaaaacaatgtcatgtgatgcatgacagtacatatgtatctcaactgaaaatcctaaatgtcaatagtgttctccgactcactatttactaataagagtttcctcagaactgtctttgcctgagagtttcacgaccaaacgtctctctgcacagttgattctagggacaagaagtgctaagaatccatgttggcttcaagtgcaaaatggaaaacaccttagtgtcccaccaaccacgtcagccaccttcctggagggctagctcccagacccttttcccatcgctgtatagggcccacgtcatctgtggcatttccacgactctccgatgccagccatcagtctctcggcttgtgttgaaaattagcacctttacgtgcccaccagtggtcatgagtcctagtcatgcccaccctgttaaaaacaaatctgatacaaaatgggccccagcaggagacagggacagaacacggacctcacactctctccagctcagactcaaaggccagcactgccccatcacagccgagtgctcttaggcaacccacagctcagctacctgtccccagcctcctcgttgcaaagttaagacaagacctgccttctagatttgtcgggaaattatttaaaatgataaacaaagagggatggaactcaacacacagaattgcccgatgatgtgtgtttcattccagtggtttcgccatcaaaaccatctttaaatgttggagtgtttccgtttccagacaactagagatgaaaatattttcacagtcactcaacgcaggtacctcaaccacgtattttttctcttaattttgatccttgaaacacaaaacaacagatgcaccaccttacattaaaacagccctttagagtttagagtttatgacaggccgcctctgcattctctcactaggccgtagctgtaactcacaaacctgacccttaaaactcccaggacaataagagaagccacaccatggagctcttgctgtcataaaatatctcgcatcagttcaatattgcatctcgtctgtgcctcaaaacaaccacaggcaagaggcctcacgcgggtattgcagatgctgagaaagactctcaagccagaagactggtcctgggccccagggattagtggcagggccaggctggaactgagctcctgttactccaaatcccatcctcttttctgacctcccagtccctttctcataaaaccaaagcatcttctccaaccaggccaggacacacgcaggagagagtcaggcaggaggaggcttctggaagggaaagcagagtggctgagagccctgggacagagtctgacattaggtacaggacaagtttggaaagatccagatggagcgggaagggaatctgggcgtgggggtgcctccttccaaagtgcatccacatccgaggtgactgcagggagacgcagcgctgactttggcagcagggaccacccgggtgcagagaacccaaacaactgaaaatccaaaaaggaatctcagtgcacagtaagaaagctcattctttgggctggttaccttcccaaacacgttctcctctggcctatgtgaaaccgacgttgcactgtacaactctgaagctctttcttgactgcccactgaatgagggtctgtgctacattccaggaggatccaaatgtgaacacagctaggttccagctctgggactcgggaaaaggaggcacaggcagcaggacatgtgctgcaaggagactactgctcccgtgtttcattcactcactcatccaacaacagcactaaggctctgctgtgtgccaggcacttttctagctactggggatccagaggtgaacaaagtcttttacaattgagtggtaagagactgacaataaacaaacaagtatataaataacacactgaatgttgagtactaaggagaaacacaaagcaaggttaacaagagaaggggaagtaacgctaatttatgtagggctgtcagggagccggcaataagtgaggggccggccaggtgggcatctgggggtggctgatgccaagggggtgggaacagcaggtgcaaaggcctggaggcaagagtggcctggcaaatccgaggaccaagggataagatgaaagagcctacattcagttaggatctccgggatggacatgggccaagatgacaggtggggatggggtggggacaacccagggcagatctgggcaatgagcctgtctgcctggagccaggagagcctggaggggccattcttgggagcgagcgggggaacttgagaaaaatcaggccgagacacatggatgtggagggagcactggaaagccactgaaggcctgggcaatggtgacacacctggcctgggccaacttgcagactcaggggtaccccacagcccaacctgggaaacctcacagccggcacagaaatcataaagcacacagcaatggcaccccaccagtacgcagggttccacatagagagcctggctgcatgatcttgaggtcacctaactcccgggcctcccttgtgtgtctggacagggagagaggggaggattggcttcaggagaggcgagaaacgacagtgcccatgacagctgactcagcctgtgccagcaggctgctctgagacatgagctggacccaacccaggcggtgggcagcaggggggtggggaggaactctgggaaaggaaggagccagagaagtctccctgtgggcgctcgggccaaccaccacccaagggaacaatgagcacccccagcccccgatgggcacacaggctgcctcctggtgagcaagcgtctcaaacctgacctacatctgggaggcctgcctggtcaccagggactaccttacaccctacctgtgcctccacgtccccagtgctcacggccacctggcaagggtgaggaactgagactgcgttgaggacacacagcctgtgagtggtacagccagggccgctgcccaggcccagagctctctccgtttctctaaggaccaggctgcaaggcagggcatgtgatctctgccgaagacattcaagccacccagtgatgtgtgctgggcctcgatccccaccgaccgccagtcctctcctcccctggacagtaaaggtttctccaagacttcagacgacggtgtcacctgaggccctcacctattaagtcaccggggcaggtatgcatggcagaggacacggaggagtgccggagaggagctgaggcctggagggggcctctgcagccaggctcaacccccactctccccactccaacagccctcactgcagccaccgcggcccaatccaaacaaagcccagcctgatgccaatctcaccatcaactgtttttcctctgacttcctcagttttgtctaggaaaaatcaaagtgtcttatcccatctctaagcttccaggggtgtgatcagtgtcttttacaattaccttttacttttatccagcatttcttagctcggttggcaaactggatatttatgcacctccatttcacaatccatctccaccgattattcctgtaaaacatttttttttttaaagtttagagttacttaagaaggttatgtaaacaagttaaccagcaagccacaacttgggtctgcggtgtcagagaaaacatgcaaggtgcaagagaatgaggagctgatggtcaccagctttacctccttccagcacccactcctgctcacacacactcacaccccgtgggactcagcctgcagcttctcccagcccaagagccagacagtggggaggagcacagaccacacttcctaacaaatgagagggaagacttcgtgccccattgctactgccatcacccagtcccagcccagagagggagcccactccaagggcccccctgccagtactgctagagcccaccgagggctgccagcacacagctacgagctccagctttatctactcacgccctggacactgcccggagccccagcaggttccacgtgtccttgtcaccccagccctcctgccccgcggatcctaagctcaggagaccctctccagcccaggctgtgggggaaggcagcccccacggtcacccaggaatcagcgcagagtgcagggcatcctggactccccggactgggaaacccagttcctgtccccctgcgtagtggccacacctctgggaggggagaaacccctgcctcacctcactggagggaccctgacccagaggcctgagaaaaagccaccggcaggctcctggcacctgccaacctgcaccttaggaaaacttgtcccacttcaacctgcaaagctctcaggtcattacttctaaaaccactgtcctttctgaaacaggaaggaaaatagaaaaacaaacaaaaacaaagaggcacagaaggctgaagacgccagaggcagtttagcccaaaaacaaagtgccagacacaagatgccaagtttggggcgcttcctccaccgcatgcctgtttaggagctgactgcactcaaccacagatttacgtctggtgcctgccaggtcgttatctgaagagatctgaaaaagtaagcctttcttctgccagtaaatactaagttaagactagcaggcccctctaaggctctgctctccactggggtgctgcaggacaggcccctccgcgggcgttccccgcaccctccctccgcgtcggcccggagaaaaggaagttcgcccctagcctgggcttaccaaggcccgccgcccgacccatggagccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgctcgggagctcttggcccgcagcttacgcgccgccccccacgcgtccgggtccccgcggcgccgcgggcggcccaaggctgccgccgccagcgagtcaggcagccgaggttccccagcttacctggccagggcgcggggctgccccggtccgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgctgccgggtctctcccgggggctgagctcccgcagagctcgcgcctagccgcacacctcgactgctgattagcccgacagctgaatagcggcgggagcctaccgcgagcggagtacggaaagcccgcagggccgcgccacatggcgcacgcgcactgagctgcatacctaggtgacaaacgtgcacgttttgcacgtgtatcccagaacttaaagcatgacaaaatttttttttaaaaaaccctgatgccattattaggaacaatttgaatagatcagtcacaacctatatgctggcttctggtgtctcaatttgtcctgggaaaactgttgtaaagcaatagtatgtcagtccttatatacttatccatctccaatctggaaagacaaggcttatatgtttcctttttagtcccctaatttctctttatgacacaaatccagttggcagtattaaagatggggctgattctcctttacttatctggaatatgctaccattccagataagtaatagtaaaatggccatttcctcttgctaatcaaatgtcgtttttgaacacaaaagccactgggtttggagtatgaaacataaacataaaacatatcatacactatctgtgacgttttcataaactcacatgatccttttatatttttctcttatataaaacgaaatactttccattaaaaattgagatatttaaatgagaaaatgcttgccaatgttattaaaatataaaattttattatttattcaaagaaaatggtcacttttggtttgtgctaaaaaataacagtaacagtagaagcctgctttaaaatattttaagtgtgcgatatcatattacttctcatttactctttgcgtttctagagagccaagtttatttttttctcaattcagtttaaaatcagagggaacaaaatttgaaacgtgacataatatcaaggttaacatgctagctatgtaataactgtaaaatttggccacaaatgcatttgctttgagaaaaatgatcatgtgaaattcctaaatatttgggccatatggaagatgatatcagaagaataatatattctctgtatgtcaaaggaggaggataataaaaaccgtagttattaggttagtacaaaaacaattacagtattcgccattgccaaaaattgcaattgcttttgcaccaaggtagtaataaaagtatggttgagtttctgtagaattccggcaaaggatgagcatccttaatctgaaatccaaaactctcccaaattcgaaattttttgggtgcccatatgatgcctcaagtacaaaattctacacctgacctcatgcaatgtatcatagccaaagcacaggtacacaacacatagtttattcagtgctttcaagagaaaattaaaattaacatgaggctacatgtaaataaattttgtgtttagacttgggtcccatcccaagatctctcattatgtatatgcaaatactccaaaattcaaaaaaattcacaattttggatttttcaggtcccaagcattttgattaagagatactcaacctgtccctgtttggaagcagttccctctagatagattaaactggcctaacaaaaggtagtatctgttgctggagttgagaaagaataaatatttacatacaaaagtgagggcaaaagaagactacaaaaacattcttattgaaattaaataaaattatgcccttttctctgtgtagctctttggccagtttgaacaatgaataccaagagccaatgactgaattctaattatatatttggtgattatgctcagacagacttgaagagagaaatttcataagcatcattttggcatttgattttctaataacagagcatctcaaaatatttttattcttcataattcccagaattttttttttttggtaaatcttgcatatgactccaacgtgcaagttatttgtaacactaccaataacttttctattcttttggaggagaaaatattccatatatatatatgtatatatgtacacacacactacatatatagtttatatattccgattctgccctattaatctataaatgtatgcacgaagaaaatatgtaattactgggactgtaaactatatttatatcagataaaatagataaataattctattagttttatttttcaaatatatctgtgtattaggccgtttccttacagctgataaagacatacctgagactggacaatttacaaaagaaagaggtttagttggactcacagttccacgtggctgggaaggcctcacaatcatggcgaaaggcaaggaggagcaagtcacattttacgtggatggcagcagacaaagagcttatgcagagaaacctccagttgtaaaaaccatcagatctcgttgatgagatgagagcatgtgggaatgtgggagttacaattcaaggtgagatttgggtggagacacagctaaatcatatcaatccatttcctgaaatttgctctgtgataaaaagttaagagtcagattatctgagtcaaaaaaagatataaactggcattttagcttaactagttataaaagtataggttaatttaagaaaagctgagggttttaaaagaatatttagttttatgcatagaaaaaaggtataaaagtaaaaacctgctgctcatttgggtattaaaggtataagtgttaagtataaatgttatattttctaattggctagtaatttatgtacttttatttacatctttttgtgtattaatttttcccaaaacatactgaaagtttttgttttaatacttttctattgatcttcacaattttcaacttcttcaatccaaatttatcgattagtaatgatgttgcttttttctttttaaagtttttacctattatgttttctgccatattaatcagtattttaaaaaattactaatggctgtaataggagacacacacaatttgttaatgagaatgcatcaagtttctcaccattaagcataatgtttatctgtcttcatacagccatatatgttttatatatgtgtgcacgtgttcccttgtgtacgtgggttgcatatgtgtgtgtagttattatgttaagacataccatatcctttattaaactcattgaaattaagaaatgttaatatattcagatgcattttggtatctttggagataatactgtgatatttatttagtaatatgatatgatgaaaaatactaacaaagctattctcacattgttgccacgaatctctcgtggtcatcgactatctttttttttttgagacggagtctcgctctgtcacccaggctggagtgcagtggtgcaatctcggctcactgcaagctccgcttcctgggttcatgccattctcctgcctcagcctcccgagtagctgggactacaggcgcccgccaccacgcccagctaattctttgtatttttagtagagacggggtttcaccgtgttagccaggatggtcttgatctcctgacctcgtgatccactgcctcagcctcccaaagtgctgggattacaggcgtgagccaccgcacctggctggactatcatttttaatagaacgctcaattcagtttgctaatattttatttggtgcttttgggcatacattttcaggtttttaattggaattgcaatgtcatgctgacttcataaacataattccaagattgcctttctcttcaaatgttctgaaacattttaattatcaagggaattatctgttcctgaagtttggatagatattactcaaaatactggtgaaccctggtatctattactggaataggggaagtgatgagaataaaaagctgaggccttttgtatcttggtgatattctctttttatttattttgtctttattcagtaatctgctttgatatcctgaatcagtatttccttaggtggagagagttttcttatattgaatattagattctttctccaattttacttttagaactatagttaccattctgtacttagatctccacaacttattcatcctgcctaactgaaattttgtacactttgacaaatatctcttcattttttcttagctcctcatttattctctttttctattttctagaaacactgatttttacttggggtatatatttttatccccccatatatatccttttcttatctcttattgtctctttgtccctttcccttggatcctaaggaagactcctatgttttcattgacatcatttagtgttctatagctttaattcttttcttcattcgttctaatgcagcctctagtgttcctttaatattttaagtttccttacaatgctaccttcactcggttctctttttcttgccctgtaattggccagaaaaaatatttgctgtattttatattttatatcatgttttttcattttaaaatactttacagttacatattttaaaatatcttactcaaatattttaatatattttaacacaatgttttatctgaaatatacatttatatttcttgtaattattttattcacaaaccttttatctgatgttttgttttatcacattgttaaacatttctgaaattatcatgtactgtgtgtgtatatatatatatatatatatatatatatatatatatgtatgtacttatcattaaataaggcaggatctacacattgttttgatatcccataaacagagtatacaagtgtatcttggttccctctctatccatctgtctcagctcattttatgctgctataacagaataccacagactgggtaattaatttacaaaacagaaatgtatcggctcatatttctgacaaattcagaagactaagagcatggcaccagcatgtagagagggctttcttacttcttcatcttatttcttcatgttatggaaggcaaaatatgaaaagatgaaaagtgacaatgtacaaaccgtgtatgtatgtgtgtatgtacctaaaggtcccacttctcaccactgtagcattggtgactgattaagttcctaatacatgaactttgggggacacattcaaactataaccccatctgattattcgtagagttctcaacagatctcaggcagaaggctttttgataggtccagccctttatcaattgtagataattagaagtgatacacatctttaccaggcttcacgccttccttctgccaagcttacattcctaaacataaagcacatccacattcacttgaatttttcacctatattgaacttcttggaattcgaggcctcaaatcaatgcagaataaaaggagataacggtaaatttgaagaattaaatgatcatgaccatttttaagtcaggtctttcgcaatgaccgtggtcaataatggccaagacaaatggagatgaattatacatagaatgaatacattaaaatgtcatctacttttctttctccagaaggattcactgttctatgtgcgcctctcatctgcctttttattaattaacctttctactgaagtctggacgatctccaaccagtattcctagtttgtggtattgtagaaatatatttttgtgttttaacgagtcaacaaagcatttgtaagaaatcatcataaaaatctattaagcattcattttgcatcaaacatttattgcgtaaaataagcagatacaatgaaaattcttcttgatggtggaaaggtatcactgtaaaaaatcattatcatcttgggttgcaatacagcagtaaacacagagattttgatatatgtaggacctatattgctgagcttagctatgctctctgtattttgtttctttgcctttcttgtcaagttgtcagcaatcacttcacactactgaaaatataattaattgcctttagcagttccctccctgcttctaaccttatactttgaagcagaagcagaaaattactttggctgagagtcagagctaacctgaacgttgtattaagtggaggccaaaagtttctgaaaatgtactgggggctttattcatggatgaaagggtataaaacctttgttttattgatctgcacttcctaatttttatacttacaaccattgtccaaaattttatatattgcttcagatgtcttgtattccacaccaatggaaggtaccgcgtcttattcatccttcacctccaagttcctaccaaaatgcctgacatatgataggtacttactgaaaattgaatggaaccaacttactgattatctattctcccttggatatctcacatgcatctgaaacttagtatgtgggaaactgagctcattttccttcttccatgctcaacattgtcttttccctcctgtgtttcctattttgatgaatagcccatattctcaaccaattacctaggccaagagccttggagccaacctttctcttttcccctcactactcacaactaattgataaccaactgttgtctaccccctgccccccacaaaaaacagcagattaatccatgacctcctctccactctcactgcactgtcttggtcacagccgtcacaattcttcgtctggaatgtaatatctcctaatagtcctatccattccaattcactttccagattcctgacaaaaataatttttctgaagagaaatctgatcattaaatttagctgattgattgcaaaattaagttctccatgttagagatgagagtttgggaaaaagaaggcagcaagaattcacaaagaagaataacagagatcagaaaactatccacagagacagcttcagagattttcaggggatgtgcagatttattgaatcttccaattaatactgatcaacacaagtatgtgaggaaatggtcaaggccagggtacaaaccactagaaagggaaggcaaaaaagtctccagaattcacataaggtcataagtagtttgtgtttccattagccagggtagaaaatcctcgaatcagttagagtactcagaaggatattgtctcactaatgtggaaacaattctatctagactgaaaggtgctctggttctaccaagcaaagcttaaaagcaaacttcaacacaagcaaattattcctaagtaatttaactgcatcccagaataaagcttaactattcagcacaaaataaggtagaattcactatgtccagcattcgataagaatatatcaggcatagaaataggcagaaaaatgatacatattgaagagaaaaaaatcaatcaagagaaacagacccacaatgacacagttgctaaaattagtagataatgacattaaaacaggtatctatgtttgaaaaggtagaggaaagcatcaaatgagagacatgaaagagagagcaaaatgtgaaatcatcttctcgggattaatcaaacaaacatggaaacaatgtcttagatgaaaactatactggatgaaatcaaaagcagattatcaattgcagtaaaaaaacagtgaatgtaattgtttaacaatagaaagtatctgaaatgaaaaataaaaatgggaagagaacatcagtgggataacttcagtggcctattataagggtaactggattccccaaaggataggagggaaaaaagttttcaggaaataatgtatgaaagaatagttactgaaaacaattacatttaataaattgagctctcctcagcctaatgagtgtcaaaagtctcttcttttcttggactttctgctgacctgaacactgctttgagacaagtctacatgaaaaaaaaaatgaggcaaaggtaaagaaaaggaaaccttctcttggtcaatcagatgagatggctgaaaagaatgccaaatcctcaccacaagtgatggagtgaatggtcaccttggtccagagtgagaagactgtgagcctcaggatggttctaacacaggattacccactcacctggctgcagtccctgtaattcagacccatctttagggcttttcctcggatccacgagtcagcttcctgttttctcttatactcctcctgtctcggatcttcttagtctctctctaagctctacagaagtgtcttctttgttgtttccttatatactttatacctacctatgaattaccatcccctgaatgttatggcttctacgaaagataatgcaataattttatttttcttttgagacggagtctcgctctttcgccaggccggagtgcagcggcactatctcggctcactgcaagctccgcctcctgggttcacgccattctcccgcctcagcctcccaagtagctgggactacaggcgcccgccaccgcgccgggctaatttgttgtattttttagtagagacggggtttcaccgtgttagccaggatggtctcgatctcctgacctcgtgatccgcccgcctcgacctcccaaagtgctgggattacaggcgtgagccaccgcgcccggccaatgtttgtaatctagttatttcttagggaccaccagcactcactcttgtctgtgtttagcacaaagagcaaggggcagagtactcatcaactcaggaggaggaggagtcagtagagaaagcattcatgaaaaaaggcttacatctcagcaatttctaggcacaaaagacttatgaaattctaatattttattttgacagagttcttctttagcattatgttagatacaaaaatagattttgaaaaatcattttataataattatagtatttgcctatctgtttatgccacgtaaattctatgtataaataggtggagaggtagtcacaatattggggggcatgttgcatagtatcttgcaccatagctcactatcttttacataatacgctttagtatgttcagtaaaacacttttagtaaagggctcagaaattatgacagggtaataccagtcatagaatcaagaaaggcatctagttttatctacaaaagattttagaaataatcttataacatatccactaaattgaatgatgaacattagaccactttttattccattataatcttattttctctcataacgctatccattaaagtatagattctattgtaaaagcttctaaaaaagtatcaaatcttcctttgttccattccagctaagctgtgtttcccacctgttctgtgcttgctaaaaatataatgagaaaataaatgactatctaaagttgttttacaaaagactgtatcatagatcctgtgaaatccttcctgctttaaatcctttgagtggctggatatcttgaaatggcaaatgaattggccacagaacagtgcacactattcaaggtttgttcatggagtcttatttatcacagtgatctgtgggcatgataacataatctatacagtgttcatttttctcttaggtggtctgggcattcttcaaccatttattcaaacattatcttctcaattccaccttataatttttatttctaaagcgaagtgagcacagaccagatacctgtacctgggtagtggttttctaggatacagtaaaatgcaggatacattgaagagcaaatgggtgcagatgaattgaaaactcttccctctccacgtcaaagcccagttgaaggttggcatttgaacagaaaacattcatagacatgaatggggaaagttaatgctcagagttcacaagtgaaatgaaaccattcctactcactgcttctacaaatcactttataagtgatcctgaggaattctttctcatctctctctctctctcactctccctcctccctcatctcttccctctcctattctggctgaaactggcacctaagtcaaatgtagctaagcaaacagtgtctcagtacgagacagatatatatgtatgcacaatacacatatatatttacatgtatatatatatatacacacacacacatatatgtattattttttcctaattctacccacaaaagaggcactaataccttaagagccataagcgaattttgtgcccagatggtttttaatacctgtccctactgaaaggaacaagagcctcttggagaaatgtctggttccagggctgggacaaagaaggtacatgatgaaactggaacacctttttgtgccagaaagaaagggagtgctcaagaaaacaatgggaacatgtcaaaaagaaataggcaatagcttgaaggggctcctgctgaccaaatctagggacaatttgtctatcaaaataaatgaggattgcaacgattaaataaaataggatgattaaataaagtaggaaattattcatctattataataagcaaacaaagagatacgcgcatacataaatggataaataagcagaggagaaaagagaacatttctttattttattttatttttttgagacggagtctcgctgtcgcccaggttggatgcagtggcgcgatctcggctcactgcaggctccgccccccggggttcacgccattctcctgcctcagcctcctgagtagctgggactacaggcgcccgccacctcccccggctaatttttttgtatttttagtagagacggggtttcaccgtgttagccaggatggtctcgatctcctgacctcgtgatccgcccgcctcagcctccccaagtgctgggattacaggcgtgagccaccgcgcccagccaagagaacatttctttaaattagtgtgccacctgatacatgtgaaaggaagagtcatggagtggccgggtggagggaggcagggcggggaataccatttgcaactatggtggtaaaaaataatttaggcaagaagtatcaggagaatacttatctttgggaagagctggatgagaagcaggctgcttgcgtgttctcaaagtgtctcttcacagactgctattcattacaaggagaaaagtactaactaaacagtgaagaatgcaaatgacactttgaccttttgctgcaaagtaacctcaccaataagaggtatgtagatgtcttgtatttgggggatatatggtaccccgagaaggacaccacatcactgctgcattattccacttgcagctgtataaccaagtctaatcatgagaacacatcaatcaagctcaaatgaagaaacattctgtaaaattactagcctgaatttttcaaaactcccaatgccatgataaagaaaggcagagaaatgctgatagaataaagaaggtgaaagagatagaaaaactaaatgcagtatgtgattctagacatggaatatggactacatagattagatgaaaatattacttcagtgttaaatttcttgaattgtaccatcttcagatgcttatttgaggatatttaattcagtctggagagttttattgcagtttatctttcttcctagttggtttgggggaagaatttcttcagctgaaatgttttgactcatattttctgttttctacagcagcttttatattgcagtttttgtagttatgttttttattctgttcccaggtatcatagaaatggagttcctagttctagagtatccttttctataaatagagtaaaatgcagtttatttaataagagatgttggcactttgggcagaaagggagtggtaggcacgtggtacttctctttcatctggacatattccttaattttaccttctttttttcctttctgtgccatgactcctgatcaatcaaatagacaactgaaattattcacagatctgaaatgttttattatttctgttaccagatttgtagctcttcaatgcatgtttaacctgtgcacatagtctaattttcactgctggtgttgacagaaaaaaatatttcaaaaatggaagctgagggaggccgaggcgggcgaatcacgaggtcaggagatcgagaccatcctggctaacacggtgaaaccccgtctctactaaaaatacaaaaaaaattagccgggcgtgatggtgggcgcctgtagtcccagctactcgggaggctgaggcaggagaatggcgtgaacccgggaggcggagtttgcagtgagccgagattgcgccactgcactcccgcctgggccacagagcgagactccgtctcaaaaaaaaaaaaaaaaaaaaaaaaaaatggaagctgaggattgtaacataatgtaggtatataatggcaatggcactatttctgcttttcctgtgctttgggtctacctgaagagtagtgtgcacttgctgtgaatggtagagcccacctacattaggctgatgatttattgttgaagtcaaaaaaactagtgaaattttactgagtagactcttgatcagcagggtagcagatgtctcccagaatattttgcttctcaaatttacagggcttctacctttcatagaaaaccatcctcacctctgactcatgtgacttatcttcgggtactgccttctcttggcagtctttgggactacctcaaagcagaattcatcctaccctgctcagtgttccctcgactcttcttccattatatggtagtccactggtgtctcaacaggtctgtacattatcagactgtgagctccctgctccctcagccagacagagattgaagaggacaccatctctttcaactaaattgtgtgaggccattacaaatggccgacatttgtaggccactacatatgggctactactcacttatgttttagcccagcccttgagtttgtaaagtgtgttgggttaaatttgtagttagacaatttagccgagggaagcttaaatgttctgtgtagagcagtgggagaaatatgttcttgttatttttgctcttcttgaaacaaaagaaacggaaaagggagagaagaggtgaataataaatacgaaagagtagaaatgcagtctgcaacagatgacagcagactgaagctagaatccagaccaggccaaggaactttatgattttaaggaggatgggtaacacacaactggaggtgttagcagtgctacagtggtcagttgtacacattttttctggcccttgaaaacttgagtaagttcagttaaaacacacatagcatgagtaagaattttgattttatgaacactaaggaaaatgctgtgtttgttacatgatagggcaaaataattagaaaaagaaccctacacatagaacagttgcataattttgaaacgaagttaaatcagaggaaatgtggggggcaggaggagaatgaccacaaaattataagcctacagataatttggaaaaatcctgaggaggattttcaagaaaatgttcagtgaaagcttggagcaatttcatctagtgtttaagaagaaggatttccttgctgatttctatgatgtgtttttattcatacacaggtacagcacctacgtagcacgtaataggctatttacttagatagcaggtgagcccaagatataatacctgtactttagctgttatctttagaaataaacatctaataggatctattttggcactgcaatggaaactatcaacattggaaaactcctaagtaagtgttcaacaatagagaaatgactaaacaaattacagtatatttgctctatttcgtacatgtcacaatcacaagattgaaatccatctatataagctgacatgttaagttcccttacacataatgccatgtgacaaaaaatatgttgccctactatacaactgccctacttatgcaaatgttcagaaaactatgtattaacagcaattgcccccagttgaaggatttgattggagggaaaaaaacagatcttcactttcctcttccaatccttttatgttacacaaaattttgtcatgagaatttatatatatgcacacaatatcaatatatttatattaatatttatcttattaatatatttatattaatacttgcataattaatatattattgttatatttatatttatattattgatatattagtaatataattattaatattacattaatattttaacatattaatatataaattaatacatgtatactataaaacagaacatctgtttttggaacatggttagttgagctaatgcaaaatgctttctgttacagttaacatggtggagaattataaaacttgtgcatagtgttgggagttcacagaaaataaatggagatggcaacccatagatagtgtgaaaaaacagaaagaggtgagattgcatgacaaatgagtaccatgtaaggtaaactttgttggacttatgactcagaaataggctctcaaaaatacaggtttggaagtctccttttattcaactttactgtagaatttcagaaggtgacattcactaattctacttgtacaattcaacaagttttgatagaagcatagttacataggccctaccacattcaacccttaaaacaatcccagccagaaactcctctggtgcccctattctatatatatataaatatatatatagagagaaatatatacatagaaatatatataaatatatatagaaatatatataaatatatatagaaatatatacaaatatatatagaaatatatacagaaatatatagatatatatatagaaatatatacagatatatatatagaaatatatctatatatttctaccatgcccagcttctgtgcccaggctggagtgcagtggcacgatctcagctcactgcaatctccacctccaaggttccagcgattctcctgcctcagcctcccaagtagctgggactacaggtgcccaccaccacgcctggctaatttttgtatttttagtagagacagggtttcaccacgttggccaggctggtctcgaactcctgactgggaatctttaaatgaatttttgtccttgtagttttgtgttttctagaatttcatataaaggaaatcatacatgaagaagtaagtaaaaagctaagatttttacttagcatcatgcattttaaagtaagtcttgtctttatatatattagtacttcattacttttttttttttggttaaatagtatttcattttatggatatgccccagtgagtttatttatttaccaattaatggacactacagttgttttcagtttggggttgttccatataaaattgctataaacattcatgtacagatactgtacagacatacatttttattttccttggtaaaaacctggaaatggaattcctcagtcatacaataagtgcacgtatgaatttataacgtaagtgctaatttataacataaagtgctaatctgttttccaaagtggctcatcaaaaacatatgagcgttgggttgttcatccttaccagaacatggtttggttttcttatctttatttttattttaaatgttccaataaatagtgatatttccttaagattttaatttgcattcccctagtgattaataatgttgatcatctttttgtttgtcatcactgtcattgttttttggtgaagtgtcttttcaaatattttacctaatttttttaaccaaattgtttggcttcttgagttgtaagaattctttgtatattctggatacaaattccttatctgatatatgatttgcaaatattttctcccattctgtggattatcttttaattttcttaatggtgatatttaagagcaggagttcttaatttttaggaagtccaatttttctacttttaatttttattatttatctcattttcttgccttatctaagaaatcttttcctaaccatgttcataaagattttctcaaatattttcttctagaagttctagagttttacatgttacattcaggcttctgatctatttcaacttaatatttcttataacaagaaaggtgaagatcaagactcatcttttttcatacggtcaccaagttaatcaagcatcatttgtaaaaaactctcttctttcaccattgagaatcaatcattgtagaatactagctgactatatatgtgtagatctatgtttagacactatattctgttccaaattattctgtacatttctatactttatctcaatgcaactttatcttactatagctttatagtgtgactttaagtcaaaccatatgaatcctccacatttgttcttttaaaatattgttttagttattctcaaggcttgcattttcatataagtttttgaatcagcttgtcagttcaacaaaaatacctgatgggattttgatagggattgaactgaatttataaatgaattttgggtagaattgagatttaaataatatttagtcttttattccataaacatagtgtatctctctattgctttattttatattgattttttatcaatgatttttaatttccagcacacaaagcttgcttatattttactagatctattctgaataatttcatgtttttgatatattgcaaatggtattatgttttttaatttcaattttcagttatttttagctcatatacaagggtgtgattatatatatataaacatatattatatatataatataaacatatataaacatatatatatatgttgacctggcattctatgaccgtggaaatttcacgtttaaatcagtttagcatttttgtagcctttctgagattttctaaatagctaattataacatctgttaataaagacagttttgtttttcccagtttgcatgcctctatcgctttttcttcccttattcttttcactaagacctcagcctaatgttgaatagaaatggtgagaaaagacatccttaccttgttctcaaccttaggggtactcatcagtctttcacaatttagtattgtatttactgtaggttttgtcaacttgaaagtgttccttatctttctgatttgctaagatctttataaccataactaacaaatgttgaattttatcaagtgcatttctgcatgtattgagatcctccaggtgctgggatgtcagtgctcctgttgcagggccaggcaacaagatttgtatgtgttttcacacaaaaagctgaatctaagctgcctacataggcccaggaataaatgcagcaccctcagttgacggggactaaaaaattcctcctggccgggcgcggtggctcacgcctgtaatcccagcactttgggaggccgaggcgggtggatcatgagctcaggagatcgagaccatcctggctaacaaagtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattccgccactgcagtccgcagtccggcctgggcgacagagcaagactccgtctcaaaaaaaaaaaaaaaaaaaaaaaaagaaaattcctcctctccagttggagacgtgacaaggaatctcggttctgctctgattctgcacaccgagcacataatccagcctcaagcagattttgaactctaatctgaaatacaatcataataatagagttcctgatttcagacattaacatcgaagttgtttttgagttcattatagaatcaaaggctaaaatattctgaagagacatttctgccatacaggccacatgctatctttaattgagaataatggaagctaactctcctaaactcttcttactgtattgaaatttaagtagactatatgatagagcatatattttttcattcattcaacaaatatttattgaatgtgtctgttaggggtccaggcatttttcaggctctgatatgatgaaaggaaaacatgaaaagccgtctcttgttccaaggggagattattattattatttacatggtactgcagccaaatgtgttcatcttattagagtacatattgattgagtataacatgatagcctctcttaggttataaagtacttttatatcctaaaacgtttgtgagaccttttctaaataatcactaataatctaaaatacatacatatatgattttatatatatatcttcacttcattattattttcactaagaatatacaaaactggctttgttctaggaagttactttgctttgtgatatttctgcgtttatttatcctctgtacacctcttattacatagaattatgctgagttgctacaaatgaaataagccaatttctatacattatttgttttgtcaaataacaccatgttcagtctttgcaatgtgtctattcttctggggttattttaagatacatgcttcagtttatattgatagcaccatactaatcattttataaaaatatatgaaatttaattgctgatgttcaatattagacatattttatgctattttatccaccaaagcaaagccttctcctagtgcagatctgagtaaccaccattcccctctgctatcaaatatttccaaattaattagttatttccatgtttttgccctattttgatttgtccaactatttaatttcgaattaaactcatttcacttaagttacaaaccaagcggatgtctagatttgttgtttccagatttatttcagacattaagaaagttatattctgtctttaatatatttaacagaacaaaactcaagttgtcgttttgctaattattcgctatatagattaaaacattaatccctgttaaaatcatgctatttagtactaagtttttttttgttttgttttgtttttaggcggagttttcgctcttttcgcccaggctggagtgcaatggcacgatcttggctcaccgcaacctccgcctcctgggttcaagcgattctcctgcctcagcctcccgagtaactgggattacaggcacgcgcctccacgcccggctaattttgtatttttagtagagacggggtttctccgtgttggtcaggctggtctcgaactcctgagctcaggggatccgcccgccttggcctcccaaagtgctaggattacaggcgtgagccaccgcgcccggctagtactaagttttgttggatgaagggaggatcaaactggggcatgtcattttttgacaacagagttaactgagtgagtggctctcaatggttcattacgtgtaactttcctctaacactgttacatgcgagcttccggtaggagtgccttctcatggagagggtggttattcatcagtcaagaggatttaagtgtgtataatcaccagctagaacgttcagtatgcaacaggcttccttctgccttcatgtgcaatagtggtctttaaagctggagcttttgctgaatgttgttgatatactacaacaatatccagaaaatgcactctatttcctcgctaatccaaagcagacaatggcatacttctaaattaataagaacactgaaaaccacaaacatttaattccaaaatcttgttgctgacattaggatacatgtaaaaatttaatccaagttcaacttaaattcttccatcagtttttgtttagttgctgtggagttttataggaaattcagatagctataggtttcccctataagttctcttcaataatttgattcctgccaataataaatctgtccatcatggtaagtgatgcttttgttattcacattgccttatgtttatttaacacaaaactccatttgtatatctccactggaatccttggtaatttgtgattgtctattaaattgtgttttaaaattggcattgagtttcaaatcatactgtataaactgccaatggtatgacactcattgtttattttaaagccatgataaggataattcccttttctgctaaatggactcagttccaagtagaattacaaggaacaacaaaatgtctttttttatttaatttaatttaattttattattattatactttaagttttagggtacatgtgcacaatgtgcaggtttgttacatatgtatacatgtgccatgttggtgtgctgcacccattaactcgtcatttagcattaggaatatctcctaatgctatccctccccccttccctctacaaaacgtctttgaaataaactttgtagtagagaacaaagtaaacaatccttgataagaatcaagaaatttagattatcctcctggccaagcaaccacctgcctgtaattttgtaaaacaaacttggcttcattgatgtctctctccttgtcagtaaaggaagagagaaataattgaattcattattctccctatcagtaaacagtttattacttttaaaacctaatttccttaaactttgaaacgataactttatgattattgtctttaattattggtaatactttgaataatttaagaatgctaggctaggcatgtccattgtactcattttatgccttaaaaatattcacaattgatggcttagttgtatttagaaaaacatgcatagctctaagtataaaaatgcaatgtcaatttgaggggttttgttgctgtttctcatcataagttcacctgtaagattttactttcaatgtagcatggtatcattgagtttacttatgtctgttatttttcatttttcactgagtatacaatatgtctaattcttcagtgttgttattgtttattatgtcaggtagcaatgctgatcatttagggtttggaatttttgaagtcaatgccgtaggctttcaggataacaaatgaaacagcaaaaggactcattttccatttggtatcttctaaatataattatataaggaaattccctttacccactataggattctgctctcagaaatgtctctgtttctagagattttcgaagcaaatggcctgcaaatgaaaaatctcacttaatacaaacatgcttccaaatgttttagacatattaccaattttagttcaagtttaatattttaataattgtgttatgaatactagcactaaagcatcaattataaatcagtattaggttctatgctggaaatacagtgcatatacaggccagatattcttgaaaaaccacataatactagagcttatgattgaatagtttaagaccttctaggaaaaataaacctgataagttaaaatttgcatacatttatgaaagtccctaaggagattttgcccattaatggacttaaaaaaaagacagcatacctcttttatgaataataattggtggtgtacagtgacatttttcttttagggttttcttttttaaatttttttaaaattttactttaagttctggggtacatgtgcagaacgtggaggtttgctacataggtatacgtgtgccatggtggtgtgctgcatctattaacccatcctctaagtttcctccccttgccctgacgtgtgttgttcccctccccgtgtccatgtgttcttcttgttcacctcccacttatgagtgagaacatgcagtgtctggttttctgttcctgtgttagtttgctgaggatgatggcttccagcttcatccatgtccccgcaaaggacatgatctcatttctttttatggcttcatagtattccatggtgtaaatgtaccacatttcctttatccattctatcattgatgggcatttgggttgttggttccatgactttgctattgtaaatagtgccgcagtaaacatacatgtgcatgtgtctttatagcagaatgatttatattcctttgggtatatacccagtaatgggattgctgggtcaaatggtatttctggttctagatccttgaggaatcgccatactgtcttccacaatggttgaactgatttatattccccaccaacagtgtaaaagcgtacctatttctccacaaccttgccagcatctattgttttttgactttttaataattgcaattctgactggcgtgagatagtatctcactgtggttttgctttgcatttctctaatgattagtgatgttgagctttttttcatgtgtttgttggccatgtaaataccttcttttgagaattgtctttcggtgaatttttatttaccttcctctaatttccagaaacttttcaagattacttccctgattgttttgttgatatgttgctttactgagagtaatatatatgtttagagttacttttgtatgcatgtaatatttctttcgatacttagaccatttctaattttatgatttactgatattgactccctctagctcaactgtggttatagcaaattagagtagttccaatctcttcctatcaacattcatcaactacctaagggttatctcatctcagcctccttcacttttcctgatgcttcttttccaaagttgataccactagtttattgccagttttacttctatttttttcaacctccagttccctggttgttttgtttgtttttgctaatatttccacaaataagtaaatcaaggtctatttttactaaaaccataacttctaaattgaggtaaaggataacaggaatgatttcagaataattaactggaattaatatctgcaaataatatccatcatctgaattcatagcttcttaggcattatatcatcttaaaaagtaactgatttgataaacatctaccaaaaaatcctgcattatacttaatggtgaggaactggaagtgtttttgctaggtttagaagcaagtccaggatgccctctcttacaactcctattcaacattttactggaagaaatagctgatgtaatatgtgaaaaagaaggaaaatgtttatagattggaaaggaatgaaataaaatgtcttcatttgtagatgacatggtttgccatggagaaaattccaaagaaatgttaaaaaataaaaataccaccaataaggtcaatctatctatatatctatactatcaataaggtcaataggatacaaagttaatatataaaataaattgctttcctatattccgcaaacaaacatttcagaaatttaaaaaagaatgatgcaatcacaatagcaccaaaaacctttttcattagcaccaaaaaatgaattacttatgtataaatatatagagagtctataggtagaaatctacaaaacatgataaaagactaaaagaagatctaaataaatggagaaatattccatattcatggattggaagactcaatattgtttgatgtcaactgaatatatagattcaaaataaaagcaataaaaataaaaattgtatttaatagctcttagcaaattgattccaaagtctacgttgaaaagaaaaagacctaaaataggcaagataatactgaagagaaacaaagtttgaagactcatgctacctggttttagtatttagtataaagctaccataatcaagacaacatggtattggttaaaataagatacacagatcagcggaagagaagagacggtctagaaggagcacacacaaatatagtcagctatctttgaaaaaggtgaaaagacaactcaatggagaaagaattatattttcaacaaatgatgccgaagcaaatatacatctgtaggcaaaagaagaacctagcaacaaaccttatacatgttgcaataatcaattcagaacagatcacagatctaactatacaatataaagctataaaaattctagaataaaatacatgagaaaaatctatgtgaacatgggtttggttatgcttttagctttaataccaaaagcacaatttgtggaagaaaagtttcatgttggactttattcagactaaaagtgcctgttctgtgaaagacaagtgaagaaaatggaaacacaagccacaaactggggaaaaatgtttgcatagcaaaaatctgataaaggactggtattcagcatatacaaacactcttaaaagtcaacactaaaataacaaacatcctaattttaaagtgggcaaaagatctgaacagacatcttacccacgatgatatacagatgacaaataagcacatgaaaatacactctaataatctgtcattaaggaattgcaaattaaaacaacaaccagatatgcacgtattagaatggctaatatccaaaaaaccaaaaataccaattgctgatgatatggaacaacaggaaatctcattccttgctgatagtaatgtaaaatgatagtcactttggaagacagagcttggcagtttctaacaaaggtaaacatagtattatcatttgacccagcagtcatgcttctgggtatttactgaatgttttttaaacacgtgaccacacaaaaacctgcaggtaaatgtttatagtggctatattcataatagtcaatttggaatcaaccaaaatgttcttcattaggcaaataaacacactattatactttgatgcaatggaatgttattcaacaataaaaaataaggagttatcaaaccatgtaagcacatggctaagtcttaaagtatatattgtcaagtgaaataaaccaggctgggccgggtgctcatgcctgtaatcccagcactttgggaggccaagtcgggtggatcatgaggtcaggagttcgagatcagcctggccaacatggtgaaaccccatctctactaaagatacaaaaaattagctgggtgtggtggcatgtgcctgtaatcccagctactctggaggctgaggcagaagaatcgcttgaacctgggaagtggaggttgcagtgagccaagatagcaccattgcactccaacttgggcaacagggcgagactccatctcaaaaaaaaaaattaaattaataaataaataaacataaataaaccaggctgaaaaggctatggcttcatactgcatcacttagtttatatgacagtttgaaaaaggcaaaattatagaggtagttaacagatcagtggtgtccagagtttcaacatggggtgagagtggtaaagcacagggcattgctaagcgtgcagaaaatgttctatatgatattgtaatttttgatacataatactatgttaaaaccaattgaactataaaacataaaaagtgttccttagtatatgcaaattaaaaaaaaaacaattattggccaggactggtggctcatgcctgtaatcccagcactttgggaggctgaggcgggcggatcacgaggtcaggagatcgagaccatcctggccaacatggtgaaaccctgtcactactaaaaatacaaaaaattagccaggcgtggtggtgggtgcctgtaatcccagctatttgggaggctgaggcaggagaatcgttttaacctgggagccacaggttgcagtgagcgagatcgcgccattgcactccagcctgggcaaaaagagcaaaactccgtcacacacatacacacacaaataaaatttaaaaaattatttagaggtcaagggcatccccagatagaatgcagaatgtaacaaaaggatctaactacattacaagctctctgagggtgaggaggatgggaatgctgaagtaaggaagtgctaaagcaaagcaaagcaaaacaaaacaaacaaaaataccccaaaacgctcagtgatgaggatatgtcagggacaaagaaaccaaatgaaggagttctcaacaaaagctatagcaatttgagcaacagaaaaaaatacagtagtattggattataactcaaagtataaataactacgaattcatacaaacaataaatgatgtgtaaatcaataaatgggaaaaatggataaatattctggtcagaagaagtccaaatggcttatgtggatactctgccctcagtgagatagggcataactccttgttttttaagtatgggctgtgcatagggacctctttccaaagactgccatatgtgagttgactgagtgtcaacttgattgaattgaaggatacggggtgttgattcctatgtgtgtctgtggggtgttaccaaaggagattagcatttgagtcagtgggccggggaaaggcggacccacccttaatctggtgggcacaatctaatcaactgccagcgaatataaagcaggcggggaaacatgaaaggagagacgggccgagcatcccagcctgcatctttctcccgggctggatgcttcctggcctcgaacactggactccaagttcttcagtttggggactcggactggctctccttgctcctcagcttgcagacagcctgttgtgggaccttgtgatcctgtaagctaatacttaataaactcccctttatatatatgtatatctatcctattagttgtgtccctctaagagaaccctgaccaatacaccatatgaaaattgaaaaaaaaatcgagtaactttgcagtggagaaatttgacaaacactaccccagccaagcaatcaaagtgaaaatgaacagcgatatgccttgttgataatatgtcattgaaatggtgtgacgaaaatggcacttttccactgtggtcttctccagaacacataacctcagtctaatcatgagagaaacatcaatcaaatcccagttgagggtcattctacaaaatacctaacaaggacttctcagaactatcacggtcatcaataacacgaagaccagaaaaactgtcacagacaagaggagtctatggagacaggacaaccaaatggaatatattattgtggttgggatcctggaacagaaagaggatactagagaaaaactaaggaaatctgaataaactgtgggctttagttaatactatatcaatattgattcgttaattgtaaaaaatgtaccataggaatgagaaatgttaataataggagaaatttgatgtgggctgtatagaagtctctttactatcttagtaattttttggtaaatctaaaactattttaaaattgaaagcttattaaaaataaatttaaaatgtgattgataattaaagtcgtataattatgcagctgatgctataattaaactaataagaagaatataattagattcacatgtactgatatggaagaaagccaaagatacattatgttaaaaaaaagcaaattgcaaaaacatcgattgctgtgacccactttatgcaaaaatgtgaacacatatgcatacacctaaatagttgaagaggtacacactaaagtatggttacttcaaagatagcagtaacattgaggtggttgtaaaaaatggagtgaatgtgggcataggcctttttttctatacatttctcttatttgaatattttataataaacatgtatttgtagatacgtataagttctttatgatttaaaatgcttttcttagatatatcttaacttcttttgctaccaagtctgccttaatccattattccctttcattaatgtaacatcaagtgtcttctccaatgcttctttttgctaggcacgtaaacaagactaagtttctcccaggttaaagaggaaaataacaaaacaaaataaaacaaaaagctaccttatgcctttcagttaccccgtattttttttctgccaaatttcctgaaggtgttgtctatggtcattatttctacttccctatgtagctttctctgtcagttcactgcaggctgtcttctgcctttacctctctactcaatccagtgtatggcaaccttcctgacagtgtggtggagagggtaaagctctgggcacatttgggctctgtgtctgagaatttgcatattttgctttactttcctaatctcaatttccttacgtctaaaatgaggacagtatccttcttgccaacttctagtatagaaactgatacataacatatttttaaaaatattgatcagatgatctaaaaagcaatctcgtcatagcatcatggcaaagatgtaatccctcaccatctttcctctagattcttgcggtggtctactagtgttatagatgaactaacctccctaaagagtctcagtgtgtctgccctcacaacccttcaaatctctgtcaacacaatatccagagtgggcccattgaagcctaaaaaatgtgcatgtctcctctcctcagaaccttccagagcctactattgcacaagaatgtgtttgtgtagtgtttgtatggcatgtgtatatgtgtgtgtgagagagaatgtgtatttgtggaggtaatcctaggaatcaacaacactggagtggaaaactatggcagggaagaaaggaagccattaaagttttgttatcaagcagcatactgctgtgggcaccaggtgcctaggctcagtaggaaactcagaagggtagggtgaatatgacccagaggagttccaaccaaggttctaagaagctgagaatttggtccacactatctggcagttattggttgatggctgctttggggaaggatgtggaaggaatgcattactttctaacatgtccaatctactttatctttaagcctggcaaactgtagcagccaaagagagcgctcagttgaagacctgtcaatagggagcatacccaagaatggtgaaagccaaggagatatggatgggttgctgacagcatctactaaaatgtcttcttttcaaatatctaatgtatttgtatttcctttttaaccctatgcatcatgtaaggttctttaggaaatagaaggcatattcacaggggataattaaagagaatttaacaaaatggctatttataaatatgtaagcagttttcaagaatttcacaagttagaagaaagctagatggactaaagctatttccattgtctaaaggagcaagggtagggaacagacacttgaacctattagatgtggctttaagtaacagaaatcaggcaccgccaagctacgcctcagcagggaaggatcctgagaaatcacactcagattgatctctcctccaacctctgatctgctctttgtgttttgttggtcaaagcaataacaagtcagagtatagaaagtgaagcagtactgaagagtcagtggccagagctcaaagctcactgaagtatgagaagtggagccagaggagcaggtggagaatattcagcatgactagggcaatgtaagttgtaagagagcctgatttttgtccccctgtttcctgcactatcccctacaaatagaacagtgcctcatacatagtcagtactaaatagatatttgttgaatgtttcagtccattcacaatacttttgctattcattgtaaattattccaagattgcacttcgtttaacttttgccttccaaaaagtgcaaattgatatctcgatattgtgaatgaatacccttaaaatgtttaagtgcttcatcataggggagtgtcacagcttcgaataatcgtgatgtaaagactggttttttaaaaaagtcgtcttctcttgtaactcaatatttccatttcctcttctcgatgaagcaataaaaatggttttcctgagttgccagataaagtccttattcaaaaactgtttgacttccatgaacccaaaataattccacttgataaagtatattttattagtatttaccatcaccttaaggaaaggcatatgtaggagattgcctagtgctgatattggaggaccatatatcagaaaaacatatattaaattacacttgatcatttctatatttctaacttgagagaatatttctgtcagtcagtgattcaggatcctgtatttaattagctgttaaacatttattacaatttttgattttgtcattttttattaaaatagttttaacaaacatgattcattgaaaataatattctcatcccacgttaaagatagttttctacttttattttttctactcaactctttttaccttatattcatcaaagaaaagtagaagtaaacgtatccccccaaaattcatttctacttgggctctgtgaatttgactttatttgaaaataagatattttcaaagataatgaagttaagatgaatttacactggattgctaaagatctgaaatccagtatgactgatgttcttataagaagaggggaatttagagacagacacaggcacatagaagagatgcgtgtgtagatggagacagaggttggagttaggttgccactggcaagagtaccaaaggttgatggcaaccaccaaaaactagggaagaagcatgagctcgattttccctcagagcccacagaaggagccaatcctattcacaccttcatttcaaatgttcagactccagaaccacaagagaatgaatatctgttgtttgaagtcaccaggtttgtggtgatttgttacagcagtccaaggaaatatatacagaataaaatacagtaccagatctgttctcatccactggcaaacattttttggaatattaaatctggaaatgaagagtggattgccactttcttttttttttttttgagatgaagtctcgctcttgttgcctaggctggagtgcagtggcacaatcttggctcaccgcaacctctgcctcctgggttcaagtgattctcctgcctcagcctcccaagtagctgggattacaggcatgctccaccatgcctggctaatttttgtatttttagtatagacggggtttcaccatgttggccaggctggtctcgaacacctgacctccagtgatccaccctgcttcggcctcctaaagtgctgggattacaggcgtgagccaccgtgcccagccaattgccactttgggagtatcaagagtcggcccttattagcaagtatttctatctgcccgtttgggttgagcaaaattagaactgacaacggactagatgcttctattaccagtatttcaacctccagaggatccagataacagttttcaagtaactctcatagtagcctaagcttacttaaactctgaaatgaaagaatagaaatagactcaggatgccaaaaagtcatacatttatgatttaaactcatcaaactgaaatttaaaataaaaattatcttgaaaacctgctacatagcaaacactgtgttaggttctgggaatacaacatcgaataagacaatttccctgacttcaaggaatttgaagtatgactgtaagatacaatgaaatgtacaatgaaaagggaaacaggaggctacagaaataaaatgaggcctatcatatttagctatatgctgaaggcatttgcaagtcgttgaggagtttgaagttgggaagcaacaggataaaatttgttgtttagaaaacagcacggggtagagtggagggtagtttgggcagatgcaagcctggaatgactgggagatcagctaggccagtatagctgacattctgagaaaaaggtgaggtggcttcacatagagttagcaatgaaaaaatgaaagtgaaaaaatggacggattacaaggatgtttaaatggttaatcagcaaagtttagggatttaattgggggtagagatgggaaggaaagacagtggggagggaaaggcagattccagttagtggaagttagtggcatcatggtgcagttttctctaggcaggaggcccaagatgaagggcagggtccaggtacacaacggagaggcaggtacaatgggctacattcaaggaaacagattttctgttatttacattcaagttatttatatacccacccactcacagacactctttttttattctttcaaatgaattagcctactcctctctatttatgaacagcatttggttgatttggctcattatttaactaaactaagttcagtcaactttcaaaaatagcaaaaacaggccaaagtgggaggatcacttgagaccaggagtttgagaccagcctaggcaatatagtgagacccctgtttctacaaaaacaaaacaacaacaacaaaaagtatccatgcctggtgttacgcatttgtaatcccaaattacaaaggctgaggacagatgatggcttgagctcaagtgttcaaggctgcagtgagctatgctctcaccactgcagtctagcctgggtgacagagagagaccatgtctcaaaatttaaaaaaagtatttcttgatattacacagctagatattttcaaaacataattaacaaataaaagaaataatttgaggtaattgtaaaagacataattttaagtaaaatttaaaaatcttcacgaatattccttgctctcattagatggtgaatatttaaccgaactttgcaggtgatggcagagacacaggctaataataaacatgatgacttgaagtagtaactcaatttattattttaatatatattaaagttaagtatgataaatttatttaaattaaaagaaaaagtcatatttaattttgtggaaatactaagtaaataaaaagtgtaaacattgttccagaaataaaactgcaaccctttaatgatctgatcctaggcctcaacctggctctcagttctaaagtcttttcgttctaagtgtttgctctaacactggatccctgtgtgttttactccaaatgcagatcccagggtacaaggatgagacaaattgcatataatcaaaaggggaaaaccaataactatgactaaattagagaaacaactggcacggaagagcgtgagtcagaactactagttttctagttttttcttttaattcaaaaattgaagtatggacaggtgtattctgtgtcctgtgaagctgtggggcaattttaaaggccatcctttcagtagtgtcaacactggtaacctcaatgttaaccacacgctctgcacaatgaatacttcaaattttccaagacaagtctgcagaaaacaggaaatggattcttcattctgcacttttttatttctaaggttacattcttttaacttttcagactgttactacagtttatatcacatactgaatgtttcctagaaaactaacaaagttgagatcacctgaattgcttttctattttcctgcacactggtatgaatcatacttctctaagcaaatatgttccttaatgtattacttttcttactttgaaaactctaaaactacctactctaatttataatatcacagaactttaccctgtgtttactatacatttacctcaattttatcatttttattctacatacaaccctcatgagattgtcactgtctttcttatcatctgtgtgagcattagtcatgaggctggaaacttcttggggtaaaaaatattccaatattcataattatatcggctagcttccagcatcatacatgacatagggattttatctgttgtttgaaattgacagagccttctaaaaccatataatcactcattggcttggcactctacatggcaatatttatcaatgactatgaagtgcaagacacaatacaaagtgtatatccaatcttatagagagcatttggggacatctatgttgcaaaatttagagttctctttatttggatttgagaatgataatgtgacatgtatgctgttttaaagccacacctgttccagcactggacagcaccacgttttgcctcccatgtttccagatcatgttttgccaccaaatgagttcaaattgtgtcaagtgttgttgaataatacaatatgtaaaaatctagttttaagagctggtattttggttttattgttgttgttgctgttgtttcaggattttaaactgtggaacacattgtcagtgatccaaagaaggaagagataggcatttcaggaaaatgacataaagtgtaagaaaatagagatgagggaaaaaaaaaaaagaaatactttagaaaagacatgtaatccagagagctgggagcgtagatcttgggaaggggtcaagtgcattacagctggagcaaggcatcagggttgaattataggagatgtatgttttgctcctattttttttcctgctttattgagatataattgacaaataaagttgtatatgtttaaggtatacaacatagtgagttaatatgtttatgtgctgtgaagtgattaccacaatcaagctaattaaaacacccatcacctcacatagttactcattttctgtatgtgctgagaacacttgagatctactctcggcaaatttcaactctacaacacagtgtcattaactatagtcaccatgcgtacattacatcactcgaacctattaatcttataactggaagtttatatcctttggtcaatttctcctcattctcccaacttcctagcccctggcaaacaccattctaccctctgcctctgtgaattcgacttctttaggttccacatataagtgagaccatatagtatttgtctttctttgtctaccttatttcacctagcataatattctccaggttcatccgtgttgtcacaagtggcaagatttcctctgtttcatagctaatattgtactgtgtatataccacattttcttcatccattcatctgttggcagatgctttaatctgtttccataacttggctattatgaataatactgaggtgaacatgggagtgcagatatctcttcaagatactgatctattttcctttgcatatataccaagaagtgagatagctggatcatttggtagttcactttttatttacttatttatttttaaggaacctccgtatggttttccataatgaccatacccaattaaactctcaccaatagtgtacaaagattcctctttctccacacccttgccaatgcttgttatttcttgtcctttttaaataataggcatcctaacatgtgtgaaatgacatctcattatgattttgatttgaatttccatgaaggtttgtgatgttaaccattttttcacgtacctattggccatttttatgttttttttagaaaaatgtcattcttgtgtacatgtaccctagaacttaaagtataatggtaatcaaaataaataaaataaaaaaaggaaaaatgtcattccagtcctttgcccatttttaaccaggtttttcttttgctattgagttgtagtttcatatataatttggatattaacctcttaacagacatctggtttgcaaatattttctttcactccctgggttgccttttcatttgcttgactttttttttttttgcctcttccagagcaattaaatacactattagctatgctagtccttatttattcatgactccctatctctagacagaaaactctggggaacaactggcccctatatcctcccacttactagatgtgcatgttctacagacactttaaattcaatttgtctaaccatattcatccattaatttaataagccattattagccaatgtataagacattggaggttcaatggtgaaagtcataccaattgcatttttggtgcaattacttcaataatgtaattattacattacaaaattacaaaccgaagcatactctgatggaaggaatgaatgtccttctcagagagtatctaagaaggtagcttttccacatctggtggggctgatgttctctgaggaagtgaaagctgatctgggatatgagagtgaaaaggaaaggaaggaaggctaccagaatggaaacaagcatgtgcaaaacccctgtggcaaggcagagtggaaggaatcagagaaagtgaaagaaacccgtgtggaaagaaagccaaggaaccacagcttgtatatgaaaccatcactgttagccctctagaagccttctgtctgctcagccccctttcttccactgaaggaatagtaactacactgttcaaatatttatggcaataattccttattatatttagttaccactcttaagaatttccttttaagtttatataaatggaaccataaagcatatagtctttgtgtatgattttacctacagtacattttgttttccaatttgtttgtgttcttgagtcgcacatttcattcattttggatgctcgagaggattctttgtttgaatatacaataatccatgaacctaatgctttgatgatgaacatttttgatgtttctgtgtttctagtgatcacaaatcatatatgattaaacatctaggcacacatatgcacgtcatttctctagaataaacagcaatatgtatatatatttgtatatatatatgaacatgaacatatgcaaacacaagttcatgcataatactaatataaaattatgtactattctatctcctttcacatattttctgtttttgtctctcttttcatcattattgatgttttcttcttccctttcttccatttaatgatctctctgcatcttatccattgaattcttagtttaggctatttcacatattacattgttttagttctagaatttctattactttcttttctgaaaaatctgcctgacagatctcttagtctacacaatctaacacgattttctattatgatggaaatattctataaatcagtattgcacaatgcagtattaaccaaccacacatagctattcagctcttgactaaagaattgaatttttacttttatttatttataattatttcaaagttaacattggtagcaacttttatattagatagaaggtcttctatgattctattttcaccatccacttaaacttaaaagaaaaaaaaaaacctaactcactcaggggaggcatggtggctcatgcctgtagtcacagcactttgggaggccaaggcaggagggttgtttgactcaggagtttgagaccagcctgggcaacaaagtaaaatccgatctctaatcataataatataaataattagctgggagtattggcatgcgcctatgctcccagctattagggagggtgagatgggaggatcacttgagcctgagagatgaaggctgcagtgagacctatcatgcctctgcactctgacctgggcaacagaacgagaccctctctcaaaaaacacaaaaaacataaaaactaaaatgctcaattggaaaaatttgaaaaaaaaatagacaatcataatcaattaagactcaattgtcaacactcatagtgtataaattatatacactaaatgagattgtgtgcatactatccatatctacacacatacacataaacaaaataaattttagtaatgttagtttatgtattttatagcctattttttcaaacaatatttataaaataattttatggcattaaatagtgtctaaaatcatagactgtaatgactgtgtaagattttactcttggttctataataatattgtcttattactcgacatttagacgactattttgatactgttgctaacatgattatctctagctgatttcttaggattattgagataaaagtaggattgctggaataaaatatccaaatattaaaacatttttggtatttattgtcaaattgtttttcggaaaagttataccagcttgaattgccattagagtaagataagaatgcagtgtgaatttaagtcctgtttctcctctaccttttcctatctcctctctttctgtatcaccatatgacatttgtcatagtcctgttcttcttcaatatctttgttccataacctctgttttaaaggttccctctccccattccatgttcagctctcctgtcttttttttttttttctgagacagagtctcgctctgtcacccaggctggagtgcagtggcgcaatctcggctcactgcaagctccgcctcccgggttcacgccattctcctgcctcagcctcccgagtagctgggactacacacgcccgccaccacgcccggctaatttttttttttttttttttttttttttcagtagagacggggtttcaccgtgttagccaggatggtctcgatctcctgacctcgtgatccggcacctcggcctcccagctctcctgtcttaaatgctaaatctcacatccatatttccaatctgtcatgtcttccaagatcaagttccacttttccaacatgtctgctatatatatatatgcgtgcttgtccctactgactctcatcgcatctagagctcaatttttaacattatctcttcccccagcctatcctaataactcaactccccatgtgttcagatttcccttttctgtaagcaatcctattgtcacttgagcacaaaactcccactctttgtcgcttttcctttatctcacaaatgccgacagtcatcaagaatgattaaattttcattcgcaatatgaatccaagacatgtcttcccttgcatactgctgcttccatgctagaacaggcctttatcaccatggcaattttcttttaaatactgttcctgcatttagactttccttccattaatctattctactcaatgcttctaaactaatctactcaatttatcattttgagggtaccactgtcttcatcaaaagtcttcaatgtccccctgttgtgttgtaagcaaccccaagttgcataatttgtcatttatccatttgtcttgccagccagccattcaaaatttatggagtgcctacatgattttttttcctttggagaactgctggctactggaactactggcccttgcttaaaaagggtgtgaagtgcctgggagtttatatccccttgagatttccactaaccagtgactgaaagatactgacaaaagcctcacatccatagtctgaattataatagctctgaagcttagtttacactccagtttccctatggaatcaggcgaaaggctgttcttgggctttgcacggcgatcacactcttgcctgacttccttgtcttccttgccctacttcactggttgccttatttatctaccctggagcccttccttaataaattatttttatgtgaattcttctcttaggttctgcttctggaaaatccaaagaaaaccacttttgttaagaaccaaagacatgatcactactgcgaatgaactcacgctgagtagaaaaatagacatgcaagccagcaatttaaattttaatatgctatctaccataatagtgggatttgcaaagtcctgtgagatgaggaaagaataaatacctatctcaggtaagggaagtcggactggaaagtcttcccctaaagtaatatctgatctgaaattcagataagatattttttttaggcagaaataataggtaaactagttataacaaatagtgtgggaaaaatttaatgttataagaacatgaaattcttcaggaactacaaataactcaacgtactattatcagaggcaatatgtgatacaagaggggggagggaactgattcgaacaggtgagtaagatggccgaaatgtgaattcaaaacattctctgagtgttgtaaaaagagctcatctagtttatctgtcaaagatggcaaacaatatggagaacccaggagggcaatgcctttgattatagagttgtagctattgctctggcagtattgtggaggactgcatgtggaatttgcaagtagggctagtctggagaaagaataatcagaaatcaaataccatggtgagcacaaagggctgagaagagagataatgtgagatattagaagaagaaatggcagtagttggtgattgattgggtctgtggtaagattctaggctttggatcaccctgccagtcaccaaatctgatagaatttttttgacttactttatcaagatagcagcattttccttccttcttcagcttcctgtttgattgttttgctaacttttgtacgttttccaaattatccatattgacaacatattattcttttacttgcaaagtggagtaggtggtaaaaatgaaatcatagcatatagacaacttactagaaattattgagttaatcagaaaaagcatgctgataattaaaatacatgtgaaaaaacgtccaacctcaatcataactgtttaaaaaatgtcaattgaaacaatatcagattaacaaaaattttagttgtaaaacattcaattttagcaaagataaaggaaagaaacatgctaatgcaccacctgtgagactataataggtccaaatttttgaagagccattgcaaatatctggcaaagtaaaacactcacttcctttcatccagcaatggcaccactaacaatttacactaagaatcaatctagatgaatatatatgaagatgcttattactgtattatttataatagcaaaaaagtccattaatataaactcattagctatactataaaatgaccgttccgtggaatattatgcagatgttataaagaatatgttaatataaatgtggtcaataaatattgcattacaaaaagaagagtagaaattgagcttgtagagaataatttcatcaccacttaatgagaatatatatacactgaaaatttctgaaaggatccatccaaaactgctaacattatttaccactggggcttgaaaatgatggagatttgctcttgtcatttatttttttccccaagaacaacagtaatttggcgataaaattaatggaaaggggcattaacaagataattgagggacagtgtttagtttttacatgtttgtggaaggagatgaggaattaaaactttatataattctgttgaaataaaataaaaataaaatccttagagtcacaactctaagaaaggacaagcacttacagataggaacatagacgctaaccccacatcctgtaagtgtcaaaccaacgactaggattcagctcccctgacccttgccccagtgctctttctatgatcctaagcgatagtatatctatgcctagaaaatcaagccaactgaggtggaaaagatctctgccattatttctgtcttctccgaatatacgggactgattttgagttcataaataaataagaaatgttgaagggttgtccatgggacactaaagttccactgtattctcaaccagaatttcttaattcagtaccattgctctaaaaggatgctttctcaagcactgaaaaatatggttccatttatgtccctaacttaagggaagagacattttgaattggaggcaaataatctatgttgtaacacttcaaagctaggtcaggaagcttatgctaaatgccttatgtgtacttgtgacttttgtattctgaccctgaatgtattacacagataagctgacatgtctccaataattttcctcctaagtacggtataaatgaaatattagctcatattatctcggcaccccaccaactgatcagtttgttgctataaagtgcaaatgcccaatcatataaaattccaagcattgctctgttgaaaatgagaaggcatcactagaatgtgagtgaaaagaatattatgtgcttcccttttctatatgttagattgcttcacattgaaaaaataagttcaatctgggaggctgaggcaggcggatcacaaggtcaagagatcgagactatcctggctaacatggtgaaaccctgtctctactaaaaatacaaaaattagctgggcgtggtgacgtacgcctgtagtcccagctacttgggaagctgaggcaagagaatcgcttgaacccgggaggcagaggttgcagtgagccaagatcataaatagtcttcactccagcctggcaacggagagagcctccatctcaaaaaaattaaaaaaatagaataaataaaatataaaaaataagttaaataacatactacccaaaaacttgtaaattactttatccatctacttctaggaaattacaaagaacaaatttcattattttagcataacagggatggattttcttttgtaatgttcaatatattaacgatagattttttttcctagtgttctttaggatacttcctgcaatacttcattcaagttatcagtgatttttactatgtattgtaaatgatacatagccaccatatataaatatttgctgaattcaagattactacgttaagaaactggggtaaataaaatggaaacaagacatccgtgaatatttaaggatataatatcgcaattgcatgtttctgctggcttttcatgatataataaaccttgttttttcttctaatttaaaaaatgctatcaataataaaaatgctaattatacataatcaatatttttatacatatatcaattcttacaaatgttctaattgcagtttagtaaactgatgtgtaaatatactttgtaagacagataattttttttctatttgtaggtattttatttttatgatattgtaaataatatatttttaatttttttattatactttaagttctagggtacatgtgcacaacgtgcaggtttgtgacatatgtatacatgtgccatgttggtgtgctgcactcattaactcgccatctacattaggtatatctcctaatgctatccctctcccctccccaccaaccccacgacaggccctggtgtgtgatagtccccatccaagacagacaattttataagaagattaacttgaagttataagtagactagtgaattaaaatttccatttcctatgctgcagagcacttttaatgcaatttggagggagaacattagtgttcagcatttataatttatcatttgacatttggactaaaaactctatttccaatactgcacatgctaccataatgcagggttttacaaagagattagcgtaattcaatggttaatcatatttcaaaaaggagctatattgtggactttatattcccctcatagttgcttctggaagggatctcatttgttactccttctcagcattgggttctattcagttcttaagtgaaaacgggaaaaaatgctaccctatactgaagcatttcaacacaattggaaacattatgcatgattttcaatagatgaggatatacatttacaaagtattcacaaaaagatatttttggccaaatttgaatttgttgaaagaaagtacatctctgatctacttttttagaattttctgggtttcaaggtctttaacagaggtgtgtacgtatgtgtgtgtgtgtgtgtgtgtgcacgaaaatgtactgtgttcataaaaatgccactgttggtgtttccaaaatgaagctactacaaaatacagaattggtgtaatctagagagggagaggaattgataatgcagagagcactttgaaaataaaactgtggaaaagaggccacagtatggaccagaggtaattacccgatcactaaaaaagagagaagagaaagaaaaatacacaggaaaacagggtcagagaggcagaaagtgaaaaatcaaacagtatatttggcactgtagagagtaaaagaatgagagattttccccctttctgttcatgggttatgaaattgaggttttccatataattaagaaaggatggatcttggcgaagggcatattgtcatctatgagagagctgcgagaagtgtagggaagattggagaagatggctgacattgctgctttggggtagttgctctaaaacttctgccattcagccatgcggatgaggtgagcaggtatttggggacatgtgtgacacttgatcacatgtaacaataatatatattacatttagaacaatttatatcataatttatgtgtggaacaggatgtagctcaacaatgaatattcagaaactttacctaaaagccaattcataagttattctaaaattgttgttaacctggtgggtgtattttctagggatttcaagtgagcaaaaattgccaagaaataaaatccgtcaggaataatgtctgctttgcctgtgaatcatagacacacttaagaggcatttaacagtttagttagagcaataaatgatctttgctttaaaattgaaaaatgtgttttctttaaactttggtttcattttcttaggcgtttattcaaataatacatatgtgtgaatgtatgtgatttttagactataaaatactttgaaactgttagataaatctttgctaataagacatttcgttatggaagaattttgggattccttttgctctcagtattgactactgtcattgtagaagttctgacaatatgatgattgtatgaagactctgtgttcaaatgcatcatcccaaggcactgaaaacatattttcatgttcttgttttatcatatttatgtataacggaaatgggaagactgaaagatttcattatcacaattttggagggcagagaaaataccgacaatctgcatttccaggctaagtttaagctattcagaagccaaaccttctcactattcagctggcatatcacattcagcgagaaaatgtttcagttttttcatagctatgtttaactttaaataagagattacataattaatgctaaaactgcctgtcactattatattccttaaggttttccattctttcttagcttaagtcctgatttttattttcattgttatcattgttatttttcttttcatagaaaagtactacttagctctataatcttttgtttgagattaagggatgaatatttttgacaaaggaaaaatatgcttgaataagtttgtggtcttccgtgaaggtttaaccttatagagttggattttttacatttttgataatagcaatgattacataaaccttatccaaaaattgttataattattgagattaattttgaatcaattaaaaagtttaaaaataaatattatttgaagtgtttataagatcagaaaacaactgaaaagattcatggttatacatcaataattgcttatagtgtaaatgaaaacatttgttaatttctagaaatttattgcatatttgattctactttccaggcaatattcccacattttaagtttgtcttcatttcaataaaactgtatccagaaaattaataaaactataatttgaatgtacaaaaatttcaaataatgactccatatatgctcaggaagtttaatgtcttgactttaatcataccaaagacttcttatattaatacaattttgtatatatgcaagggtttcacttctgtatgtaatcaagaactcaactaagctgtttatcctctccatgttcttccagaacattctcccttaaggatctaattcatggttacttcttactctatttttaaatttcaccatgattatgcatctcatttacattttatttcctgggtctttcctcacctctcaaaaactacccagagagcatgatagcagccttttcttgacttccacaccttacacacacacacacacacacacacactcttactttcacaaatatgtgataaggggaacagtgttgctacatttatattattcttgacagatgaaactgggcacctgtttgctgcatatcataggcttggccaacatcaggcagatgctgcccagatggcctttcttcatctagaaacatggagccatgctggccatctcactttcctcgcaccctcaacctaattgtccccaggtcccaatcagcagttgaatgcatttcctttccttcattttcctttctgctatccaggcatttgtcctcttggaaagcaagacgaagccttcctacctcatgcttaatctgctccagtggcattagcctaccctcattcctcagagagaacagatccttcctaactcagaatttcacacaaggcacgtacccaggagtcctcgccactctattccaccccatgtcccctcatattcaatagccataggctttagtctagaggtgacacctctgggacaatgtacctgaagccctagacaaggagctttgttatttgccatcacatattctacgtttttctacatgacatttatatcaataatttttgtttaaataatttttaatattttagtccctctcctcaacatacacgcttctaaaaatcagtgtgttgctcactaccaatttccagcacctagcacagtccttagcatatggttggaactcactgaatttcagcattataacgaaatgaattaaatggatgttgtacacatgtgtgaggagccatgtggaatgtaaatggcagcatacctatgtgtaaagttgtcagaatcaaggaaatggagctacattgggagccagaaagctaatccatatggatgtcaaggagatgaggcttgagacacagagcagtgagcaatgtgagggatccaaagggtagggaagtcccacaggaacacaggagatgattcaaagaacccgtggttgtcctgaaacattgcttttcttcatgggctagaggacttccttggcagagggctgaagacaaatgcgtgcaaaagtgctttctctaaatgtctcaccagcttatgttttcaatgtataattccagaactatatatcacccatctctccgtgctgttcagttcttttcatcctgctaaatcttttctgcatctctatttagatgatttctcattctttccatctgagactgatggttatttccatgtggggatgttacgaagaagagtatttagggtctagttagcaaaaacagaccatagaatttttttttaaggtctgcccagcatttaagaagatatcagcctgttctccaagtgtccagtcctatctcgtgtctaccagcttttagcctttttctaaggataagctctcgcttttcaaattctgtgtgacatttttaaggccacatacatgaacacattttcatttattccatcttgcagtcctgaagcagtaacgtgactacctgttgcagcaaaaaggctgctccttggcctgatctgcatcttccggggaacttgcctggcgatctacgatccatcaaattttccccttagtaaatctcagaaaaagatcacccataagcatagcacaggggtattctgaggtttgactagtatttcagagtgctgtagatcctaagatgaaagtagtaagaaagttgaaaaaatagtattatttattcaacagacatgctagaaatctcagagcttccctagtccctattttctgtcctaagcatgtaacataaaaccctgcaaaatcagaactgagttctctgtaaagacattcagaaataaacaagaccaaccttgaagggggaggccttgtaatccatggtttattcttcttgttatggctgatggcagcacctagattagagtaggtgctcagccatggattcactgaaataatgctttaaaagtatactaatagagaagaaaagagagaagaatcaaatagacacaataaaaaatgataaaggggatatcaccaccaatcccacagaaatacaaactaccatcagagaatattataaacacctctacgcaaataaagtagaaaatctagaagaaatcgataaattcctggacacatacaccctcccaagactaaaccaagaagaagttgaatccctcaacagatcaataacaggctctaaaattgaggcaatagttaacagcctaccaaccaaaaaaagtccaggaccagaaggattcacagtcgaattctaccagaggtacaaggaggagctggtactattccttctgaaactattccaatcaatagaaaaagagggaatcctcccgaaatcattttataaggccagcatcatcctgataccaaagcctggcagagacacaacaaaaaaagagaattttagaccaatatccttgatgaacattgatgcaaaaatcctcaataaaatactggcaaaccaaatccagcagcacatcaaaaagcttatccaccatgatcgagtgggcttcatccctgggatgcaaggctggttcaacacacgcaaatcaataaatgtaatccagcatagaaacagaaccaaagacaaaaaccacatgattatctcaatagatgcagaaaaggcctttgacaaaattcaacagcccttcatgctaaaaaccctccataaattaggtattgatgggacgtatctcaaaataataagagctatttatgacaaacccacagccaacattatgctgaatgagcaaaaactggaagcattccctttgaaaactggcacaagacagggatgccctctctcaccactcctattcaacatagtgttggaagttctggccagggcaatcaggcaggagaaggaaataaagggtattcaactaggaaaagaggaagtcaaattgtccctgtttgcagatgacatgattgtatatctagaaaaccccatcatctcagtccaaaatctccttaagttgataagcaacttcagcaaagtctcaggatacaaaatcgatgtgcagaaatcacaagcattcttatccaccaataacagacaaacagagagccaaatcatgagtggactcccattcacaattgcttcaaagagaataaaatacctaggaatccaacttacaagggatgtgaaggacctcttcaaggagaactacaaaccactgctcaatgaaataaaagaggacacaaacaaatggaagagcactccatgctcatggataggaagaatcaatattgtgaaaatggccatattgcccaaggtaatttatagattcaatgccatccccatcaagctaccaatgactttcttcacagaattggaaaaaactactttaaagttcatacggaaccaaaaaagagcccacattgccaagacaatcctaagcaaaaagaacaaagctggaggcatcacgctacctgactttaaactatactacaaggctacagtaaccaaaacagcatgctactggtaccgaaacagagatatagaccaatggaacagaacagagccctcagaaataataccacacatctacaaccatctgatctttgacaaacctgacaaaaacaagaaatggagaaaggattccctatttaataaatggtgctgggaaaactggctagccatatgtacaaagctgaaactggatcccttccttacaccttatacaaaaattaattcaagatcgattaaagacttaaatgttagacctaaaaccataaaaaccctagaagaaaacctaggcaataccattcaggacataggcatgggcaaggacttcatgactaaaacaccaaaagcaatggcaacaaaagccaaaattgacaaatggggtctaattaaactaaagagcttctgcacagcaaaagaaactaccatcagagtgaacaggcaacctacagagtgaacaggcaacctacagaatggaagaaaatttttgcaatctactcatctgacaagggctaatatccagaatttagaaagaactcaaacaaacttacaagaaaaaaacaaacaaccccatcaaaaagtgggtggaggatatgaacagacacttctcaaaagaaaacatttatgcagccaacagacacatgaaaaaatgctcatcatcactggccatcagagaaatgcaaatcagaaccacaatgagataccatctcacaccagttagaatggtgatcattaaaaagtcaggaaacaacaggcgctggagaggatgtggagaaatagggacacttttacactgttggtgggagtgtaaactagttcaaccattgtggaagacagtgtggctattcctcaaggatctagaactagaaataccattcgacccagccatcccattactgggtatatatgcaaaggattataaatcatgctgctataaagacacatgcacacatatgtttattgtggcactattcacaatagtaaagacttgaaaccacgcaaatatccatcaatgatagactggattaagaaaatgtggcacatatacatcatggaatactatgcagccataaaaaatgatgagttcatgtcctttgtagggacatggatgaagctggaaaccatcattcttcgcaaactttctcaaggacaaaaaccaaacaccacatgttctcactcataggtgggaatggaacaatgagaacacttggacacaggaaggggaacatcacacaccggcacctgttgtggggtggggggaggggggagggatagcattaggagatatacctaatgtaaatgatgagttaatgggtgcagcacaccaacatggcacatgtatacatatgtaacaaacctgcatgttgtgcacaggtaccctggaacttaaagtataataaaaaatatatatatataaaaaaagatatagataaatgcaggtatagaacatattgctggattgtaaggtatcatttctcctgaaattgatatatacacaatacaaatcaaaatcccatcaggcttttatggtcgttttataataaattgtgaaattaggtaaaaaaaaaaaagaagaaaatgtggcacatatacaccatggaatactatgcagccataaaaaaggatgagttcatgtcctttatagggacatggatgaagctggaaaccatcattctcagcaaactatcgcaaggacaaaaaaccaaacactgcatgttctcactcataggtgggaattgaacaatgagaacacatggacacaggaaggggaacatcacacaccggggcctgttgtggggtcgggggaggggggagggatagcattaggagacatacctaatgcaaatgacaagttaacgggtgcagcacaccaacatggcacatgtatacatatgtaacaaacctgcacgttgtgcacatgtaccctagaacttaaagtataaaaaaaaagtataccaattcacagaaatcctccacacttccaattacaataaaactatccatctattactctaaaatttgtgaatattaatcattctatctttccagcttttcttctgcatttgtgacccctttgtactatttttttctgttaggatacagtcaagaaaactgaaatcatggtagtaggtactttaaagacggaattggttaccagatgttagaaggctctagaagttcttgagcaggagtaattatagacatcagtttaccttaaatgggcagaattcagatagataacaacaacaacaaaaagagactgtggaggttattcatagtggactaatttgtttggaaaaaataagtagctataaatcagtatattctagtatctttgagacaacaaatattggaaattgtttttcttttcttttctttttttcccagcaagtgctgtgtttattttccaaacaattttattgaaatgtcccaggagtagatgggcagcacaaatgtatgaacaggaaaaaaaaatcacatgtacaataatttttttaaagtgaaggttaatcttgggagatatcagttcccctctccctccccctgcagacttccagcgtttccgttaaggttaagcctctacgaacctagcattaaaaaaaaaaaaaaaaaaaaaaggaatacaagatcttttgcaaataacaaaaacaaaaaccaaaaaatggcataaaggaaagagaaataccttcctgctcagatgggactcttcctaggcacctaattagaaggcgtgctgagcggtggagaaacacaacttcagagtgtaagggtatggaccattgggtttttcatcaggtaatggttcaggaagcccggagtctccagggcatcgctcttggattcccattccagcagtccagaggagctgcgctcgctttcgcctgagaatactttcacagaagatggccgcttcactcccagctcatcatagatctcaaagaagttctcctcggtcgcctccagcggggcgttgaagaagtgcagcacgttgctggggtgctggatgcggttcttggctgcctgctctggggtggagaaccgattgttccgggattcactgaagtctttgtaactgcaagacccatcttccaacccgtatgactgaccgggcatgatggctggctgcttggagacacagacattcagcttctgcccaaacatgaagttgttgttgaggtgggtaatgacccggtccacagcgtagccatcagccatctccaccatggcgcccccggcttgcttttcaggaatttcaccttctccacattgccatacaagcagaagacattgaagactaggtcacagttcatcttagattgatgcaagccttagaccacgagcacagggctgtcggcgtgagggccatactcgggtggtgggggagggggtggggggtgcccatactggggggccgtagcgacttgggccccgacagtgacccccgactggtggacccatccttctcccttcgtagtgaggtcgggggggcccgtggccctcatcatggtaatggctgtggtacccaccgtggggccctccatattctgcggggtgatctcccaggagagggggctgcctctggcgtttgttggggttgctgccagggtcaccttgtccactgagattggggtttgtgtagtcccaagtatcctgatcattcttgaacacattcaagcgtgtaggctttgcgtattccatcttcagagtgcaacagccagaatagataccagccccattgagagaggccttggcccgctgggcactttgaacagagtcaaattccaccatcgcctgaactccattcttcctgaaaatgataattctctggacagggccacaaggattacagatagtgtaaagaacatccgtggtgatcgaataaatggggttcaggatggtaaagagaagcacactgttcacgctccgggagtcatccgagtccccggggagggagatcttctggctggtagagtagttgacaaaagctgggtgaccggcaatgtatatttggttgtcggctgcgtagctcacggcgttgcaagcccccaacacatcttcaaactccaccagtgcttgtctctttttaggcattaccaccgcatagctgatgggtccaaactcctgcaaggcctccacaaggtcagcttccaccacatcgtcaatcaggcccctgctgtggacaactggggaggcaggggttttgtgcaggtcatggtagttctccccgccgccgcccccgccgccccgcctcctccaccgccaccgccgccgccgccgcctccgtgctggtcgccggcgttgccagtcttgagccgcttaggggcaccgccgccctcactgccgccgccttagtagccgccaccgccgcctctgccgccccccgccgccatcttcatcgctcccgaccgcctctgctgctcctcccgctgctgcctctgctccagccgccgacgccgcttctcccaggaaattacttttccaagttagtttggtaaagtttaaaaggttggtgctttatcctgtagacaattgagagtagtttctgtatttaagaaggataaataaaatgttctgtgtgcagggcggattagaaatggaagacattggaagcagagagaagttaaggaagaatgttgacattatcttaaagtgttaagaacctgaacgaaactccttgcaaaatcattgccagggaatacagtgtagggccattgactgactctagtagtggatgaggacaactcacagagagaaatctgacaatccatgtttagcagagggaaggaagccagaaatagttactaataagtgcaagacttcagttttgttggttttttgttttttactcccagcaagctaaatttgacaataatgtagctcaatttctccccatctcattttgttaatctctataatcttgccccagaaaagccatttgtaccccagctcagaaaattctgtattcatttgtcttcataagattgtaaaaatttcaaaactgtctgttcatgataattagagaaatacaaatcaagactacaatgagataccatcttacaccaaccagaatggctattactaaaaagtcaaaaaataacagatgctggtgaagttgtgaagaaaaaggaatgcttatacactgttagtgggagtgtaagttagttcatccattgtggaagacagtgtggcaattcctcaaaagcctaaagacagaaatagcattggaccctgcaatcccattactgggtatatacttaaaggaatataaatcattctgttataaagacacatgcatgcatatgtacactgcagcacaattcacaatagcaaagacatggaaccaaccaaaatggcaatcagtgacacactggatcaagaaaatgtggtacatatatgccatggaatactatgcagccataaaaaagaacagagaccatgtcttttgcagggacatggatggagctggaggctattatccttagcaaactaatataggaagagaaaaacaccacatgttctcacttgtaagtgggagctaaatgatgagaactcacatggacacacagaggggaacgacacacactggggactttcagagagaggaggcagagagatgggagatcatcagggaaaataactaatgggtgctaggctcaatacgtggatgatgaaataatctgtaccacaaacccccatgacaaaagtttacctatgtaacaaacctgcacttgtacccccgaacctaaaataaaagtttaaaaaggaagtgaaaaaaactttaaagtagctcaataagttttatattaatgtcaactttaaataatttttatgcataatacgttattaaaattcatttacctttttaaaaaaagaatgtgaaattttagcagagttttcaacaacaatgttgtagttaacaagagaaaagcatccctgatgctttacaaactggtgtttcaatgaattagtcttttttttctgagagggaatctcgctctgtcgcccaggctggagtgcagtggcatgatctcggctcactgcaacctccacctcccaggttcaagtgattctcctgcctcagccttccagtaccagaaggcgtgcaccatgacgcctggctacattttgtatttttagtagagacggggtttcaccaggttggccaggctggtctctaactcctgagctcccaaactgctggtagtacaggcatgagccaccggacctggccaaaatgaattactcttaattgtgttctattcatttgtttttcctgcattttcatttcatttcactttgatgaaccaaccgaaatacccgatggaatacagtgacagcttgaaaagcttcatgttaacaaagttatcattccacagtagataaaataatatgtgaaagtagtgagaacttaggaattcctctaaaatcagaatttaaagacataccacttaccctttgttaaaatagcttacagcacagaagtcttagaaaatgggcattagagtgtcagaaagctagtcatgttagaaaaaacctttcaaatcaaggctagccacctcattaaataataaaatgaagaaactagttataaaaccggtgttccattttcaattttaaaaaaatgctgatggtaaaataaccattaatttaaaatatttttctgctcacttctagaaggtggagcataaaccacttaagtgacctattttagccccactaaagcaaatggcaaatattgggattggattaccaaatgtatgccttccatttcattggccatatatcttattgtttcatgcatggataatggcttttctccttcttcagtaacccaaaggaaaagctgacattctaacctggagctgcacattcaagctttgacacatgcctctcactggtttcgtctaatgcttataataaacctgtagagtcagcaactttagaaagatgggttgaagaagtgtctttatcatagtttgaatttttctctggggcacttggcagagtcacctctggtgtttcaaatgtgcttgaaagttatctggctgccctctgagaagtctgcataaaaactgctttacttaaaagcaggcaaaattaaggtttctgtaacaaaaccataggcatcgcattgagataggacaaagaccaaatatcctgcttccatgtggcagagaaataatgaataacttggttcaagagctcatggagtggcatatcatcacaccattattaatagagaacattgctaatttctaaaagggcttcatgtcatgattattttatcctcttctttctgttaaatttttaacatgtatgtccactgcaaagtacgcaaaggaaataaattagcactaaaaaaagggcttcttcacaaccgcaaattatatatatatttctttcagaacatcactttagagagaaaatagcaaaaattcagcatcatcactttttgacagttcactagccaatcaaaatatagaaaaagaaggagaaattaagtacatttgtattcactgtacatttttagctatttgtgtagaagaaaaacaattagcttatttaaaaaccctaaggtgagtatgcagtttttaattattatctttgctgttgtgatttatatttgtattttatttatgtaaaaaccagtaaataaacctatgtcaaatacttctttatttttgatactagttcaaaatattggtgacttttttagatatgaatatctcatatgtatcttttagaaattatcagagagttataaaataatattggggaggtaaggaaggcactagacataagaaacttgtatagacaaatactttgtcaccaaagttgtatatttaaaagtccctattctttgtctcttatcgattcaaaattaattcattagaaaagaattttcctcaacatttaatccctagttgttcatctttttcactagtttgtattccattactcattgcttcatagctaaactctgtttaaatctgttaactgaaatgattttaaaacgttttggtggagcgctgcgggaggtgcgtgcgcgccccggccgccgaacaaaggagcaggggcgccgccgcggggacccgccacccacctcccggggccgcgccgcggcctcccgtccaccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcaccggcgctccttcggcggcacggaggaccgcctgtcgtgcttcgcgcagacggtgtcccccgccgagaagtggagcgtgcacatcgccatgcaccctcaggtcaacatctaccgcgtcacccctaagcgctaggcgcacctgagcgcgccgccggccgacgagatcgcagtggaccgcgacgtgccctggggcgtcgactcgctcgtcaccctcgccttccaggagcagcgctacagcgtgcagaccgcggaccaccgcttcctgcgccatgacaggcgcctggtggcgcgccccgagccggccactggctacacgctgcagttccgctccggcaatgtggccttccgcgactgcgagggccgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatccggacgaggagaccgaccaggagaccttccagctggagatcgaccgcgacaacaacaagtgtgccttctgtacccacaggggcaagtactggacgctgacggccactgggggcgtgcagtccaccgcctccaccaagaatgccagctgctacttcgacattgagcggcgtgaccggcgcatcacactgcgggcgtccaatggcaagtttgtgacatctaagaagaatgggcagctggccgcctcggtggagacagcaggggactcagagctcttcctcatgaagttcatcaaccgcgccatcaccgtgttgcgcggggagcacggctttatcggctgccgcaaggtcggggcaccctggacgccaaccgctgcagctatgacgtcttccagctggagttcaacaatggtacctacaacatcaaagactccacaggcaaatactggacggtgggcagtgactccgcggtcaccagcagcggcgacactcctgtggacttcttcttcgagttctgcgactacaacaaggaggccatcaagatggacgggcgctacctgaagggcgaccacgcaggggtcctaagggcctccgcggagaccgtgcaccccgcctcgctctgggagtactagggcccgcccgcccttcccggttcctgcccacgtggcggctccttccaaccctccctgctaaccccttctcctccaggtgggctcccccgggcgggaggcaagcccccttgcctttcaaactggaaaccccagagaaaacggtgcccccacctgtcgcccctatggacttcccagtctcccctccgccctggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatctcttgcccctcccagccacctcctcccagccccccaggagctgggcacgtgtcccaagcctgtcagtggccctccctggtgcactgtcccgaaacccctgcttgggaagggaagccgtcaggtgggcgaggactgagcctcggtgtttttttgggtggtggctggaaacagcccctctcccacgtggcagaggctcagcctggctcccttccctggagcggcagggtgtgacggccacagggtctgcccgctgcatgttctgccagggtggtggtggcgggggggtaggggtgtgggggccgtcttcctcctctttcctttcaccctagcctgaccggaagcagaaaatgaccaaatcggtatttttttttaatgaaatattattgctggaggcgtcccaggcaagcctggctgtagtagtgagtgatgtgggtggggcgtctcagcaccctccccagggggtgcatctcagccccctctttccgtccttccggtccagccccagccctgggcctgggctgcggatgcctgggccagagcccccgctgtgattggtgcttcctgggcctcctgggtggatgaagccaggcgtcgccccctcggggagccctggggtgagccgccagggcccccctgctgccagtctcccccgtcccgtccccgacatgcatctcactctgggtgtcctggtcttttattttttgtaagtgtcatttgtataactccaaacgcccatgatagtagcttcaaactggaaatagtgaaataaaataactcagtctgcagctcccccccccaaaaaaactttttgtccattttttacctattccatttgacattggtctcatatgatatcatgatataaaggaaaatgaccccgcaatgatatgattcataattccactataaatttccttgatgctttgagagtgtgattgatttattttgcccccttccttttttttttttttttaactataaagcaggtacctgtacaataatgccatttttttaaactccaaataaatagaaacagctataggactaaagtttctaatatgaatcttatagtttacttagcacatgctttaataaagttacctcttcaggaaactagaatattgtgtctggtgtaagactagatgttttgtcaaaagcatatgtaatattcatatagcggagctttggctttatgccatgaacaagcaggaggtgtttttggaactgacctgttgattttcacacgttatttattagaaatgactgctgccattcccacatagtcctaagtgtaaacatttaccatatgtatgtggcttcaagattattttgttgttcacaaaatcacctatgtcctcccatcaaaacactatcctcatcttaaaagtaaatggcactattttattcaatgatttacattttggaatcctaaccagatatttttttccttaaatttcaagcactgcattacttccaaagacatgctatgggtatgtggaaattatatcaaacatgagtaaattttgttgaccaagactgcagaaataacaataccatcacataaatatatgaatacagatgttgatggttggtgaaaattacccccaaatagccaatgccacgagtatattttgaatagctagtttgatttttattaacattatactaaggttatttctaagcctgcagacaaaatttatagaatatactactcagatacttgagaatgtactacttaaatatttggatatttttattccaaatatatctccactgtgattttttaggagatacaattgccatcacagtaagatattgctgattccaatgaaatttttaattaactagaaaaatcaaagaatgcaattctttttcaagatttcttcaaataaagaaacaagcaaaattaggctgtggtgctgtgaataacaccaagaagtatggagtcaggcaagcctcaggttcagtcacagttctactgttaagtagataattctaagggtgcgtctctgtgtcttaggtttgtggagacctacagcagcgttccacagaccaacactgagcctaccccacgactattcaacctgaccattattgggtagctttcatctaaccagttagaaagaaaacatctatgaaaactatttactaaagaattatatattttaattaagggtactgagcacggtcaagttagagaacaatagagtagaaaacttctattcaaatataattgagaccagttttttgatagttaatctaaaaagtgagttaaggaggaggatcatggggttaaaaaaaaccagaaatgtaaattatttggccaatattttgatataagtccaggaccctttgattattactctactaactggagtttctatacattgtcttctttgtataaattaggatcataagaagtcaattataattctaaatttttacttgtttaaagtagaacaaaaaaagtaattgaagtgcaaaaaccttttagcttattaaatttttgctattctgattattctaattttataattttttcttaaaaatttacattgcttagccctcctagtaatcagcttagctttttctaatcttttcaagacccagatatttttacataaatagcaccactctattataatcacatccctgattttatttatgtcacaaaagaccaacttgaatacaacctaaataaactgtctggtagataagttaacaacataacgtcaatttgaggcaacagacttacataggcataatagaaaacacactgttattttacagggagaatgtacagtgtccgttcattcaacaagttagttaaacacaactcaactaaaacaatgtcattgaaaagtagcaaattctgtttttgctccatggacttacagccaatgagtcctgagaaagaagagagaatttaaagagcttcattggcaggtgaatctgtacttggccttttagcttagagactgaagctccatattcaaagcagaagaatagtgagacatcccatatgaagaaagaaatcagaacagacatgcaggggcaaaagtagccatggtctgcgtcctggctcaggaggacagtatgtgttgaagagcaaagcctagaatgggctgatgcctgtaacctcaccccatctcattgctttatctactcacactgcttgcccagaaaatctggtgccccacagtgagaacaggaactgggcatcccagctaatcttcagctgggtgggtctcatagggttgtcagatttgaaaaaaataacaataggctttgaagaaaaagacttggagatgaagcagaatgctcttgccaaagcttccctcaattgacataagaggaacaaatttatttcccaaattagttatagtataatttaccaggtatccaaataaatttgtttagacactaagagttttcccctcgaataatgcctgaccataattttacatataattcctttattcaacaaatgctcaaagtatgtttgttttataccaaacacttttaaggaattaggaataccattgtgaataaaatagacaatctctactaaatgcttagttatgatggaaggcaaacaaatacataaaataagtaagaaatacagttttatgcctcatgatgtcagatgatagtaagtgctgtgtccccaaaacacttactcattttctcaaactattataaaacagggacggtgcataaagagtgctggacatgggactgaagattctgttttaaatatggttgccagggaagtcctcactgtgtaagaacattccatcgaggacttgaaggagatgagggaagtcatcaagaggatgggaaaaagaacactcccagtaataggaccagcaaatgcaaagaccagaggagaaagacatctgctttgtttaagggacagcaaataggtctccctgctacagcagagtaaatagagtggaaatggtagaagagtttttagttgtaaggcaagaaggggaccaaccatggagagtcttagatgtcattgtggagatttctattttactggaggtgaaatggaagccactgaagacacttgaaatggaggctgatatggttcacagctttaatagtctgctgtctgctgagataagaattgactataggacaaagggtagatttaggtagtgagatgttattgcagtcacctaggaaagagataggatgatttgaactagagtggtactggtaagaggtggtcgtattttgaaaatatctttgaagtagagttgacaggatttggtgatgaatttgacatggaatgtgagtcaaatttcatagcctgagccaaacatccctatttaattaggttgaatataatggaaaaggtggggggaaatggattaagaaaagaaagaagtttgttgtgggaaacagtaaggtgaagaaaccagcagagatgttagatatctaaatctgagttcaggagttttgaatgcatagaaaatttgatcattagcatggggctggtatttgaagccatgagactggacaaggtcattttagtttagtgtatttccacagattatatttcaagcatcgtgctaggtactttaacgtttggccattttaaaagccccttggtaaatttcacaggaatcaggatttgactgacctgtttttctcagatgtctgacctcagtcggatgcatgattttattatatttaattccctataaaattccaaaatatcaaaataagacctatatttattagcaggatttttcaggtacaatattcctactcagatagaactatatcacttaatttcacagaaatatccttccctggggtgatgatactattatatcaccaatcatgaagtcatgctgacttgcaggcaacaatggagctcacatttagatctaagctaatttgcatgacttacttaaattatgaaaagacacacttttagagagcaggcagattttgttaattctgaattatgtcaaagtatcacttaataattctcaagggcccaactctggcgaaaccggatgctgcagcgtatgtgtttcctattcccttccaacttttttcatcatgattcatcagcgaatgctatgaagtctagaaatttaattaatggatatcagggccattggaccatgcatttacacaaattgctctgtgaagaaggaacattcactctctctctctctctctctctccccaatgttttgtccccctctttctctttcaagagcagaacattttagtgacctccagttaactgtctgaactaagcagccatctcttaggtaataatgcattgctaacaaacctcagcatagacagtaacgctaccactaaagcttctgttcatgttgttctagggctaataaaatggtacattgtattctagctctgaggaaatttgagattgtctcatattttctcagttaaaccagataataattaattatggggaagggagaggaattgctgtggcagagccagcgtgagacataatttctatttattctcaatgtattatctgttttctccctagaggcttccttttgttactcttatatcaaaatcccacttaattttcctgccatctcaactcaaaaatcatacctacaaaagagctaaagtgttcatctttttgcttttgcacaaactctgtgccagctatgagagtgtaagctttatagttatatatagatgtttttatttataatctttctcctgcaagaaaggattaaagtgaagcaaaaagaacatgtaataagatgaataatgaatagaaaaataatttgctcttaagacaaagtaaaggaaactataaaagggagatgactagaactatttagcaagaagagacctcgttctttccatcaaatagtgtggtgtaatttgcacaatgcacccaatggttaatgaatacatatttgttgaggatagcattaataaatagatgaccaaagaaaaactaatacaaaagatttttacccttcaggaagtaactattaggtaggtattgtaaattctaactttaaaagatagaggaaaagatatattgagctgacccataaatacaacaggaagacacagagtaacaattactgcaggtgaatttcagctctcagtctatctaccaaccagtgtcaccaggaaccttcttcagactcatgtatccaactgcttatttatcttttgcacctggatatccctcagctacctccatttaattcatcttcttcctccaaactggtcagcatccaagcagatccagagaactgtgaggagctattctagtctctgccctctcccccgttgctgatccagttaagagggccaaagaatatagttgagaggacaccagctctgtatctagtagcatttagttttaatctcatcccttaacttgaaattggcatggccttcagtaagtgatttaactcctctggatatcaattgataaaatgtgaaaaaatttccaaaattaattgcagtgagtattaaaatagcatgttttgtacatcatgatctctcaataaacaattgcagtattattcaaattggcacacaggcctatcactgctccttccttttagattttttttccttctgtttttgcctctgaatgccccaagccaatctcccttcctctatcacctttttaggaaatccatccccaccccactcaccccaccactcctcacactcctttctctcctaccctggcctccaccatagctcctccattcccacctgtaatccagcctctgcaccactatcagcgctgcgcttctgaaatgcaaatctcatcatgttgcaccttataacatctttgaatgactcctacttgtctcatgatgaattctaagctccttagttttaggttgaccatgaccttttttgatctgaccctgtccatctctccctcctaattctcatttctctccaccaaatactccacccttcgtactgaacaatgtggctctactgtcatctcttcatacttatattttttccttgatccttaactttgttcacaatgttcctgccatctggaatagcattttccctgttggcctggaaaatttgactattcctttgcgatggaattcagtcttcacttccccatgagtgaccttcttaggacaaattgacagtatcttatattgtagtcccacagtccattaggcagtcttcaagtgtccaataggagagtgcatgatattagttgtttatatgcctatttctcccactggctttgagaaacttcagggattgttgtaaccatttgtatccccagtgtctagcatagcgtgcatctatttgtgttttgaatgagtgagtgaattaacgagtgatgagaaagccatgacctatgtttgtctctaccaatcttaaatgagattataaacagactgattcaactgaagattgcaggtcctattccttttgcagttgttattgtacatgttagcaaaaagcttcagcctttccaaaaatttcttcagtggtagcaataaattcattgtcttctgggagcaacactgtgctccctctctctctgtctctctctccctgatttgcctattgctactttgaagagtatgtgtttatgactttataatttgctacagcgcatgtaataggagcccttctatttcttcagaagtggttataagaaatattcacacttgcttatgttttgtgaacatctatatctggtggagcacatgttattataatcttattttaagcggaaatatagattaaaggattttctcttactgttcttaatgtaatgcttctaaattagatacacgaaagtgctcatctaggagataatggaagcataagcaaaacacagaaaaagccttaccaagaatgaattataaccaacaaacaaatgttagttttattgcaatagaattactgaattagtacatgatggaacaaaaaatctataacaagtttagatgtcagtaatgtattcgacatggattgtatacactgtacccacaaaattctatcaaattgtttctatttcaagaaattttcagtttattcatgttcaacacaaaagttaattatacatgaaatataaactcaatgcagaacattggcattgtatttcctggctttctgggaagaatgtgggagcagggttaataatgaaatggaagagaaagctcttcactcctctccttgttcccaggataggacaaaatacacatggccaagaatgaggaaagtaggacaaaacccaatatagtcaagaaagttatgaacctgaggtatgaggtaagatctggccctgggaatgttgactgacactgcaatatttagtatctagactggaatgattagatatgaagtgggttaacctggagtccttagagatggcgctattcccagaaagataaatgagatccagtcctaggacaaaaggacaaacatcattggtcggaaaaagaaaaaatgatttagaaaaaaagagaaagagaaacaaaatgtagaggagaagaagaaatcccaaggatggagaccaaagggtttgccaacagtctgttccttgggaatgcgagttacaccgcagcctggaagatgatgctacttccaagcccatgattctgtctccatgacttaggacactagtcacaaagaaatagaacacatctttctccttctagatctcattgtccattgaagaactgctactcatggcctgcaagagtgaaactcattggttctaggaatgaatgaaattggacctgctggaggcctttaattattatgtgggcctcagaactgatgaggattgatgtgggtgttatttcaataaagagttataaacaattcatatatgaaaaatttattttcttaatttatagttaaatacactaatattgtatttcaatgttgttattcaaattcaagaccatgtcagttcttagacacaatctctcactgtgtattaatttcaaaaagacattgtagtaaccacagatatattttatatatagatataaattaatagacattactttttgagctgttttatgtttagaggcaaaaattagtgaaagttaaagtgcctgtctgtagactctctcactccacccccatttctcctatttttaacatcttgtggtatttttaacattagtgtgttacatttgttacaagtgatgagaaaacgttgataaattatttttatctaaagttcataattatattagggttcactctttgtggtgtccattttatggattttaacagagatgtacccaccatgacaatgttacacaggattatagtttcactgccctaaaaatcccctgtgctctacctagttattcctcctttctttcctccccaggaacccctggaaatgactgatctttttactgtctccacagttttgcctttttcaaaatgtcatatacttgcaaccacatagtgtgtaggctttcatattggcttctttcactcagtaatatgcatttaaagttcttccatgactttttgtggcttgatagctctttttttatatagaactggttaatattccattgtatggctacaccgtacagtgttagtccatttgcctattgaaaggtcctttggttgtttctgttttggtaattatgaataacactggtataaacatttgtgtgcacgttttgtgtgggcataagttttcaactcatttggcaaataccaatgagcacaattatggaatcataggctaagagtgtgcttagtgtcataagaaactgctaagctgtcttccaaagtggatgtaccattttgcatcccaactagcaatgaataagttatttctgctcattgttcttaccagcactcagttgtgttgctattttggattctggccattataagagctatgtagtagcatctcattgttttggtttgcaattttctaatgacatatgatattgagtatcttttcatgtgcttatttatcattagtaatatgttgccatcagtaacgttcctttccctttccattgccagtgagatccagcatttttttttttttttttgagacatagtcttgctctgtcgcccatgctggagggcagtggtgcaatctcactgcaacctccacctcccaggttcaagggattctccctgcctcagcctcctgagtagctaggattacaggcacctgccaccacacctggctaatttttttttttttttttactagagagggggtttcaccatgttggtagggctggtcttgaactcctgacctcagatgatctgccctcctcagcctaccaaagtgctggattacaggcatgagccaccgcacaaggccagatccagtatttcttaatggaaatgaaaaattcaccagttactgcatttttccccatatatttgtaataagttccgacgtctgataaggcaagtccaaccctccgcattttaaaaaattaatcaagttatttattaaaaattaatagtctacgcacattttaaaatcaatgaccatattagatttactggaaaaataatgtaatttaatattaatttatcacatccattaacatgataattctccacttatttggatttcctttaagatcaattcctaaaattttctatatagatggttttaggatttttttttgtagcttaactacaagatactttgtagtgtctcaatttttattacacttttacaccttcaattcaattattgctgatatggaaaaacttttttttcaacatctattttagatttagtgggtacatatgcagatttgttatatgggatactacttgatgctcaggtttggagtacaaatgtatccattaatcagatggtgagcatagtatgcaatagttactttttcaacccttgtccttcttccatcccccatctaatagtctgtgactttgtactgttttctattatgaattggggaaaagccattattatattagcttcagaacaactaggttcaagtcatggaaaacaatttcgcacaaacaactttaggaaacactgctttgaaaactgtaatctgaattatagctgaggccacagaaaccaaatatttactgaaggttcttttaagaaaaacaagttagccaggaatggtggctcacgcctgtaatctcagcactttgggaggccgaggtgggtggatcatgaggtcaggagattgagaccatcctggccaacatggtgaaaccctgtctctactaaaataagaaaaaattagccgggcatggtggcacatgcctgtagtctcagctactcaggaggctgatgcaggggaattgcttgaaccagggaggtggaggttgcagtgagctgagattgtgccactgcactccagcctggtgacagagcaagactctgtctcaaaaaaaaaaaaaagaagatgaagaagaaaagaaacaagttgtattgaaagaggacatcattaacagtatatctcttcaataatggtttattttactatattctcattcctctcttactgtgtcccaaatctctttacaggctaaaagaaactgttcagaattaatcctattcataaagaacagcacttactgagtattgcattttcctcttcaaattcttcagcatacattgggactacaccatatggaccatttttacatttttacttttgggtttttgttttttttttcctagagaaactgcaactagatttaggtcctcattctattaggtcagtatttgtctagtaaacttcagcttaagcaaaataaaatatgtgttgctttgaactgaaactcctcaaaaccgtattttaaaaattacagaaaaaattaaatgaaattattattttaaaaatcttgtagatgaaaagatatgatatatagtaagtttaagtacctatttcaatggttcccacagtggggccctcagacacccaggtccaaactattttaacaggaatactaacatggcgacatttggtgtaagggtgctaatacaataccgggtaaaaatgcgggcagtttagcacaaataaaggcagtaacaccaaactactagtaatcatagtattcttcactatgcacaggaaaggtttgaaaaagaagggcaggttgggcagtgtctcacgcctgtaatcccagcactttgggaggctgaggtgggaggatcaccagaggtcaggaatttgagaccagcctggccaacatggttaaaccccatctctacaaaaaatacaaaatttagctggacatggtggttgcatgcctgtagtccctgctacttggaaggctgagacaggaggattgagcccagaaggttgaggctacagtgagctgtgatcatcctactgcactctggcctgggtgacagaacaaggtcctgtctcaaaaataaaaagaatgtctatgatgaagcagtgaaaattttactacatcttaatccttgaatatgtctttttaatatttcaagtgatgaaattggaagcacacatgagcattcctacagactgcctgaggaaaaaccctcatgtgactaagtcttgaagtgaattaaccactttaatggagtatcatttttacttgaaaggagtactgacaaacaatgttatttcaactggggtttttgggagacattttctcaaaaaatgaggttctgtcatttcaagaaaaacaacagacaggccataataaaattcaataataaaactgctaataataaaattaaagcttctgaataaaaaattagaattttagaaaatatatccaccattgctttccaaaagtattctgctgagattgatggtgatattgatgaatgtattttgatactgtataatcaaatgtatcaacatgtagaagatctcggtgaaccattattttctaaatgaccaatgcatgatgttataatatcatgcaagggtaaaagatccaaagttcaagaaaaaccaagttttgatggagtatcaaaaaagaagcctaggcaacatggcaaaatcctgtccctacgaaaaaaaaaaatacaaaaaattagccaggtgtggtgatacacacctgtagtcccaactactctggaggctgaggtgggaggatcacctaagtccccagagactgaggctgcagtgagctgtgatcacaccactgcattccagtctgggcgacagagcaagaccccatctcaaaaaacaaaatttatatatatatataaatatataaatatatatatatccacaatgatctaaaatggctatctgtatgagattggacattgttcacatttcttcaaggaaatatcacacaataaattgaatgcagatgaaaatgacataccagacatcaaggaaatttgcaaaaaatataagattgtgctactttgggtttagaaattttttcataaaaacatttataacaatacgtggtgagcttttaaagaatagtttaaatatttctgatttaatttctaatgataaataccagtagatataacctacataaaccaaagctccttgggccctcaatatatttttaagaatgtaaaggagtcctgattccaaaactttgagaactgctgccttcccctccactttcctgccttccctagaatttcttccttggaaggaacatccctttgccattttaacttacagagttccattcaggccagttttgctacctccctcccatctttccacctccctgtcttgacacaaaatctgaccaaaggactctaccagcccaccccatttccagtgcttagctgtcaaggtgggctaagccaagaaaatctgggttttctctgagactagacctctttttctgggagatctggaatcacagggacaaggttggccaccttgggatagtcagaattcatcttgcctcaaaggggagaggttaggcaagtttctacaaagccaaactgcttcctagaaagtcaaagataattatactttgtgccacaactgtgagaatgcccattttattgcacactttctaacatttttaccaaactgataaataaaagctggtacctagaagaaaaaaaggccaggcatggtggctcatgcctgtaatcccagcactttgggaggccgaggcgggtggatcacctgacgtcaggagtttgagaccagcctggccaacatggtgaaaccccgtctctactaaaaatacaaaaattagccaggcgtggtggcaggcacgtgtaatcccagctacttgggaggctgaggcaggagaattgcttgaacccaggagggagaggttgcagtgagccaagatcatgccattgcactccagcctgagtgacaagagcaagacttcatctcaaaaacaaaaaaaggttccatacaatataatttgttccatctctagaaaccaattcagcaatgagaactgaaagccaccacttggaaggtttcaaggatttagctctacctaatgacgtctaaagcattagttaaggtagaaaaaaatacacacacacacacacccctatgtatttagtaccaggaaacatgatggactagatggtatagtcatccaacagaaaacacacaataactgaagccactgtagaggagtaagttatgatgtggatctacaatattgttgagtgaaaaagcagattacaaaaaaatctgatttttcaagggagagggaacacatacaagcacaggagaaaagagatgagcagatgactggaaaaatacaaaattctgatagtggtaccttctgagtgggagaattatcggtaacattttctagttttgcctaaacattttctaaatttcttaaaataaggctttgttatccatattataaaatatccacctcctcaggaaacttaaccttcagcacaaatgctacaacatgttcaaagtttgttcagtttaagagacaatctattttgaaagacatctaaaatgacgaccaatatttaaacctatgcattaatatttttcaatcatatgctttaaattttgtaattttgttaaggttaagctttatatccatctggaaaaaagttttctatttgtctttaaaatatgacctacaatataccagtttttaaacaatgaatggtgctcaaaaattgcaatataaattcaggcagtgttccttacatagaatgtttaaaggcttctaacactgctcttcttcaccggttatgaaaacacattaccattatctaagcatctaattattcaggtcctttgtttctcctctattctattaattttatagtaattttaaggcctgtgaggatgaagttgtctgtgacagctaccacaaaggttactataagtggacaaatttcaaacaagtttatcaccactaccatccccaccataaaactgtcttaatcaagggcaacacatttcaaggttaaccaagacaacctctttacctgtcactgcttaagaaaaggactttttggtcttatttagaaataactttctctatctatttttctccataaatccactgagatcaatgtatggctctatctcaagcaccagcaagcaaaactacctgccagaatgtgcagtttttgtatctttccaagtgtaggacacagctatcttttgacatcacaatttttaaaaaattgatgcacaaacttcttcttgaacgttcagccaggcatggtggctcatgcctgtaatcccagcattttaggaggctgaggcaggtggatcacgaggtcaggagttcgagatcagcctagccaagatggtgaaacctgtttctactaaaactgcaaaaattagccgggtggtgtggcaggtgtctataatcccagctactcaggaggctgaggcaggagaatcacttgaaccggagtggcggaggttgcagtgtgacgagatcacaccactgcactccagcctgggtgacagagtgagactccaactcaaaaaaaaaaaaaaaaaaaaaaaaaaggaaaagaaaataaagttcagacatacagcagttgtaattctaagttcagacatacagcagttgtaattctaagttcagacatacagcagttgtaattcctctgaaggctggttatgggacacatcactttcatactttgctgttcaataaatgtgggctggagaataaagtaaactgacagaattaccatataaaataaaattctaagtgctctgacaacaagagaaccttaaaatacacacacacacagacacacacacagttttccctgctaatcattttacaactaaacaaccaagtagctaacgcagagcccacaaaagcggagtaaaaattctaacacttcgtaaaataaaaatgcacatatacccctgtgatctaaaaaaaatgcttaagtattcaaagacagcaattacagctactgagaacatcgttgtgagcaaacagaggcagagaaaacaaaggtgctgatgaggatttgaagcacctaacctgcagaaacccactgggtgatttcctaggttccagggtggcattatctttcagaacgatcttcaagaagaggtcacatgacactgttacaaaggatctggagaaagagacccttgctttatctctccggctctccagtcatgcttcacattttcgcttcttacactctttcacatgaagtccatttacacacctccatcaagcccttagagacctttttgcactatccatgacaagttctggatgtcatctctgcacttttgacaaattcttagcagttaacttacagggcagttaagatttttgttcaagcacaatatagctagaatagggtcatatactcaataaaacaaatatttaccaagcacttattgagtggaagataaaaagcacaaagcataattacaaaatattctcccctgccaccataaaagaatttcttaaaggcttacagaatatagcataacgtgaccaaaacaaaaatagtaaggactgaagaggggaggaagggaaaatatcagcatgaactcaatatgacccagaagagccttgatggtcagacgtgtaaagacgagttgggtagggttaaagggtggaggtcaggggcacaggtcaggggcacattctacaagggaaaaacagctgatacagaagcctgaaaggaaaagcgggcagagcacctgtacaggactcttacctgcggcatctaccatacaatgcgcctttccagaacacagcagtgcgcagccagcccctggggagagggatcactcaaacagcaccagaggctgcattccaacttttcttccatcaacgactccgttttcattgttagtttctccttcaacacaaacttgaaaccaattggctgaacacgcgggagcaaggaaaacctgactgaagaatgaggcgttaaaacttaagggccttgggtcctggcgcggtggctcacacctggaatcccagcactttgggaggcagaggtgggtcatttgaggtcaggagtttgagaccagcctggccaacacggtgaaaccccgtctctactaaaaacacaagttagccaggcgtggtggcgggcgcctgtaatcacagctactcgggaggctgaggcagcagaatcgctttaaccagtggactgtcaagagagataggctgcaatgagccgagatcgcgccactgcactccagcctgggtgacagagtgagactccctcaaaagaaaaaagaatttttttttttttgagagaagtctccctcttatcccccaagtttgagtgcaacggctggatctcagctcactgcaacctccgcctcccgggttcaaacgattctcctgcctctgcctcccaagtagccgcgattaaatctcctgccaacacgcctggataagttttgtatattttagtagagacggagtttcaccatgttggccaggctggtctctaactcctgacctcaggtgatcgcccgcctctgcctcccaaagggattacaggcgtgagccactgcgcccagccaaaataccgaaaatcttaaaggtctttccccttccccgcctgggctcaaaaaacgccggagccgccctgcaccgccctgtcgcggtctccggagcaggctggccgactgagggcgaccatgggtcccaagaaggctccggcagtcgcgggctcccacctcggggcgcggcgacgggggcctagaggggccaacagcccccaagcttacgccacgcgaggagtcggagagacgcgccctcccctctcctcccacccaagcctccggcagtcccgggccggggctgggccagttgcgggagaaaggggcggggaactggggcctctctggggaaggctcccctttgtcctgggactccgggcgccccctctctgccctcgccctgccccgcgaggccgccgccgggcgcctcacagtcatgttgcagtggagcgtgagcgggggctgcggctcctg

SEQ ID NO: 344 - DNA, 137701 bp, Homo sapiens
caatgtccttgcttcttgccactccttccctggttgttacttcattgtattatcagaggagtttgaaccagagtgactccatcttgaataggggctgggtaaaataaggctaacaactactgggctgcattcccaggtggataggtattcttggtcacaggatgagatagaaggtcagcataaggtacacgtcacaaagaccttgttgacaaaagggtatggtaaagaagatggacaaaacccaccaaaaccaaggtggcaacaaaagtgacctctggttgtcctcactgctcattatacactaattacaatggattagcatgctaaaagagacactcaccagcacatgacagtttacagatgccatggcaatgtcaggaagttatcctatatggtctaaaaacgggaggaaccctcatttccacaaattgcccacctcttccccagaaaacttataatccaccccttgtttaacatataatcaagaagtaactataagtataatcagttgagcagcccatgctgctgctctgtctatggagtagccattcttcattcctttactttcttaataaacttgctttcactttagtctatggactcaccctgaattcttgcttgggtgagatccaaaagccctctcttggggtctggatcaggatccctttctggtaatgtcttctggttgaaccacgaagggacaatattgaggaaacctctgacccaaagaaaacagcaataccaattggccgactttgagtaagaggaggggtacatttaacgtgggtaaaggatggaattgggttagaggcccaacttaggagggttagagtccctactaagacagagttaaaggcctccttaataaaaggcaaggacacttgaccaaacttgggttagaggcccaacttaggaaggttagagcccttcctaagattcagggggttacaggttagaggtccctctcagtaaagtccctcttggttaaaaatggatttggaattatgggatgttatctgctattctctttggattaatctgccttgcactgtttgctgatggctgtgggtgacaggattaggcatgtacaggatcaccagatgtgggagcatttttctccctaaagtgggaaagatgagagctgatgggactgttggaagagctcccttcattactgaaaagcaggtgcctgaacttttgattcagcgtcgctgcaatgggtgggtctttctctggcctcccggagctatgtaccctgccacagacaatgcttttctccccttttctcctttctcttttctatcttttctgttactcagagccaactgtctgctgtttcatcttgcccagagaccacatgttgaaactcctggttggaagatcattgtaccccacttttctttttagcatataatcaagaagtaactaagtataatcagttgagcagctgatgccgctgctttgtctttggagtagccattctttactcctttacttttttttttcttttttgagacggagtttttgcttttgtcacccaggctggagtgcagtggcactcttgactcattgcaacctccacctcccaggttcaagcaattctcctgcctcggcctcctgagtagctggaattacaggcacccaccaccacacccagctaatttttgtatttttagtagagacggagtttcactctgttggccaggctggtctcgaactcctgacctcaggtgatctgcccacctcggcctcccaaagtgctgggattacaggcttgagccaccgtgctccatgataacttttcagaaaacttttttctactttttgccacaacttttttacatttttatccgataactttttcaccccaaaacttttttaatcccataccttttttatgttgtgttctttcaataaacacttgcatagttatactacatttttgtaacaatgaaacagattatctcatgccaagcatgcccagtatttgcacaatatcaatacttttaatactatagttttcaagacacgcaaaataaaattttaaggcaaaaacagcactttgcaacaatttaaaaatttattgcattacagtagcatcacatcagcagtcaataatgccactttaagcaaaagtctttcagtatttccgttacacattctgttaacaagaactcatacattggtaaaattcattctaagaaaacttggcaaataacgctttggcctggaattggcatttctttctctacttttccttcccaccatttcttccttttaaactacaggatttatattttaaaatgttttatttcagaacattaagatagcagttacattttttaatatttatattattttaaaatgactctttaagatacagttttaaacccatgggctagaaatcatacgactgttaattagccgcattatttggtctaacattttttatcattctgaaactggatttgtgtaatacattgataaattcatacaatttggaagagtcagttgaagttacaaggacccaatatctgccctctttcagtgaatgccggcaaatctgttattccattggcaaaatcgtattgctgctctcctgttaatctcacatttataaaaggatcatgaggctgccaagtgctaaaaatggagatggtctagtaactagaaaactccccaccccagggagcacacctacatatctccctacaacctaataatgtgatgtgttttggaacacagacattagaacttcatgaagttttaactgttgattctttcccaagcatcatcaagttatgatttaggcaatgtatgattgaaatgcattcattcatcatgcataggcacaatcacagaaatattgcacaaagtatgtccctgactgaaaatgagaggtacaaaaacgtatttcactcttcgtaaagaagtttgtgaggaaatacaactctgcgatcgtatagacatgtttcctgataatacagacattcacaaacagtagattgcaccacagtgtgtaaacattttaagttgcataaacttctccttgattttcaaagataatataatactgtctactaaaattcctttttgtttcaactaagtactctcacatatattagtttataataatgtttgttattactttctaaagtgttttccactcaaggaaaagaagtaaattcctatgtcagagtaaccgaggtggttgaagaataggtattagccagagaggtctagatagtaaaatcaaacttcaagcctcaaagaagctccatgaacagagaggaatgccaggtgtcacacagctttccttcactctaattcattcttgactagagcctgtatgcctgtttcagagacatttaaactcttaaaggatttcttatgatcttcactaaatacattaagaagaatgccaaccagcgccctttcgtgtactgggacaggtagtcatgtgattaaaacagggaacacgaactctgactttaaaatgtattgtagatacaaatgctctaagctaggaaaggtttttcacacccacagccaatgatggcagcctttcattcctcggaaataagccctttttaggtcactgaaaaagagtgcaactgctgcagctcacgatgcaatatcttcatgagcccagagcacatacaaatccaaagggaactgccacagtacactgctcattcttggcaccggaacagatgaaacacactgtatcctgcacatacctgccagagcaggccactttcctcttctgtgagatttagaaagctcccccaaaaggttatcactcccatcaccaatacacagaaaatggaggaaaggctgtttccagttctcggcctttaaacagctctaaatgtcagtactcacagtggcatattacaaagtaataaacagtgcacacttgagggcaaaccgcatattgagctatagaagagctcactgtgattaagatgagatcaaacatcatagcagaacattagcaaattttatctgaattctgtaatggacatccatgctgcaataacattagaaaagcacgggagcctattccaaaccagcgagaacagttttgtgcaaagagtgggtctttgtgtgtttgaactcccaccacgtaagggcaaactcgatatgcatgctaatgacctacaattatgaaatgaaaaaagaaaaatgctgaaggatgccagagtgaacatcagtgagagccacagagacccactctcttttaactttttacaaataaacttaaactataaattagaaacacaaataatcatgagtagctctaacattcaaatgaagtaaatgaattgtgtaggagattaaccccataactttgtttcgtttttaaaaatttcttgagcagctctttgatgatggtggtgtttatctccttcttctcggcagccaagcccagcaaaagcatggcacacagcagttgctgcccaagcctgggtgctcctggtggtcctgcatctcaccaaggagctgcacgactggctgtgcagtagggttgtcctgggaagaaccctccctggcttctccttgtgcaggctccacgctgttggtgaggctcgcctcacaaagatctttggagagagggaggcggggatctgagtggagtgctagccgccccccgctcctgcctgctcaccccgcctgggggctctactcaccaccatgcttgtcggcagccccgagctcctggggggctggggctcctggactgggttcagcagcagggttccgggcagcggccaggaatttgccgtgcccctcgctgtagctgccacaagccgcaacaccatctcctgcagctccagcagcttcacctgaagggacgggtgctcagctgtcaggccgctgctggcgcccaccctcatgcccaccccacccacacccccaccccacccccacccccacagggatgttgcacaccctaccttcctctcctccttgtcctgggccagcctgatgatggcctcctcccggtgacgcatctttggcactgtcccctggctctgttagaaggcgatgtactttcctgcgggaggacagggctcagacgctggggcccctcccatagccctgcagctccccctgccgtgccctggcctcccactcactgatggcatctctctctccggtactggatgaatccaagttccagtttctccacatgctccctcaggtccgccttctcctccaggaggtccataaggccgctctggagccaaaataatggggtcacatctcagcagcgacctgccccagccctgcccttcttggcccatgctaggactcactcccctccagcttctccatgacttcctgcagggcccggagggtctccccactcacagactcgcccccagtccctgaggctgggactgctgcctctggctccttctcggccgaggtgagcgtctccatcacctggcccagcttctcctgcagctcctttacttgctgctccaactgcagtgcgctcttgttctcgtgcttctggacagagagaagcaatcagcagccacccactgcagctggagaccccagaacttggtgtctgcctcccatggcaccgggaagggtggagccaagttagaaaaatactctcctctctcccacagccaccagagcaaagctctggctcacaggtgcctttggaagtaatatttcatgtgagggctacactgccccattttacaggtggggaaacaaaggcctggagggctagggaggagggcaggctccccaggtggggcaacccaccagctcctccaagtcgctctgtggctcggccagctgctgaagcctcttctcccgttcccgaagcctctcctgctgctcctgaagcctctcctcctgctcgcgaagcctctccttttgcccacggttcaggagactgatgcactgattgttttccacctgagcctggagctctcctgccactctctccagctccttcctcaggtcttgcagctccacctcagaggacactgctggggcatccgggggcagtggctcagctgagaaaggaagcagatcataagggcctctggattctcaaaacaaaaatcaaaacagaaaaaacaacaaaacaccctcctgttggcgcacagctcctctcaggctcccaaacttggcttcactgctaacgatccctcgcacccggatggtagccagtcttccaaaccactttcagatagagagcactgcgggtggctgacaacgggccctctttgctcatggggacactgaggctcagggagatgacaagacttgtctcctggcacagacctctttccctctgcctcaaagccctgccatccacccacctccctggggcactctaagccacccccacagccctctgatgccagtcctgctcccaggtcatgccagccccatcttacccatctggtttttgagtctggacaagctcctctccagctcctctacccgatgcgtatcatgcttcttctcctccttcaatgtgcaaacctgcccaaagcacagggggaaagggccctggagagaggggctggtggctggacaggctcccatctccctctctgcccccacctccacaaagcccagacccaggaccacctctggctgcactattcccattttaaagaggcccagaaagatccagtgacctatcttaagttgttggtggggggggggtggggcgggaggctgaagggtcagatctcacctcctgcgacattttcctcatcctctgctgccactgggccctctctccttttatttgttcagcatattgatctctctccagctggacttctttaagcgactccttcaactgcaagaatggccacacaagttaggaagggccgtcactggtcctcacctgctcctggccacctggggtcatcttccttccacatccctccctctgcaaaacctcacctgtgtcacgtgtcctttcagcagtatctgctcccgtatggactgctctaactgccgcttgagaagtgctttactgcggctcgagaactggatggtgaagagtgagaagtttcgatctggggagcctgggccattccacacagtgccccttaaaagggctagggctaggctcaatatacaactcggtcagtaaagatcaaggcatttccaagcccgtggtctggttttgaaaaaaactcagtgaagttggaagggacaaggagagagatcagataatattgctattgttattactcccactgtttgaacctttgtggagtgcttcagcaggtaccttgctagcaatcccatttaatcctcgcaaccaccagaggagacagttactatgatgccctctcttgggtagatgaaaaaacatggagtgtttgaggttaagtgcttgcctaagatcacttaggcagagctaggatttgaacacccaggtctatcagattctctaagcccatttttctgctgggggtgggggcacggttaggaaggggaaaattaatcttttgttcactttttgaaaagatgatacattcacatagtccaaaactcggaaggtatcaaagggaagtatctcccagccaccctgctgctctctcctgagttgtttacgaacacttgcagacatgttttatgtatattatcatactatgtacacacacacacacacacacacacgtttcctctctctacagaaatgggaacatactaaaggtacccttctgtaccttcacagtacaagtacccaataccccacaccccacctaggacttggccaagaccacagccaggtaagggcagggcaggcacttggcctccaagctctgcatccagtgctcgctccccaccgcgccccccgactcacccacagcagctgactcagcctcaggctgcctctaacaaccatacacaaaagcagtgagaaatggccatgctgccttctgggcaggacactccatcctgcagaagggacctttaggctcactcctccatctgtgaagccgggctcccaggggacagggcaggtgactggactcaccccatccggcttcttcttctgtgtggcggcgacagcacagagagaccactctaactctcctatacgctgcgatgaacgttgcaggcggccggccagatccttggactcttctgtaatgacagagttgacatggggctcaaaggactccgccttacagacctgtcaaagtgccaggttgaaggatgacagggtgcccagattcccaccttcaaagtatctgagagaatgtttcatgtgatacaggtccgtatttagtttctttttctctgtgttcaatctctggatttgaccctttgggagaaaagccaagcaagtgctgaaatagaaggaaagaaacattctccggaggacaggaggaaacttcacaccctccactcacctctagctccctttcagctttctgtttctcattgtttgctttcttttcctataggaagaggaagacagagctcttaccagggggaggcagagaaggcacagcaagagatatgcccccagaatgccaccaatgccccaggacaggcccacccatgggaccaggttatcagggaccctgtggggatggggtggaatctgaggggtgagcctccttccccaggctgggagtgggtgagacgagactggggcctctacatctgagtgtcccccaaacccagcagtcatgtcgccagcaaacaaagaaatcacgttacttcttccagctgatgttccacttgtttcttctgttgtttctgtggggagagtcaaattaaagtgatggagggtggccccctcaactctattccccagacaggaagcggcaggcaggggccaggaatggattttaaaggcaaagttctcagacccaatgggaacaggaactgttcccaagctcccaaggacagaggatttgggtctttgttggttttcagccacagcctcacaactcaaagtctgaatcaggaatctcttgagaggacagtaacataaacctctagagatggagtttgagaaaggctcccccttctgccagcttgtgatttagaaaagtgtgttcattcaatagacatttactgagcacgtacgggccagggatggttcttcacagccgatataggatggaaaagaacagacaagagcccttggccctgagctttccattctagggggcctttaaatctcagactctcagagctaacacagacctttgatactcactacctcctctggaaacacgagcccaaaaaggagaggtggcttgtccagaatcaaagagcaaattagggactgagtcatggcagaaatacggggcccctgacaaccagtcaggccagcacttccccaagaggcaacaaccccagggcgtgtgtagcaaggactcgagtaggggtgcctggagaggagagagtcggcaaagagggcagcaaaagaagagccatgctgcatgctctggggtcccgccaggtgaggcctgggcgccccagctccctatctgcccttggcaccaggggcccccagcccccttcttcagggccccaagaggaaaccggagcccaggattggcagcgtggaatcaggggaccccactggactcttaccaaagatttgatggtgtcattcagtcgactgatttttatggacctcgagttcaggactgctgcttgttcttggcacgggctctgacgcgcatgcagagaggaggaggcggaggaggacttgggggagaggtagagagaacgatcattagggctgggttgtgtgtgggctgtctcagctggcagaggggcacccagtccccgctgcgggaggaggttggagggctggcctgcggggtcactgcacctccgcccagagcctcctacctccagatccttcagggtagcagatgatgtagggccctccccgtggatacctgttgctgactataagagatgagactgcacatggagatgttctgtccccctcagtgtctgagccctccgacttcctttcttccccatcaactggcaacattttcttttctgcctatcttggaccctttgtcccataactcctttgtgccaacttctctcacggttcttatctccccaccatcccaccctgggggccttgcagtgactcctgatgggaagtggctgttctcattgtcctggcttccccttgagactggggatgaggaaaatcaaacagcaaagaccatatcctgggtgtcctgggtgttgacagcaggccatgtactagggattaacataaaatcgacaattatcaatctcattgaaacttcacaaatacaagtcaaacaataccacctctatcatacagacgtgaaaacagaggcccaaagagctcaagcaacttgccctaaatcatatccctagcagacggagaggcaggattcaaacccagaattcttttcttttttgaaacggagtctctctctgccttccaggctggagtgcagtggcgtgatcttggctcactgcaagctccgcctcctaggttcacgccattctcctccctcagactccggagcagctgggactgcaggcgcccgccaccacgcccggcttttttttttgtattttttagtatttcaccgtgtttgcctggatggtctcgatctcctgaccttgtgatccacctgcctcggtctcccgaagtgtggggattacaggcgtgagccactgtgcccggccaaatccagaatccttcaccagtacccaacagtccatccacaatcttaacgattgccctctactgctccttgggccccctgtccccaaaagcctgtccaggcaagactcacagcctcagatgagtggcaaccaccagaagcggccgtctcagggctactgccatttgctttcgtgttcctcttcgctgctgctggaacaccagggcggtttctctgccaatattctttgaactgtgggaaagaagagcagtaatactcatgagaactatcagcccctacagccacatcctcctttatagtttttataaaatactcttatataccatctgatttaatgacaccaacaactctataaggtgtcacaatcatttagggactgagagggatcgacatcatggctagaaaaaaagaaaaaagaaaaaagcgatactggaacttggaaactcagtcttcccactctaagctctggggttttgccaggcaccaaacccagaggcagaggtagaaaagtaaacattaagtaggcaggagctgtatgtcatgtggtttagagtcgtacatcttcacacgtctgttattgggaagaagtgcaccagtacctctcaaacttttatatcaatgtgtcctcatggcagaaggcagcctttctgtgaaatctgggaatttatcagaaagaggacaacccaagcctcatttcagagagaagtctggtatactcttagaaacctatgggactgccatccctaagtacattcatgttttttctcttatctcaagatatctcaagagaatcaaaggaaactgatgcttcagaaagatgtcccacatttatcctgtggtactcaaagcaccccagcttgagataatatgaggaagattcaaactgtcaagttcagtctcccaagatctattccacagaagatgaggaaatctcacttcagagaccactgactgaaggtcccagactgaagtctggtcccagaaccatggagaattagaatatgaggtggagaactcggaaaaaaatgttaaaatctctttggaaagtagaagcttgggagaaaaaccaaaccaaacccattctcccatcgccacccagagacactgtcaacgttttgagctcacgggggaagtgtaggcttttcccactgtcaatgtctatggtaagggagtaaggcagcctgaaacctcttgctcccaggtcccatagtctccatttcccttccagctggaaatttctgctgtgaccagaagaaccagaaacggggtgacaacgtttaggggactgggtcataagaccagggccagtcttccagtaatgacagttagtaggcagactgtgacatcactacattccactcctcctagtgcgggggagggaccacatcagcgcgatgtccgagtctccactccacaacgcgggagggaaacacagggttgtgacccaggtccttggagacgccagcacaaagagctcagggaggtcgaccttgaggcagcaggaggggagggcagagtctgcagcagggagccccaggagtcaccagcccaaagtcacccagggacaactggcgagggcggggcctggggctggggggcccaggtccttggatatgcgagcccaaagagcccagggaggtccaacttggggcggcaagaggtgagggcccagtaatggagtggggcgccccaggagtcacccgcccaacgtcaccccggggtgatcggcgagggcagggactgagctgtttgctgaaggggcagggctgactgacaagacttttgtagggggagcccagaagcgccggggttggggggcaaagtccggtgtgcgtcaggagtagtatggactgtggcagcggtcttgtcgtcggaggggatctgtggctgggttagcgggccatgacccggtacgtctttacctttttcttggctgcagctaatttactctgtccagtttcttctgccattgtggggtggggagggaggcggggctggggccacgtcagccaaatcccagcgagcgctgatcaacacatccagtcacctggaagacagctgcgtaactgacccagaggcagcgtaaccagggccacagtagaatgcagaataggggcgtggccttaatgcttcaagcccattggccaacgagaaagatgacagggaaagggggcgtggccaggcggcagtgtgtccagagggacctgtggctcatcaggaaagctgcccatgcaaccgctgtccccacccactctgagagaggggaggggccgcccgctctgggagagtggaggggctggcttttgctttaaaacccttaaaactttaaaaatcatatgtgtgtatactttatatatatgtgtgtgtctctctgtgtgtatccatgtgttcctccagagctgtcttcattaaccagcttctatgcaaggtctgtcattttggcctatatttttcatcttcaaatactgtataaaaattaccagtattacctgaactgagatacagatcctataaaagtgggaaatccacagcatgcttgatgattaatgaagcagactatattatccaacattccaatgagataaaataatcaaaatgatttcttttttggaaaaatgtttctcttattctcctacattgttgctgttttttctttttaaacaggaaacatggttaatatccgtaaaaacacaaagcttttgggctgggtgcggtggctcacacctgtaatcccagcactttggggagcccgagtctggtggatcacctgaggtcaggtagtggaagtgtgagccatcacacccggccggcttcatttcagaactctttccccagcactccatatactatgaataattcctttcttcttctttggatagcattttagtcatatctctattaccccacttgtcacatgataatcagtggctcacccatccatctcccttgattgctcatgagctccttgagaagagtctgattttcagcaccttgaacagtgtgccacacatacatgcttcatacgcagagaaggaaatgatttcactacagtgtaattattcccagaattcaatatctgtatttctaaattgttctagatactctgccaacaacctgagaatgttatgttttttccccaaaacttccatccattattgtgtgtctatggtcatagttaactcaattgtgacgtcacctttggacaagcccattaacagtttctttttttttaggtgatttttaattttaatttttgattttgattgtttcttttctgttttttaaatctagcagtgtttggtaaacttcaacatctctatatccccgtgtctctgccccgctggtctctgcttggaataatgtctcaaggttttagtcacctggaaaaaatttctactcacccttaaagaatcagaaataaataggctgggcatggtggctcatgactgtaatcccagcactttcgggaggccaaagtgggcggatcacctgaggtcagtagttccaagactagcctgcccaacatggtgaaaccccgtctctactaaaaatacaaaaaatagctgagcatggtggcagaggcctgtaatctcagctactcgggtggctgaggcaggataattgcttgaacctgggaggcagaggttgcagtgagctgagatcgtgccattgcactccatcttgggtgacagagtgagacatcatctgaaaaagaaaaagaaaaagaaaaagaaaagcttaaataataccttctctgagaagcctttatatcttcctattctttcaggaagtgttgaaaattcctcaacttttgaaacatttgtgcctctattactgtgtatcaggcagtgaactgagtgcccaggatagaaagatgaaactgtagatcctgcccttacggagctcatggtctagtatggaaaacagccatatgaacaaataaccacactataggtcttcagagctcaagtcctatcctaaatactgtgaaattaatgttctgtgaggttttgaaagtactagggccagagacaatatggctgcttggatgactttccatccaagttaacattcggccctcatcacaaagggaatacatgcgtgcatcttccttgcaacccaccagtgcctaacacatcatatcaccacttttgaaatcaggaaacaggctcagaagtccaagagcttgaccaaagtaactcagctggtaggtagcagagccaggtcagtatgattcttcttcaatatcctgccagccacatgggcaagtggcctcaaaatcaacaaaagacaggtagaggttgacatgcatcaatggagagaggctcaaaaggaggattttatacacaagaatagaacagaaatgttctggaagtatatctgtggatgtgaagcaggagggggcacaccaggtttcaccttggtcaagtgaatctataattccaaccggggcctcgccgccccccacccccccgagctccagacttagctatctgtctttcttactctaatataaaatccacagggcaggaccttaatctctagcttgttcacacagattaaagcagagtctggcttataataaggacttaataaatacatgaatgaataaataaactatcaaagaagctaaagaaacattccacattcttgcgggaagggattaccatgaaacagaccctagcagtcacttacaaatacagttgaccctcatcattggagtatcccatattttcaaattagcttacttgctaaaatgtctttctaagtcccaaattaatacttgtggcactttcaaggtggctcctggatagacatgcagtagtgaaaactctgtcactctttgcacacgtcccaagctaaggtcaaacagtgaccttggtctgcttgtttcaactctcatacaaagatgacctgaggacagagacagtagaggacactgcagggtagcgcaagaagctgtggctctggggccagttgggcggggtctgaatcataacactggcacctgttagtggagtggcctcagacaaatcacttacaattctgtacttcctttattcttttggaaagaaagaaaattcaatctaccaggatgagttgtttttaggaattaagatgataacctatatgacatatgtatttatgtacatatttaccctggaaacaagggtttgctatttgattaattcagtgttccaggcaactttgtagaatattactcctgcaaatagtaagaattggctgtaattaaagaaataacagagatgtagacaaaacaattatttgggtgagctacaggcagtcttcaagaagcttctgaagaaacagaacttcagcaggcacttaagctgtagaaaaggcttgcaaggagatagaacagcacctacagagagaggtccaggtggggtcaggaaatggcatttcaggaagtctagagcagtagaagatgaggccagaacacggcgccacagtgctgctctgcaccctctatacaccctgtactgcagaacctcactctctgcatttagttcttggtttctaattctctcttccattaaactgtgagcccctcaaggtcaaggtctctaagaagaaaccatagctacagtcctctaaatttgaaaacaagttattaaacacagatacacccaagaagaccgtacaaaaataatgttggatttcaattgcagtcatagaaattcacaactggtatacatttgcaatctgtccaggatttttctctgatgactgccgtaactctgtcataaacccttttcattatttgagacaccgagacatttgttagaatgtttgggaaagacattctaaaagggcaagaaagaccttgatcttttttgtgtaactgattgactggttgactgactgagatgggatctcattatgtagcccaggctggtctgaaactcctaggttcaagcgatactcctgcctcagcctctctagtggctgagattacaggcgcacgccaccatgctgggctctagtgtgatgtatttacgaggcttaaacatatggttcattacacaaggctggcacctcagagtaaagattttttaaagttcactctaatagacttatttctctatatgcaagatacaattttaccacagtaaaacacaaggaagcatactgatatacatatatgttacaacaggataaaaaaaagcaatataattttctccacaaaagcttgcaaaatcctggccaaaacacagtaaagaggatgttaatctcacagctcacgtttctccactgagacccaggaaaaacaatgccagtttttgtacagtcacaaaactaagcactgtgagaatttacaagatttggttaacttgtatattctccccaccctgacagacaagtcccaaaggagcctagcagttttaccccaacatttcaatctcctccaacctccaaaataaaaccctcactgtccaatatctcaatttatattttcaaacgtctaaaatcttaatcgaaacaaagagcagtgcattagctttgccgccatagaatgcttggtataattttacttaggcacatcacagattgtgctattgcctaaaaacatatgggtagaaccaacattcctagaaaccaaacgcatatattacgaaggtgaaagggaatagggagtgttgtttttaaacagatagaacgctgtgattgtccactcataggttaggtgtgatcaaatcacatcgtgctgtacagctaagtatgtcctatattgtatgacaaagtagggtaacacattatttattgaggacctgttgggtacacagaggcacaccacaagctgtaaaagacttcattcttgccctcaagaaacttccaagtttctagacagcctgatagaaggtagtcgaaagcaaatacttcaagcactagccatcacaattaccttaggtatttacgctacccttctacgagtctctgaatatttcgaggccccctttcctatttcccatgggctctatggctcaacattctttacagccacaggctttcctggactttacgttattattgaatcaacattgctcactatccgcctcctttgccaattaaaattccactttacatccaaccaccactttggctttgaagccactgcctgatactgacgctctgtcgatgtacaatgactattcttacacgtctctgtctactgaggaggatcctactcttttaacagaaacagtgccattgacttccaatcaactagtttccataatatccaaaatattagataatattccattatactcccaaaacaaataatgagtgatgttctctcaaatacacgtataatcaaatgtgacattgagaagatggggcgacctttgactcagagattgtattcaggcctttgtagatgcatttatttgacataattatgcatttaaaacataagttaaattgtcatcagcctgaaattataggggcttttgttggtgagaaacctattttatatataatcgtttacccatagaaatgtttttgattaatgttatctgttaaagacttcagttcacaatatttcccctgttaatagtatatatgtttttggagttgatctggagaatttgaggaccacgttctaatcgctatctgatgctattctgggaggacaattcattgcctttgggttgctgggggttggaacttgaaggcgggtctgagtctggagaccttgccactgacttttggaaagtctgttgattctacctttggaagtgcctttacatgccttatggaaggccgggcatggtggctcacgcctgtaatcccagcacctcgggattattgatgaataaatcaatttgggaaatgcttggtaaattcaacgggacctctcagaacaatgaatttatatggccacgatgttgttttctggtttgtttgtttttttgtttttgttttttttgcaaagagcattcggaagactttctagtacaccagtttgggaactgttggtggaggagtcagggtaattaggctttggactattccaggtacaggttgtcactgtattcaaggaattgttcttagtctttgtatatatccgaattaactatagcaaattaacaagcagaaatataagaattgggccttggagggagggagagggcgagagagaggggtagatagaagtttcctattttaactatggttcaattctaagcattctaaaatttcattggattcttttaactatgaattacaagggtgtttaatttccaagttcatgaagcctttggttaatctcttcattattaacttctaaccttaactgcttcatatttaaattatcaattttatggtgtggattgtaccaattgtttttcaatcttctgacgtgcttaatggattaatacataattaatgtttctcccacagtccacatatgcttgagaagaatacagaatatctgattattgggtacagaggtctatatttgtccattacatcacgtccattcacgggttattcaaatctatatatgggcattctgtgtaacttacttatggtaagcagggtatgttgaaatctccaaatacaatggcagactcgtcaatttctccctgtggttttatcagtttttcctctgtattttgagtctattttgataggtacataaaatatgaaaattgctacaacctcctaattaacagtcagttggcatcaagctgttactaatgctttgtgttccaacatcctatcttgtttgaaactgaagctccatcagttgttttggttaatgtataccggcatatctttctctctctctctcctttataaaaactttcaatcttttcacatcctcatagtttcaataagatggattagaacagctggatatcgttttattagttccatctgtctaactggtaactttagtccatttacagttgttgtgactcatttatgtggacttccttctgtcacctttagaacttccatttctctcactttccaatataattttaatatctcctcctgggattccactaagacgtattttagacctcattctgatctccctctccccgccaaccccaccaacttctgccctgtcatttatcctcatatctctctgtgtaacatatggacttactttttggagataatggtctaaccaattaatcctttcttctggtgtctaatccatccactcggtttcttatttcaacaattccattttatatttccttatttcattttattctgagacagagtctcactctgtcacccaggctggactgtagtggcacgaacctgcagccctggcctcctgggctcaagtgatcctcccacctcagcctcctgattagctgggagtataggcaggtaggtgccccatacacagcttttttcttcttcttttttttttggtggtggtggggtattttttggagaaacgagttctcaccatgctgcccaggcttgtctccaactcctgggcttatgccatcctcccgcctcagcctctcaaaaagtgctgagattacaggtgtgagacaccatacccagctatatattttatttctgtaagttctatttcatccattttcctttcaggtcttcctcatcattcctggtggtcttactgctcctgctcgctcaattttatgagtccatctttttcttatataatacatttatttcacatgtaactattttctcacaattctaatatttgaagtctgtattctgtatctgataattccaaaacctacagtctttgggaaacattcattgtttctgataattctcaaatatattgggttcactacttgaatgctatgatttcactgaattcatagttgcctgcttttaatctttgggaatcctacaggcttaagttagagatggtttcctagaaaaagtatctgtgcgtgcttctgatgagagctgtggggacaactaacaagagacccctttaccaccgtccgtaatcctgatattctcttggattctcctggagaatgtcaggattacacaaggttctcaaatttggctccccaaccttgctcatttatatacagaagactagactgcttagtataggtgatgactcacttcctcctaccctggaaaaaacaaaacagatctctcatctgaatgtgatcacagactaggaaattctgaaggtgaataactggaggctgtaggcagcagggaaagacaggtgtctttcctgaccatagaaataggtcacaagctgccctaaaggctgtgtgctccaccaggatttcactatttagctcaaccagcagtccctctgtaagagtgaacggaagcttcttagagcaccacgctgcctttaaaccacaaattcttgctaaaagtcatggtcatggtaaaaaacctatggctttgcaaggctttcttggtaatgtcctagaattaaggttaagcctgcgtttcatggtaactgaacaggaaaccagcctgaccaacatccttctccccaatggcttgctctcagctcctcttgcttgggccttgggcagccagacggtctggttttaatccttgctctgccacctgtgaccttggacaagttacctaccttcagttacctcatccacaagatgcagatattagtaataccctctttttaagttattaagaggattgaaagagttaataaaaagtaaaaaaaagacttggtaggcataggcacagaggcgggaaaaaagcaataataaagaaatgatacttctatattttctatagatcatctttgtaacaagaagaaaacaaaccaaatgaaaatgaaacaaattctctcaaaaagaattaagtcaagacaggcagaaggctcacaaagtaatataaaatatatcttatggtttatggaaaattcttaataaaataccttctttgctccaagctgcactctggctttgcctttgagtcacgtggcatttctttgtacgatgaccggttctgtcgagtaggcactgcttcagccctacaggaaggaaaaaacatctctagaaaacagcagcattcctgattcccacttgaggaggcctaacaaaacggcatatgcctcaacagcagcacatcagtgttaaaaagtctggagtcaaggggaaaaagtaaaattggaccatttccagaatctcaccaaaaacaacaaacggatgttgcaagtggcctacatgagcaaattagaaccttaaataaaggtcactcttaatgcctatcccagcatagatgcagcaccaagtacagtgtcattttactgggttacctttttcattcttgaaagtaggagctatgaaaaaaaaaacactaaaatttcttgaagagaaccttctacttacaacctaacttacgtaatcgaaacactctattgagggtgaaaattgagtattataagaaaataatcacctgttttgtgagaagttcaatacgtaatgctcctccacacaatacataccttagaaagaaaaaaggaaacatacaaaactatctcgagaattattcctgcttaaacaatttctacatgccattactaagaaagtatgcacacagtaaacatgagaagagaacatgcaagcatgaacatacttgttagggatacaggactatgggtaacttaaaaactctgttggtattactctcatgtaattgctctgaaattctagtcaactatttgcaatggctcttagaacagaatactttgaatttttatgatatcaaaaactaagaacttagccaagtattcccaagaataggaatagtaagcatacttagtaagtattccaaagaataggggcagaagaacgcatttctttaaagcactacctcagaattcaatttagtaattccgatgctgcctgtaacatcagaaaacaacttccttaaaaacatagcaagttggatttaccaagttgctgaccaggtcgcattccctcctgccctcaatcccatctttgtgttatactttatctccagtaccattttgcttagtattcatggtgctcaagttgtcactgtggacatcagagcctataaatatatattgttctggctccttcctgtacatctttccaagtcatacctgctattctccaaagtctgtgaatcccgacactaataacttggaaattcagtttaaggtcctcttcagaaggtcagttagctcaaggcatcacatttttctcaggactcttaagaaatactccaaccacagaaaaaggcccttctttctggtatcaggagccattggccacaaacacaaatccaatagagtttcagccatttacctcccacatcgtcccttccctgaagttctagctaaagcaggaaaaaataatgaaaacaccacctgcagtcacgaatcctccagtttcctggccaagatttcgtatttccttcaagatacctcccaaagaggacatgacgagggaggggcacacagggtgctacaggtactgataaggttttatttcttttatatatatgtattttttgagacggagtttctctcgtcaccaaggctggagtgcaatggcacaatctcggcccactgcaacccctgcctcctgggttcaagtgattctcccagctcagcctcccacgaagcgggggttacattacaggcgcccgccaccatgcctggctaatatttttgtatttttagtagagaaggggtttcaccatgttggccagcctgctcttcaactcctgaccgcaggtgatctgcctgccttggcctcccaaagtgctaggattataggcatgagccaccacgcccagccaaaggttctatttcttaagtttggtgttgggcatatggatgtatgatttaatgttttaaaaaaggaagataccttcctagtttttttgtgttttgttttttttgttttaggcctgcgtgctttattcgttaccccgtatgaatccataaagaagtagccattagcaaattcaggcaatacataccggattcatacttcaggaagacaacccagttgacaacgacaacagtttctatgataacaaaagtgagagaaaatactgacattagggtcatatcaagaaagttcaatcataagatatatccacaagcaaaaatatacacacaaaaagctaagtacgaagcttttagaaaactactaccatccttagagtaagtacaagaaagtattcttttatgtctgtttttttcatcaaaataccgcatatagccatagattttaaaccattacatcttatctagattccattaacatttcttctagatcactaacatttcttctagattccatcgttattcctttgtaacctttattttcagtatcttaaaaatactttattaaatataacacatacattcagaaagttacataaaatatacctgaaggtataccttaacaagttattgtaaattatttgcccatgtaaccaccaacctggtcctgaaatatattccagccagtatccaagaagcccacagatgtccctttcaggtcacacatccctacctcccacctggatggactccttcccctaacctctatgtgatcacctctttgttcttaatagttttactgcccaagtatgaatccagaaataagtgtttctctgttttcttttcacttttgtccccctaagaagcctttttagaagttttcttcctaattctatccccactccccatggaattttaacaccacagatatactgtatgtcggtttatgttatacggccctttggagggcagcagaccattataataggtaagattttctttcactctaaggaccaattttcactccactgcaggcgatattgcctccactaagaatgtatgccctaaccaacattagttttccctattgttgaactctatatagaggaaattgtacaaaataggttttggggctctggtctctttcgcttaacatagtgttcaaggttcgtccatctttcccacatagctgtaagccattttatgaataccacaattcttcattttcttggaatgaacacctgggttactttctgtttggggttatgatacatgatgctactctgaacattccggtgtctcctggtgcctatgtactcatttcttgtggagtatatatccacaagattcctgaaccatagtgtatgagtatcttccactttaccaaattgttttccaaaacacttgtacaaatatacactcccattagaaaaacagagtcccgtaacaattttattaccttaaaagataagttaagcaaagtatctcctatgccttctttttcttttaagatctgaagatcactgtgcaaaggactagcagggtcaacccgaagaatcacaaaacaaaaaacagttcaaacaaaaagatatttttttttcaactaactcaaaaatgaaccaatctgaaagctaaaatagagcacctagggtaagttcaagaaagagaagatcttaagctgctctatatcctcaggaaaaacagaggtcactatagcttccagctcctttagaatgaatgtccaaaagagatcataatagcctaaatctaatctaataagggggttcagagtttgcagtcattctaaaggaaaacagtcacatgtatataattttctcaagaattcaaaagaagtttaatatgctttcctaaacttgtattattagtcaagcagttcaaggagaacaatttgccatggacggaactatgaaaagttaaatcactaaaaaatcggtatttttccacaactgtcctatatatagatttctaatatgactcccatcccccactcccttttcgtttgtttgtttgtttgtttgttttaagagacaaggtgtctcgctctctcacccagggtggaatataatggtgcaatcacagctcatgtgcagccttaacgtctccaagctcaaaagatcttcctgcctcagcctcccaccatccatagtagcttgtactacaggtgtactacaccgacgtattttaaaagtaataacataactacatctacaataagagttaattatattgctttcaaaactgggggaaaagtcataaaaatcaacttggcaatcattctctgtataatgaaatatattactcttgtttactttccaaccaatattattcaagcttgagctttttcctagaagataaaaatcaagcaagagttcactctatcaagaaaatgacaaaaaaatttcgatggacctataaaaacatttccaacactcaacatttcaagaagtaaaaaaaaaaaaaaaaaagtccaattaaatgaagcattatgaagtttcaagagaatataaaactagacacaagtctggttcgtttcctatttcttatcatctgaaaaactctagccaacatgttcagaccaccatggactccatgatagcacagaatttagtatgagtctattccaaaccccagcaatttttgaaaatgctagaagacactcaaggtgacacattactgactaagagagacttccattcataagactacaagcaagaatattacacagatggtctagttcacacattgacacactgagaaacacgtgtacctacatgcaactggtttcagtttttcagtgtggggacttctctaaagatgaaaacacatcgatatcttatcctaagactaagtagaaatggaactactttttagtcatgtgaaactaaaggttttaaagactgcactatactttgaaaaagaaaaaaaatcaagtttacgaagatctcacttcctagatatgtaaccatgacctcatttcctatctataaaatatgagaagtttctcctatctctaaactatgaagagcacctatttcacacagcggctatgaagactaaatgagagcatctataaagtataaagtacttaacatagtatcggtcatgcaaaagtgttcaataatttatacttgttttgaagataactcaaactggaatcgatcacaagacacggaaagtacagtaacattatttcaaatgctacaaactcagttttttaaataagatatgagaaatggactaaatttctttcctctgggaaaaattactaattaaattaatatataactaagactgaaggagggagagtaatctatctggtttcaacacttggcatctacttgcctaacaattcattccctgttttggagaacctgtgcccaagacaaagtaactggtcctcggctttcatggagttggtaaatagctctaatacaaggcaggaagtagtaagtgttcagacaatcatctgacgtttccctactctgtctgagcatttcatgtatacacacacatcattctcattgatttttcacagcagtcatccaaaaggtatgtactatctatccatactttagagttgagcaaagtgaaaccaaaaaaggtgtgtttgtcaccacactcagtgttcctttcacatcctgccacttcacataaaagagatgttaagtcaaaagagaagaattagttttgatttggtcagagcaggatggaccaaagtcaccttcacgaaggagaaataatttgagttgtgttttgtaggagagaatgaatgtgaatatacagatgccacagaaggaaagtaagcagagaaaacagcataaacaggctggaaaggggcatatacagggatcagcaggtggttccaggatgtgaacagcagatgaacagggtaaaaagtggctgttcatagatgagaaagataaccttgggcaagagaacatatgaccgtggctagggacggtggctcatgcctgtaatcccagcactttggcaggctgaggtaggaggatcgcgtgaactcaggtgttcaagaccagcatgatcaacatagtgagaccccatctctactaaaaatctaaaaaatcagcctggtgtggtggctcatgcccatagtccaagacacttgggagggtgaggcaggaggatcactggagcccgggagatcaaggcttcagtgaactatgattgtgccaccgcactctagcccaggcgacagagcaagaccctgtctcaaaaccaataaacatgtgactgaatctaccactaaggcaggaatggaggagagcagctgagattggcatgttcatgaattgcctgggattaactataattacttaaacaaaaatccaggctctagctatttatacacacttacgcagttaaatgctcttgtctttcagtcttcctaatttctctaatattgccaaattttctttttcaattccttcatcctccaactttttcccactaatgggctctgctttcatctcgtagtgatctaagtcttctatatcctgcaaaaagaagaaaaatgttagcttattcaacctatttttcttcagcagtttcttatgccaaaagttaaattattcttgactcaatgggggacaagaaacagaatatatctatcctacggggagagaggaaaagcccccacattccattcaagaggctcccaccttctatatcctacattttatttaaaagctacactctgggtaaagcagatttcaaagctttacaaagtcataactattaagaaataagccatcatttatttatttacttctttaatttttatttccttttttaaaacagagtctcactctgtcacccaggtgggcgtatacaggggtgatctctgctcactacaaactctgcctcccaggttcaagtgattctcgtgcctcagtctcctgagtagctgggatttcagacacccatcaccacgcccagctaatttgtgtatatttttagtagagacagggttgcaccatgttagtaccagcctatctggggctttataaagttaagaaaagagcctgtatgcatgctgaaggctgtgtgaccacagggcttttaaaggatgcttctgtgttcccacagttaggtgggagctcttggaaggatctcttttatcccagtgctcttgctaagaatggaaagcccctctgcataactgcagtagctggtgccatcctctgttcacttgcatcagagcctgggaggttgtggtctgcaaagctcacctctcataatgggacgccaatcaatagtatccgaagttgatatacccagaaagagagttcaaaaattatttagagaggtggaaaataatcaccagtagaattaaaatcagaaacgacaaagttggccagcggagtggggaagtccagattggggaatgtgatgtttcattataaggtctttcagcatttgcttgctttggtctgagtgaaagaattgtctcatttttttgagggccatgtacagcaaaggactcaccatctgtcagacacactggtcagttctggcaaggcagagttggaggttcctgtcctcaggtgggtgggcagggacggcagcttgccgtaaggtatccaacagcaccagcggcaggaaatgaaaagtgctcagtgattggtgggatagtggtgtctagcacaatgattcctgccaaaatcttaatggtggttgggcatagtggctcaagcttgtaatcccagcactttgggaggccgaggtgggtgggtcacttgaggtcaggagttcaagactagcctggccaacatggtgacactctgtctctactaaaaaaatacaaaaattagccgggcgtggtggcacgcacctgtaatcccagctactcgggaggctgaggcaggagaattgcttgaacctgggaggcagaggttgcagtgagcaaagattgtgccactgcactccaggctggccaacagagtaaaactccatctcaaaaaaaataaacaaataaagccacaaaaacaaacaaacaaaaaaacccaatggtgtgcaataaatgaaaatgctgccccagtcagacgggactagcatttttcagcaactttcaaggtcttgtgtcacaagaatgaagatccgagtatttcccacctgtggagggggctggtgaaggagttttcagtcccgggcaccctgggctgtgctgaaagcctctgcgtcacactgcgtgagttagctgggaaagagagctcccactgttctcttttaacccttgtccttttgtaccacagcaattgctttcctggagatcagaaccgtggctgggtttaacatcatctttggaaatcctaaaaggcaatgaagcaatttttctcttttcatttatatatttttttgatacagctgtgtcagtttgaaattttactttcgtatcagttctaatagtgtgtctgcttgacatagtttctattaaatgggcttgatatgaagttacttaaaaattcaagtatttagagtttcagggcccatcgtcttgatttttggggcaatacctcaatttcatactgtgttattcttttccagagagatgggtcactgaataacttacattttatgattgttttatgagaaactatttctggttacaaatggtaaacatctaggttttgcagtaagaaataatggattatgttagaaaaaaagaaccataagaagatgtgtttttaattttgacttcctgtaagtaccttctggagcagaaggttttctctttgtggattctgcatcttggatttggggactctgttgcactgagctgtgctctgtggggaggagcctgtggcagaacagtttgggttctgctggccgcctttccctctattcacggagtctgggtcccagagaaagatgacagcagttaggtcttgttgggaaaaaaacgcggctaccaaccctggaccattttgcttcccctgaacaaataagatagtcatttgcctacttttggggacggtgcctgtgctttgcacaggacgaggtggcagctggcttgcctgctggcctgcttcctggagataggatgctcagacccaccgctgctcttcaggggtcgtggaaggaattaatgcacttccttctgtcccccaatctctgtccctttacgtgtctctggagctgagcaggtattctttttctttcttcatctcagtagagctgttaaattaaatagatgttgcttaagccattcagaaaggtttcacattttaaaaaacaaaaggtagctgctgccatgattcctttgcccaccgctacaccgtgtcgttgtaggacagtccccacttggctgtgctgagcctgtctggaagtgtttctgattctaatcagaagtggaacagtttcagtgcagactataggttcatgttagtgatgaacttgggtggagatggggacacagcttgttctttcctcctggactctcatccagggtcctgagctgccaggggcctggccactctcaccctgagccctgccctggctgagctgatcaccgctgcatgtcccagctgccggtctgcctgtcacctgcagtgcacatgtgtgcatgtgtgtgcatacgtacatgcaccacacacataccatgcccacctcatacacaccacacacataccccatacacaccacacaccaaccacacacattacacacactgcatacatatcacacaccacaaacactacaccacgcacacaaaacatacatacacgctcaagccttccacactacattacactccacacacaccacacatcacactccacacacaccacacgcacatatcacattcacatcacaccacaccacataccacacaccatacacagtacactccacacaccacaccctccaggacgtcccaccaccatacacacacaaacaccacacacccacaccatactacacatttaccacatacacaccacacacactgtatctcatgaacacaccacacacccccgccacacacatttgcatgcaaactactcattgaatgaaaccgaatgatttagttttccccaaattaatactgcctgcctgtgcacccctggctgtcctggccggcacatcccccggtcctgccctcccttgggtcagcaccgcctcctgtgtctcaggtgtctctggctgtgccctgtggcgtgctcatgtcctgatcttgtgggaggctggctcctctgctccagtggctgccttcctagaggagaccagcttgtttgtcacctctcctgatgcccagagcagcagcccacgggggaagtcctgcttcctcccttcgctgtctgcccttccccacaggttgttttgtctcagtgctgatatctccccagctagaagaggagaccctcaaaggtgcacaggtggatttgattataatgcaggtgaatattaaatgcgttttggtgaaacactcaaccactacatacatctttaataaagtaaaatgtccaggccccctctgctcccacctctctctcccctcccacctctctcccccctcccacctctctcccccctcccctccccagaggacgtggctgacaagcctttgaggggtttcccctttctgtgtgcctttgcgtgtatgtatgggctgggcggtgtgtgtattctctagacatcttgacggacctgtaactgggatctacacacgtgcgcttgctgtagctcacttgccattttccctcaaaaataggcctgtaaaatccctcactgtagtacgtgttgccctgcctctttaaaaatgccaccaactcttccagcacgtgaactctgccgtcatttttttaaacattctcttatttatgggtacttaggttgtttccagttttttaagagattgcggcaatgaaaatcttcagctatcatttttcacagtgctgtgggagaacgtggttggaggtgctgtggcggtggagtggccccacacgtggccaggctttgtggggttctgactctgtccttgccaatgttcctccacacagtggctgcctctggggaatgatggctgtgtgagcgcccgccatgccccaccagaagagtctaccatggcccaccggaagcgtctaccatggcccaccagaagcgtcagagcgcggggagcagcatgttggaccacagggcaaggccgggtcctgtcccccaccaccaggagcccgagagcgaggacgtggagctgcccttggaggactatgtgcccgagggcctggagctggtcaccctgcggccagagagccccacgcccaagaagcaggagtgccacaaccacagccccgatggggactccagttccgactacgtgaacgacacctctgaggaggacgactatgatgagggcctccctgaggaggaggagggcatcccctactacatccgctactgccctgaggaccaaagctacctggagggcatggactgcaatgggcaggtgtacctggcccacggcgcgcatcctatggacactgacgggtgccaggatgcagtggactggacggcctgggcgggcctgcacccccatggtcacggggctaaaggtagccaggactaccctgatggccaactgcccatcacggaggatgtgtcctccgtcctggaggcccacgaccaggaagaagacggtcactactgtcccagcaaagagggctaccaggactactaccctgtggaggctaacgggaacaccagcgcttctgcctaccccctgaggtgcggggacggggacctggaggaccaggaggaggacatcgaccagatcgtggcagagatcaagataagcttgagtatgaccagcatcaccagcaccagtgaggccatccccgagcatggacctgagccagggcctgcggactctgcagagggctgcccacccatcaaggccagctgcagccccagcaggcaagaggcgaggcccaagtcgctgaacctccttcccgaggccaagcaccccggagacccccagagaggcttcaagtccaagaccagaccccagaagagaggctgaagtggcctcacgagcaggtaggactctagctgtcccggggaagggagcagaggggccctagagcaagggacctcagggtacaggcctcgcagatgctgaagcgaggcggtggggggtgctgggtgccttacagttctaatggtggctgagctcttcattggtccagttgggagacatgttgcgtggatgctccggccactcttaagctcaccgctcagactcaggactaaagccggttgagggctgaggggcaactcgtgtctcgcagaagacacccctcctcccaccctagaagacaggttcaatttcttgcccactgccctgggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtgtctgaaagctggggggccttggcctgacgggcaatcagctgtgaatacctatttggaaaaggattttttgacggtgtgacaaaacctcggggaagaaacgcatgctaatgagggcagtggatgtcagcataactgtattttaattatagcaaagtcagcgtgcattctaataaacacatttgaaaagccgccttccaaaaaaaagcctcactgtgagtatatattatagaagatgtgattattggactcgggtgaaggaacttctatttggccaattatgtggactgctttcatattttttaaagctttaactactatttttttctgagaagaattcatgaatgtgtgtgtgtgtgtgtgtgtgtgtgtgtgtgtgtctgtgtactgagagcttgggtttggaatggaaatcatattgactcctggattttcagcacttgtatcttaatgtcttgtcttctctctagaacacattgtgtcagttgacttcactttggggctgttcctgtcattcacagcaattctgtgtttacagggggctgtgggatgcataggaagtcctatggtgatggcaggcatgggaattttaccccaagggactatggtaatagggggctgaccaagaataactcctaatcctatgtcacataataccatgagcagctcaggaaaactacgcacaactcagacatgtgcagaaaggagatgtggaatgaaatggagccccctggccttatagaggcctccaagacctgccacacccacgtctgcccccaactccccagtcaaccttcagagaagagaaggtgatctctctccagctgagaccaagccaaggcccaaactgttgtagctgaaggatgtttgggctaggctcatagaagctgttccactcctgcagtgtcaacagctgcctgtggtccaggcttctgtctggtcctgggtttttttttttttttttttgagatggagtcttgctgtgttgcccaggctggagtgcaatggcgtgatctcagctcactgcaatctctgcctcccgggctcaagcagttcttctgtctcaacctcccgagtagctgggattacaggcacccgcaatcatgctcggctaattttcatatttttgtagagacagggtctcaccatgttggccaggctggtctagaactcctgacctcaggtgatccacccacctcagcctcccaaaatgctggggttacaggtgttagccaccgcactcagccttgaagagacactgggccttttaagagacactgggtgctgactcacttctgggtctgccccatgggtggcccaccgggtctgctctgggtgcagccaggctgtgcacgtcagggagcctgagctggacttaaggtggggagacatcgctccccaagagctgctcgggtgcgacatcagggtggaggctgttgctgtgtgtggcggcatcactcatttaccctcgtctcatcagcctctgtccttcggctcatctgcttgcaggtggcctctgattctgcctctggagcctgtctgccccctcttgattcattcattgggtcccaaatatgtgaacaatagcatgctagccacttttagaaatatttgtgttcatcttcaagagaggggggtcatccagccattccccagccctcaaaacccactccacagacaaagcagtggcgggtcagggctcctcttgctcttctgagccgctggcatagcgaacacggtacaaaagaaaaggatttcacatgcaatagaatttcattcaccctgaaaagggaaggaaattctgacacaggctacaatatggataaaccttgaggacatcctgctagagccagtcacaaaaggacaagtactgtgtgattccacttctctgaggcacccacagtagagtcacagagacaggaagtagaatgcgggtggccaggggctggagagagcagggagtggggagctggtgtttaatgggtgcagaggttccgttgtgaagatggaaaagttctggagatgcatggtggtgaagacggcacaacagtgtgaatgtacttaatgccactgaactctacacctaaaaatggttaagatgataaattttacattatgtatatttaccacaataaaagaaataagaaataaaaggtttttggatgatgaacgggctcgagccaatttggaccctctaaagctaagttgagccaggctgaacccatgtagccagaatcatactggattaggctgttctagcacttcacgtggtgagaatgggggagagagagagagattgattgatcagggggctgtgcagggggcgtgctacacacttgtaaacagccagatctcttgtgaactcagagcaagagttcacctatcaccaagaggatggcccaagtcattcatgagagatttgccccatgatccagacacttacctcccaccaggccccaccaccagcattggggattgcatttcaatatgagattgaggtggggacaaatatccaaactgtatcacccacaaagaagcaaaaacattttgggccaaatcaaaactattttgatgtagccacagtagggatgagctgtgattacacccattcaggcctgtggacctgcggacctggcgtgtgtggtcgtggggcggtgggtgggcacatccctgggaggtttcaggaggacattcaagaccaaaatgagccatgagtaaataatacaaccacatcctgagtgggagtgggggagcctccccttctctcctaggtcttgtatgggtcatgatcccaccttggcaggagtggaaggaacacagatcctacaggttgtggcttatagtaaagtgactgtggtcatgccttgtgagtgtcattaaaataaacagatatcgttaaatccactatcaaataacagcgatttctgctatcctttcaccttttccacaagtttaaatatcccagatattctactgtgtatattcctaaaagtagacaggtagatttagtgaagttaactggatcattggtatcttctttatagatcatctggtgaaacttgttttgcaaattatgagttgtaggcctttgttttaatgtctgtagccttaggcagttccattgagactaactcagtttttttcttattaggactaatcttattgaccggaactgtggactccccgtattaggagaacagagatctggcctgtgtaaatgagtggaagttaaatactgtagaaaatgccctctggaaactgaaatctaatgctgacttactattggtcatttaatttccttctggcttgggcaccatcgttacattcatttttcagatgtcaagctagttttctcagaatgtgtgcagggctcgaggccgagtgtggaggccactgggtgaatacaggagaggtcacaggtcaagcctcctgcgagaactgcaggcttgagccttcgatagagccacgtgaatgatttttagccccactaggttgctgtcattaaactatgcacacagggcttcttgcttttaagttagcaggatggaaaaattgcaggtgtttgcagcaaacatgaagaaccagccatgctggcccctaagcaatggtattacaaagggttggtgaagattttctcatttgagaactgaacaaaaccaaatggaattctccctagttctgcagctctgggggctgtaagcggcggagcttccaccttccctacaaacggacccagagtggcacctggtatgtgaggcaggtgaccaggagaagggggtgtcagtggttgatgggcagctgcctctgctgcctggttgacccagccccttcctgggtcatctcccactttgcctgggtgtcagtcactggagggttagcgcagtacaagctggcgggtgacctccgtagagcttaggtgaaggggctctcacagggcagtatgtttgagacccttagagggctctccttactcttgcttctcccattatttttaaattgtagtaatacacttgtaacataaagtttaccactttaaagtgtacaattcagtggcatttagtacaatgttgtgcaaccacctctgatatttagttccagaacattttcactgcccccagaggagaccctgtacttattaagcagtcactcctcattcttccctctccccgcagcccccacaatgaaaaatctgttttctcactttggatttgcctattccggatattccataaagacgggatcagacaatatgtgccctttagtgtctggcttatttcaccaacataatgttttcagggttcatccctgttgtagcacgtgtcagtacttcgttcatttctgtggctgaatgatattccactgaatggctatgtttttattttcatttttactttttgagatggagtttcactcgtcgcccaggctggagtgcagtggtgtgatctcggctcactgcagctgaagggctatattaagtttcatttatccattcatccactgagggacatttgagttgtttctaccttttgattaatgtgaattctgctgctgtgaccatgtgtatacaagcttttgggaaattttatttggctagtcgtaactttaagttttgttttggctatttattgttgcttaaccaattatcccaaaacttaatggcataaaacggcaaatttgtctctctctcactattgtatgggttaatgggctagctggacagtttttctgctggtctcatttggcagctctcactgtgcagttagacagtgtcagggactggtcgtctggatgctcagctgcagtggaacgtctgagacggcttcttcacccacaggtctgctgccttggtgtttcttcatgtggcctttctacatagcatctcatactcttggccctcttcatgtagcttctctttctccaagaggatagtcagttcttctttttggcttccagaagcacaaaagtgcaagctgtcagatgttcttaaggcttagacctagaacaggtccagtttcatttctaccacattctataggttaaaggaagtctcggagccaaccttgattcactgtggaatgggcccttccgaggacctgaatgacaggagttgtggctcattggggaccaactccaaagatgaagcctgagttctgagaactttttcttctctgattactccttattcatattttatgttttgttttatagatgtaatatattcacaagtgtctttaaggagctattttgatactcttttgtcctctccctagcaggtcttttttctttaataatttttttcttagtttattttggtcttagttttctttcaaaagcctttcccaaaatatctattctatgttgctcatcatttgtcatcttttttaaaatgcccccttttgttcattcatatttgagagaaggactaaaagactgactgggaggctgggtgtggtagctcacatctataatctcagtgctttgggaggctgaggtgggaggatcacttgagcccaggagctcaagactagcctgggcaacacagtgagacccccatctctagaaaaaataaaaattagccggatgtggtggtgcccgcctgtagtcccagctactcaggaggctgaggtgggaggactgcttaagcccaggagattgaggctgcagtgagctatgatcatgccactgcattccagcctgggcgaaagagtgagacattgtctcaaaaaataaataaataaataaataaataaaaaagaagtttgggagttctttctggccaagacttgtcaactgatagcttttaggggaaagggtttttagggggaatttatgctgattcccaattgttatccccacccctctatcttatctctttgcgcaatcataaatgatggcaggaactactccattcctctggaggtgaaatctacgttctcttgcctgaggtagatacatgtttgctggggttctgcttaaggaaatgtgggagaacaatgtgtttcagggcctggaaaatgtgttctgtatgtaggcttttggttaatctgttttcagtcttgcctatcagtcccactctccggggtacctggtgtcggagtctagtgcctctgcagggtactgtgggacaaattagcctccttgttatcggtatccccctaacctccacctttgtttgctttgcttcattaattaaccatttcccatttactgtcattgtctattggaggtgaattctcttctcttggtaaccccatccctttttttttgtaattgtgtgtgtttatacaatctttattcttcactgtaattcccatggagcctcaggaaaaagagcagatgggagaaatacgtgttcagtgttcagttttccttctgtaagacacctgcaacctgtgtttttcacagaatagaccatggacttaaagcataaagagctactttgtttttcatgattgtgccttcaattctatgtagaaatataatctgtgaattacctgatgaaattttcctaattttgaatcatccttgtatttctataataaacactgttagaatgcatacggtagtgttttatttttgcatttttacttttatattaaataagattatagttttgtttccttccttctaggctcttatttcatttccgtaccaatggtatgcagggctgacttgggaagcttacatgtttttctaagatctaggatgtagctctagtttacacagtaattttcaactgaaggagatttttgccccccatgggatgtttggaaataatctggagacattttcggttgtcacaactggtcatgatgggaggtgctattggcatctcttgggtagagggggtgttactaaacgtcctacaacacacaggagaaccctccacaaattgtctggcccagtatatacacatcgctgaggctgagaaaccctggtttaaataaatgtccaatttggagagtgagtctttgactgccatttttcttcttctatgtgttggtctccagatttcccactttttcagttagttgtagtaactgtagattctttaaaaaaaaaaaaaaaaaggattgcttcatctttacttctaggctgctgtaaagatgtataaggttttcactttttgcatcatattcacattagaaacagctgagttttggagggaacacattcaaacggtagcaaatttagtagagcaaattccaaagacattgagtctaggccagttgtcagtcctgggtataattttagatgttttcaggctctgaagctttccatttaaatgcaaatttcggaacaaagatctgtgtctctgcactgaccaaatagaaggtatgtgaatgttatggtcttgattgttttacaagattttttctgcaggtacttttgcaagtgtgtagggagagatgagaagttccaaggaaaagggtgtgaggtctttggggccagctttgagctggcaaggctaaattataggaagaaggcagagaggtgggcagagaccagatgtgggaggacttcctgtgtcatgccacggagtctggactccaccctgtaggtgacgggagccaagacagggcttggcacaaacacatggcacatttgtggttaagaaacgtcttccttgcttccttgtggccttgagggatgaattaaggggctggaaaaccgggagcaggacggcctgtgcccatggttcaggtgagagccgggtgggtggcaggggctacggagaaggcggttgagtttagccccagttcccaacaggtgctgtggggaggaagaatttccagctgccaggtcagcctcttagatccatttctctttttttttttttttttgagacggagtctcactcttgtcgcccaggctggagtgcaatggtgtgatcttggctcactgcaacctccgcctcccaggttcaagcaattctgtggcctcagcctccctagtagcagggattacaggcgtccgccaccacgcctggctaatttttgtatttttgtagagacagggtttccccatgttggccaggctggtctcgaactcctgacctcaggtgatccacccgcctcggcctcccaaagtgctgggaatacaggcttgagccaccgcgcccggcccttggattaatttcttcatgcttaaaatgaaggaaacgtgaatcattgataaggtgtcccctctttaacaaagcaacagatggtttatcagggcctctcttcgcaggcagtggggcctcatccacaaccctggaaaagaactggaaagcgttgctcagccaggtacggagggcagggccatgtgggactcccgtctccaggccccctctccccagctcccgtttctttctttctttctttctttcttttttttctgagacggagtttctctcttgttgcccaggctggagtgcatgttgctgtgcactttgagggcaggaactggctcctgctccagtttgcatcctctgcgcccggcaccaggcccgtctgctcaatgcaggataagcaggtagcttcgggctgtccacccagcccttgcagagggtggagctacagagagcatgagtggccaagatgaagccctcattggattctttgactctttctactatgtgagatattcttgatgtctgagggatgaacggcaaacaaagtgtggcctacccatacaatggggacagtagttagccctaagaaggaaggaagttctgacgcacgctacaacacaggtgggccttgagaacgtcacgctaagtcaaagaagccagttggaaaaagacaaatgattgtatgatttcactcacatgtggcacctggagtcgtcaaattcagagacagaaagtagaatggtggctgccaggggctgggggaggcggaaaggggagttagcggacacagagtttcagattgcaagatgaagaaagttctggagatggatggtggtgatggctgcacaacactgtgagtgtatttaatgccacagaatcatacacgtagaagtatttcagatggtaaatttcatcttttgtgtatttaccataatttttaaaaactaagaaaattaagatatccttgatgtcagatgccaggagagcggtgtcaggcatctcaccagccgattctcccagaagttttcctccatcgggtaaccacgagcctggggtatcacaaagagaagcctcagtgtaaaatcaacaatctcagtggagtggcttcatcagggagtgacaggggcgtgatttactactggaggacaaggcagcaggcagggaagatggcccaagcctgctttgaactgtaaggagcacgcagaacctcttatccagacccggagggctgccctgttgacagcacaagcagctcagggccagcggcgcaggaaaaccccagggtccagccaggtcacgggcacaggcctgcactcacgggtcactgcagtgaggatggaggtgtcactgcaaatgcgtaagaggatattttcagcaatagtaaaatttttaacagattttagaaatgaaagggttccccctgcatatgtcaagaacctgagtttctttctgaaacttgggtgggaccctttagagttgcttcaaatagaaaacacaccatcggcggccactcccctgaggaaaggcagacttcatggctgaaagcgtcacccgagtgctcccggttttcagcatcacacggagtggctcaggtgcccattcattttatgagtcagcctggggagagtacccacagattcggagtcacatctctgatgggacacaagctctaccctttccaagcattgatgatcctgaggttgatcaatactgagcattgatgtctgtgaaaacaaatcacttaggtgcagagacaccgcaatgaccatcccgccgggggcaaccgcctgattccttccacatcctggtcaacatccctggccaacagggcagcccacggacagctgctctgcctggctcctgctgaaaagccaacagcacaacaactctgccctccatacaaaaccacatgggccctcgagatcacactggggcgccccctttgcccccacttccttgggctgtggctggcctgtctgacatttgctctgggagatgagccagggtctgcccaggccaccacgggggcagagacgtgaaacaggcttcagctactaattttccattaaacgacaagaaaatcggctattgtgagaagagtcacatgaaggtacccaaaagttgtcacagtccactcactcgaaataaaacccatcccattaggaacactgtcattgcagcccatctccagcactctgctctgtataaaagactgactgtggcaagataagggtttaaaattgaaaatcaaagagccattcctcagtgatacccaggaaatgacgcacacgggctgatattaaacccacccacaccaagaatcctaaaagttaacgtacagattactcgttttcaagcaacacacaatgatacaagtaagtcctcaagaagactgcatgggttgaggcactggacttctaatcatgccatctctcagctcaggggtccacgacaaagctaaccccactgagatgaaaagccacttacccctttttcatcactcgcaatacaaatttcagaacccatcccaaactggaaggaaggatacgactgaaactcaactcatgcccagctaacctgggaagtacaccctcctcagataatggagacccaccaattcccgggtgtcagacgtcacacaacctcttctcccaccagggctggggaccctcaggaaagtcaggtgtccctgagaaacacccggcaacatgcagaaccacagagacaggaggcaaggttccagacaaatacacccagtagacagttaaagatttcagagctggagagagcttaggacaccccgattctcagactgcagacagcaggtggacaccactgagctggcgacagccccaaaagaggtcagcttgactgcgacgaggggacgtcttcattatctgtccagtgctctctgacatcaccccaccccgcctcctgtagcagtgttctatctacatgaaattaacctcacgtataaaacatattcctggttcattggcaaacaggcagctctgagcagcacattcagaagttgccaactttgggaggcagaggagttcgagatcagcctgggcaacatggtgaaaccccatctctaggaaacatttataagtcagctggatatggaggcacgtgcctgtgatcccagctactctggaggctgaggtgagaggatcacttgagctcaagtggtcaaggctgcagtgagccaagatcacaccactgcactccagtctgagcaacatagtgagatcccgtctcaaaaagaaaagaggttgccagattaatccagtacacacttctttaatcccgtagtaaattttctctttatagccaattcccaaagtcaagtatattgactcataaaaataccttctgggaagcatgtgactgatttccagctgagaggccctgccactggatggttaagttcataggccccagagtcagaagggggttggaatctcccctctgccatgcctgctacttggccttgtgtacgctcgcgctcgtgcgcttgtgcgctctctctcgctctcgctctctctctctcatgctgattctgcaggcattctacaggcctcccatgtcccaggagccagctctgtccacagtgctcttcctgctcctgctcctggccaaccctccaaccaaggtgtctaggagccacagggaagagcgggttctcttgctagttgctcttccactaggctgtgacacgctggccgagctccgcctccaccggctctgaagacagcacagacaactgttccacctcttccacttccactgagcagaggaactgcgtctgaatgaagccagaaatggggcatttggggaccgcaacagagaacggatgcctagcagatgggaagacgacaaactaacaaacacccaggccttggacccacgcctcccggtaggctccctctcctctccctctcccctccatcacacttcgaaccttcctgggcctggatcaccttcctggaaagctgaccacccccatgcctctgggcgccactcccctgccctaccaccacagggcaacatggggccacatcacgccaccctgcagctcctgttggaagaggctgaattcctggcaacacccacccatcagtcccaagccccgagcatcagtaccttcatgcaaaaggcactaggttggctgctttatctcataagatgagaaaatgatgcccatcaccataaacacattgttagctggtattgatagctgttaacaccctgaacaaagactaaatgaaaatgatggaaactagtgtaaaaagtctatgatgtgcaaaataacaaaatctaacctagcagtagccactccctaccacttgtcacaaggaagcacgaggaactcacagcaactggcagctcctgcagggcggacactgcaaggtcaacgctagaacataaatgacagggaacaactgaggatgaccctgagcttcacagactccagggcctcccctggggccatgggtcccagtggaaatttggtggcacgggcagcacctcctggcacagtcagggtgggggctcccctcaaccagtttggtccacctccatggaccctttggccactgagtcacacatgctggccccaccacctgctttgagaaccagggctgtgccctaccctcttctccctaccccctcatctgcctgtgcacccagggggccaccaccactgcctgggggtcctcacgtttggaggaagcagctgaggctaccagcggctgccagcttgctggcatgggtcccagacattgccaccaccacagccactgatagcacctgaggagaccctctgagccccctgcctgaggccaagcagcagagaaagccacatcctctaaggcccccatgggtgagtacccatgtgacagcccccgccagaccactgcccttgcctggagaaaccactccctaagacccctctcctccagcttgcccagccacacagggaaaaaaactcacttaaactgtccaccggcctgcttccactctgtgacacagcggctgccctggggactgctgagctacagggacccccagtcaaagagccaacccactgaccatgaagcagaaaggccctcctgaggagggccccagggatcgcagagtggactagtatcaaacacccctccacgatggaccccataacaaaaggcataaataacaaaaaagaaaggtcgacgatggcaaatgattctccaataaaaaaatacgagaggaagaatgacaaaccatttacatcaccagagagactgaagcaaggtgggcaggcagtccacaaatttaaaaggcaacaacttttctacagaccagccatgatcagctagaaaacaaggcaagaggaggggatgatcccagtgacaacagcagcagaagtgagagacgcacaaacatgcatgaataaagcaatgaagctccagtgatggaggcaaaggactttttacataaatcaaaatctggatgagaagaaaatacaaaagctctctcctctccccacccccaacccccaccataaaacccacagagcaaccttaatcaaaatcccaatcagaatatgggatgaatttagtttattctaaagtttatctagcggccgggtagggtggctcatgcctgtaatcccagaactttgggaggccaaggcaagaggatcacttaagctcagcagttcaagaccagcctgggaaacttggaaaaaccccacctctacaaaaaacacaaaaattagccaggcgtggtggaccccgctacttgggaggctgaggtgggaggatcacttgagaccaggaagtcaaggctgcaatgagccgtgttcgcaccgctgcaatccagcctgggtgacaaagtaagacagtctcaaaaaataaataaaataaataaaataaggcttatctattcaaaggaatataggagaaaggttggcggagaatgaaaaaagaagaggaatgaagaggtaatggccctttaagataactaagtcttaccaaaagccaccgtaacttacacggtagatagtggcacaacaataaagcagtaaattagaatggagaatccagaaacacaggagaaacactcagaacacagcagctacttaacccatgacaaacctgccaaaacagagaggtcaaagtggctgactaggaaattaggttggaatcctataaaaaaaaaaaaactacatccacaaatcacaccgtatctaaaatacattttagatcaaagaagagatgtaaatgtaaaaaaatcgagactatcaagtattagcagaatatgcaggagggtggttatatacattagggtacagaaacccattctctaagtaagatacaaaattcaggagtaattaaagcaagcttgatagttttaacaatgtaaaatttccaaatttttacattgccagagatgtctttaaacaaattcaaaggacaagtggcatctgagagaaaatatccgcaatatatatagaaaatgaggaataaccctgtgtaccaagaacacctagaaatcaacaaggaaaagcttcacaaatcaagagaaaaacaggcaaggatgaaaaagagaattagaaagagaaattcaaattagtagtaagcacagaagaaacagcttcttataattcacaatttttacaaacacaaaatgaaataagctatcactttacacccacttgactgaatgaaacacaaagactgatcatgtccagagagcgtcgatgtccagagagtgtcgatgtccagagagtgtcagtggggacaccgctgccccacacactagcatcatttagaatggtcaccacctgtcaagagagcaatctggcaatatctgttgacactctgaatgcccaaaccattcagccccgcaagtccacttctaggaatctatgctacgaaaacaaccccatgcagatgcaagggtttaatgtacgagactccacctgtcagcattctccgtgagtgtgaaaaacggaacaacccaaaagttcaataaataaacagtcacatattatgcaagcgtcagaataacgctgcttgcgcaaaggacaagggaccatctctaagacacacagctggtgagcggatcgaactgcaaatcttatttacagtaggatcccactttgttgaaaaatacttttaaaatatgtatgtatttaaaagacaagtaaaatacgtccacagacagaaaaagaaaacgggaggaatcgccaccaaactgtgaacaatgattatctttgtgggcactgaatggggcagtggtgaagttagggggaagctttcattttctattctacatgatgcatttctgtaaagttctaatctttataattagtacatttgaatttcataatcagaaacagatatttaaaggatctcaagatctatgttatatagctctatcatatgttaggcgccacccccgttgatggagccagggtccttctcaactccaaattccactgccagaaaaatggcacctttcttctccagagatacaagataattgcgagaaggcaaaatttttttaaaacagagacatcaagccaggtacagtggcatgtacctgtagtcccagctactcaggagaccgaggcaggaggattgcctgagcccaggagttcaagtccagcctagagacaacatagcaacacctccatctcaaaacgcaaaacaaaaactacagatggcagatctatttaatgattagctctggtggggagcactgcccctcagaccttgacctacccaagcagcctctagttgttaaagacttctcagtattggagaataaaacaaaatagacaagcactttaaaattcaccagaagttaggccgggcacggtggctcacgcctgtaattgcagcactttgggaggctgaagcaggcagatcacgagatcaggagatcaagaccatcctggctaacacggtgaaacctcgtctgtactaaaaatacaaaagttagccgggagtggtggcgggcgcctgtagtcccagctactcgggaagctgaggaaggagaatggcgtgaacccaggaggtggagcttacagtaagccgagattgtgccactgcactccagcctgggtgacagagtgagactccgtcacaaaaaaaaaaaaaaaaaaaaaattcaccagaagttcccaaggaatttgcttccacacatagaaaataatcgagtccgttttttctgaaaacttgctttaaagtccaattgtggggatttgatgtagatggttccattttaacttcttcagccagaggaaatctaaaaattcttccttccagctcaacagagcaaatccacctactgctctgcaaaaggaggacaaagatcctcctggggccgcagaattcagcagcttttccttggattcctaggacaaccaacagctgtgggacactaggccaagcttcaaaaggcagcctgccagccatcggactcccaggcacctgtggagtcctaggcggttgaggaactgggggagggcttggtttcaacctatttgccaaatcaccagcaaaacaagacatgttcaaaagaaacaagtgcacataaataagccagggctctactccccagcccatcaggtcaccggcccagcccctcagtgtgctggtgagcaggacaatcagaaaaggcctctcttcctggaataactaacagtctctcaccatccccactcccactgcccgatgtgtcatgggaagtctctgaaattcaggtttgggaaatcagttgacatgaactacagcataatattagatgtctgattaaaatcatcaagatgatacaaaggtctaatcgcagaggtgctctccactcccaacccccacatcaaatggagctttctctccttcaaatcagacttctttttttttttttgagagagagaagttctcactctgtcacccaggggagggcagtgacaccctcacaactcactgcagcctcaacctcctgggcttaagcgatcctcccacctcagcctcccaagtagctaggaccacacccgtgagccaccacatctggctaatttttctatttttttgtagaggtgaggtctccctgtgttgcccaggctgatctcaaactcctgggcttaagcgatcctccctcctcagcctcacaaagtgctgggattacagcatgaaccaccgtgcccagccttcaaatcacatttctaaggagcctaacaagcagcaggcctttccagttacagcgcatggaagtaacaaaggcagcctcagccagcatccagcgcagtcccagcagacagggataatgaagcggacgtgggcctcacgggagggaatactgtcccccacctccacaccatgctagtgagaaaaacagactgcctgcagctccaaaacatacagcaacttacctatcaaacagggacctctgacgcttcacattatcacgtaagaaatgtttcttgcccagcagcccccagaggatgaacagctccctccacctgaaaggggaagagggcccaagctgcaggcgccctggcctatcgaggccgtggacaggaggcacccgaatgtctccccagaccccaccctgctgcagaggcctctgcagcccatcaccctgcagcgctgctgttcccgctgcttcttggagaacaggggcaatttaatctacaaatcctgtaaatccttgttaaaaaaaaaaaaaaaaaaaaagaagggtaaaataaaacgtctgcactagcaaggctgggacttggcatcagctgccacctcctacagaacccagtggggagtgggctccagagcctccccgtgatgctggcagtgcctcggccagacacctgcccccgccaccctcctgcgtcctcactgcacccctccccaccccatgtcacatcttctgctcatacctccccacaccctcctctcgcctctggatgcacctctcaacacgcccctgaccgcgtcttcctcccatgctctgaactgtccactagggaagccagctgcagaaatcactctcctagaattcacttggtaaaatatgtgttgttattggcccacctactttgctcccaacccacagcaagggctctccagggctaccaagcccctaatggtcaggaactgccccccaacccccatctccagctctgacctacacaaactacataatcctgctgccaaaaacttggccctccctatgcccagggtgccacactccaggctggcccttctgccgagagggctcttctggcctgggctctgaacgggcaaacccacccactcttctaggatggggtccatgatccaccccaacctaccgtggggctctcacatcttccagactgtgcctctctaggagggccttggacccagagccagaatggggctctgatgccactgcacattctccagcaaccccttccatgcccttcctcctgatcccacccagctctaaactgggaacaagaaagctggaatatagtagcttctcagaaaatacctactgagtacacggctggatagatggacagtgctccaggcaaagggactcgggggtaagaaaagtgaagggtacctgctcccggttgtaccactgcagagtccttgagtgtcaaaggactgagaggtgaatgacgggcaaggtgagacctaccaggttagtgtcccgcacccctttgtttccactattagattaagccaccctatgtgacagataaaaggagcaacacatacaaggagttaggccggggttgccaaagtgaggagtgggaatgctgccagtccaggggtcccccacggcagctccccaaatgaaaccaagacaagttggagatgaggctgcctctaggtgtatcaaatcaactgaagtagcaccagtcctcagtgctgattaagcacaggcacgcctgtgatcaagaagaaaaccattacttaataaaatgcagttaatttagaagctgaaatctgtgaaagctcaagggaaagacacaatcaggagttcttggtctggaggggcttctgctctcaaagcttccaacccaacacagcacaaagacgtcttccccaacaaccgcacatcccacctgcaaaacgatgacacgctcctctccaggtacctgaaccttaggactcaaagggtagagaaagttcacaggcagaatcttcacaatacatgcacaaaacaaaggcacttctagtaggagctgtgggtcaggaaaatctcgacttcacccaatgccattcccgagacaatcagccatcaatctgacccactcagtcctgcctcaggggctcagaatctagcagtcaggccaggtgggaagtgcagggacctgtggccaaaatcggcccactcatcactcagctgacagctttcacgcgtactagccagaatcagttagaggctggaggtagtgccaggtgtctgaaacccagcaggcaggttggtaaaacactcacacatcctaaccctggtgactgcactgactgcgtgctttactgtagcagaacagttgcacacatctcatctcctccatccatagtaactcagtggctggtgaggaatgggacacagacctccacgtgcccttctcgggatgagtcaagacaaactctgagcagtgacgctctacagctggctcacacgtggaggcagagcctggcttcccagagcttccagttcctaacacacgcctggccccactgcaccacacccgtgacagctgccaccagctccggataattcagacagatgctagagcacatggctcacttattacaccaaaagactgagaaacagaaactgtgttttaattgtacaatgcacacacttgcttccagagagacctgagaaatccatcatccctaaatgcatgcggttactcaactagtggctttactatttttgaaacaatggatttttccaagacagttgataatcaaaccaactgcgggaaaccataaacgatacttgtttattaaattaagaacagatacaacagttcagaggaattcatatttagagctgccttgctggagaatcaattccaggaatgccaaaccaaccaaatgaaaaaaaattatatatatatatatatatacatatatatatatatatatatatatatatatatatctcacacacacacactcgtgtcacttaacgacaggcatatatatgtatatatatatcacacacacactcatgcgtcacttaacgacagggatgtattctgagaaatttatcattaggcaatttcatcattgtgagaacatcatagaacatacgttatacaaacctactacaacacactaggttatagggtacagtctactgctcctaggctgcaaagctaggcagcatgttactgtgctgaatgtgtgtatctaaacatagaaaaggcacaacgttaaaatatgctataaaagataaaacatggtgcccctgtctagggcactttccatgaatggaccttccatgaatggaagttgctcgggtgagtcagtccgtacactagtgcagactttatagacattgtatacctaggctacattttaaaaaaatatatttttattttttaaatattttatatatttttttaaaataaagtaactgcactacaactttaccacaatgtcactaggcaataggaatttttgagccccatgatattcttatgggacctctgtcatatatgctatcattcaccaaaacaatgtcatgtgatgcatgacagtacatatgtatctcaactgaaaatcctaaatgtcaatagtgttctccgactcactatttactaataagagtttcctcagaactgtctttgcctgagagtttcacgaccaaacgtctctctgcacagttgattctagggacaagaagtgctaagaatccatgttggcttcaagtgcaaaatggaaaacaccttagtgtcccaccaaccacgtcagccaccttcctggagggctagctcccagacccttttcccatcgctgtatagggcccacgtcatctgtggcatttccacgactctccgatgccagccatcagtctctcggcttgtgttgaaaattagcacctttacgtgcccaccagtggtcatgagtcctagtcatgcccaccctgttaaaaacaaatctgatacaaaatgggccccagcaggagacagggacagaacacggacctcacactctctccagctcagactcaaaggccagcactgccccatcacagccgagtgctcttaggcaacccacagctcagctacctgtccccagcctcctcgttgcaaagttaagacaagacctgccttctagatttgtcgggaaattatttaaaatgataaacaaagagggatggaactcaacacacagaattgcccgatgatgtgtgtttcattccagtggtttcgccatcaaaaccatctttaaatgttggagtgtttccgtttccagacaactagagatgaaaatattttcacagtcactcaacgcaggtacctcaaccacgtattttttctcttaattttgatccttgaaacacaaaacaacagatgcaccaccttacattaaaacagccctttagagtttagagtttatgacaggccgcctctgcattctctcactaggccgtagctgtaactcacaaacctgacccttaaaactcccaggacaataagagaagccacaccatggagctcttgctgtcataaaatatctcgcatcagttcaatattgcatctcgtctgtgcctcaaaacaaccacaggcaagaggcctcacgcgggtattgcagatgctgagaaagactctcaagccagaagactggtcctgggccccagggattagtggcagggccaggctggaactgagctcctgttactccaaatcccatcctcttttctgacctcccagtccctttctcataaaaccaaagcatcttctccaaccaggccaggacacacgcaggagagagtcaggcaggaggaggcttctggaagggaaagcagagtggctgagagccctgggacagagtctgacattaggtacaggacaagtttggaaagatccagatggagcgggaagggaatctgggcgtgggggtgcctccttccaaagtgcatccacatccgaggtgactgcagggagacgcagcgctgactttggcagcagggaccacccgggtgcagagaacccaaacaactgaaaatccaaaaaggaatctcagtgcacagtaagaaagctcattctttgggctggttaccttcccaaacacgttctcctctggcctatgtgaaaccgacgttgcactgtacaactctgaagctctttcttgactgcccactgaatgagggtctgtgctacattccaggaggatccaaatgtgaacacagctaggttccagctctgggactcgggaaaaggaggcacaggcagcaggacatgtgctgcaaggagactactgctcccgtgtttcattcactcactcatccaacaacagcactaaggctctgctgtgtgccaggcacttttctagctactggggatccagaggtgaacaaagtcttttacaattgagtggtaagagactgacaataaacaaacaagtatataaataacacactgaatgttgagtactaaggagaaacacaaagcaaggttaacaagagaaggggaagtaacgctaatttatgtagggctgtcagggagccggcaataagtgaggggccggccaggtgggcatctgggggtggctgatgccaagggggtgggaacagcaggtgcaaaggcctggaggcaagagtggcctggcaaatccgaggaccaagggataagatgaaagagcctacattcagttaggatctccgggatggacatgggccaagatgacaggtggggatggggtggggacaacccagggcagatctgggcaatgagcctgtctgcctggagccaggagagcctggaggggccattcttgggagcgagcgggggaacttgagaaaaatcaggccgagacacatggatgtggagggagcactggaaagccactgaaggcctgggcaatggtgacacacctggcctgggccaacttgcagactcaggggtaccccacagcccaacctgggaaacctcacagccggcacagaaatcataaagcacacagcaatggcaccccaccagtacgcagggttccacatagagagcctggctgcatgatcttgaggtcacctaactcccgggcctcccttgtgtgtctggacagggagagaggggaggattggcttcaggagaggcgagaaacgacagtgcccatgacagctgactcagcctgtgccagcaggctgctctgagacatgagctggacccaacccaggcggtgggcagcaggggggtggggaggaactctgggaaaggaaggagccagagaagtctccctgtgggcgctcgggccaaccaccacccaagggaacaatgagcacccccagcccccgatgggcacacaggctgcctcctggtgagcaagcgtctcaaacctgacctacatctgggaggcctgcctggtcaccagggactaccttacaccctacctgtgcctccacgtccccagtgctcacggccacctggcaagggtgaggaactgagactgcgttgaggacacacagcctgtgagtggtacagccagggccgctgcccaggcccagagctctctccgtttctctaaggaccaggctgcaaggcagggcatgtgatctctgccgaagacattcaagccacccagtgatgtgtgctgggcctcgatccccaccgaccgccagtcctctcctcccctggacagtaaaggtttctccaagacttcagacgacggtgtcacctgaggccctcacctattaagtcaccggggcaggtatgcatggcagaggacacggaggagtgccggagaggagctgaggcctggagggggcctctgcagccaggctcaacccccactctccccactccaacagccctcactgcagccaccgcggcccaatccaaacaaagcccagcctgatgccaatctcaccatcaactgtttttcctctgacttcctcagttttgtctaggaaaaatcaaagtgtcttatcccatctctaagcttccaggggtgtgatcagtgtcttttacaattaccttttacttttatccagcatttcttagctcggttggcaaactggatatttatgcacctccatttcacaatccatctccaccgattattcctgtaaaacatttttttttttaaagtttagagttacttaagaaggttatgtaaacaagttaaccagcaagccacaacttgggtctgcggtgtcagagaaaacatgcaaggtgcaagagaatgaggagctgatggtcaccagctttacctccttccagcacccactcctgctcacacacactcacaccccgtgggactcagcctgcagcttctcccagcccaagagccagacagtggggaggagcacagaccacacttcctaacaaatgagagggaagacttcgtgccccattgctactgccatcacccagtcccagcccagagagggagcccactccaagggcccccctgccagtactgctagagcccaccgagggctgccagcacacagctacgagctccagctttatctactcacgccctggacactgcccggagccccagcaggttccacgtgtccttgtcaccccagccctcctgccccgcggatcctaagctcaggagaccctctccagcccaggctgtgggggaaggcagcccccacggtcacccaggaatcagcgcagagtgcagggcatcctggactccccggactgggaaacccagttcctgtccccctgcgtagtggccacacctctgggaggggagaaacccctgcctcacctcactggagggaccctgacccagaggcctgagaaaaagccaccggcaggctcctggcacctgccaacctgcaccttaggaaaacttgtcccacttcaacctgcaaagctctcaggtcattacttctaaaaccactgtcctttctgaaacaggaaggaaaatagaaaaacaaacaaaaacaaagaggcacagaaggctgaagacgccagaggcagtttagcccaaaaacaaagtgccagacacaagatgccaagtttggggcgcttcctccaccgcatgcctgtttaggagctgactgcactcaaccacagatttacgtctggtgcctgccaggtcgttatctgaagagatctgaaaaagtaagcctttcttctgccagtaaatactaagttaagactagcaggcccctctaaggctctgctctccactggggtgctgcaggacaggcccctccgcgggcgttccccgcaccctccctccgcgtcggcccggagaaaaggaagttcgcccctagcctgggcttaccaaggcccgccgcccgacccatggagccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgctcgggagctcttggcccgcagcttacgcgccgccccccacgcgtccgggtccccgcggcgccgcgggcggcccaaggctgccgccgccagcgagtcaggcagccgaggttccccagcttacctggccagggcgcggggctgccccggtccgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgctgccgggtctctcccgggggctgagctcccgcagagctcgcgcctagccgcacacctcgactgctgattagcccgacagctgaatagcggcgggagcctaccgcgagcggagtacggaaagcccgcagggccgcgccacatggcgcacgcgcactgagctgcatacctaggtgacaaacgtgcacgttttgcacgtgtatcccagaacttaaagcatgacaaaatttttttttaaaaaaccctgatgccattattaggaacaatttgaatagatcagtcacaacctatatgctggcttctggtgtctcaatttgtcctgggaaaactgttgtaaagcaatagtatgtcagtccttatatacttatccatctccaatctggaaagacaaggcttatatgtttcctttttagtcccctaatttctctttatgacacaaatccagttggcagtattaaagatggggctgattctcctttacttatctggaatatgctaccattccagataagtaatagtaaaatggccatttcctcttgctaatcaaatgtcgtttttgaacacaaaagccactgggtttggagtatgaaacataaacataaaacatatcatacactatctgtgacgttttcataaactcacatgatccttttatatttttctcttatataaaacgaaatactttccattaaaaattgagatatttaaatgagaaaatgcttgccaatgttattaaaatataaaattttattatttattcaaagaaaatggtcacttttggtttgtgctaaaaaataacagtaacagtagaagcctgctttaaaatattttaagtgtgcgatatcatattacttctcatttactctttgcgtttctagagagccaagtttatttttttctcaattcagtttaaaatcagagggaacaaaatttgaaacgtgacataatatcaaggttaacatgctagctatgtaataactgtaaaatttggccacaaatgcatttgctttgagaaaaatgatcatgtgaaattcctaaatatttgggccatatggaagatgatatcagaagaataatatattctctgtatgtcaaaggaggaggataataaaaaccgtagttattaggttagtacaaaaacaattacagtattcgccattgccaaaaattgcaattgcttttgcaccaaggtagtaataaaagtatggttgagtttctgtagaattccggcaaaggatgagcatccttaatctgaaatccaaaactctcccaaattcgaaattttttgggtgcccatatgatgcctcaagtacaaaattctacacctgacctcatgcaatgtatcatagccaaagcacaggtacacaacacatagtttattcagtgctttcaagagaaaattaaaattaacatgaggctacatgtaaataaattttgtgtttagacttgggtcccatcccaagatctctcattatgtatatgcaaatactccaaaattcaaaaaaattcacaattttggatttttcaggtcccaagcattttgattaagagatactcaacctgtccctgtttggaagcagttccctctagatagattaaactggcctaacaaaaggtagtatctgttgctggagttgagaaagaataaatatttacatacaaaagtgagggcaaaagaagactacaaaaacattcttattgaaattaaataaaattatgcccttttctctgtgtagctctttggccagtttgaacaatgaataccaagagccaatgactgaattctaattatatatttggtgattatgctcagacagacttgaagagagaaatttcataagcatcattttggcatttgattttctaataacagagcatctcaaaatatttttattcttcataattcccagaattttttttttttggtaaatcttgcatatgactccaacgtgcaagttatttgtaacactaccaataacttttctattcttttggaggagaaaatattccatatatatatatgtatatatgtacacacacactacatatatagtttatatattccgattctgccctattaatctataaatgtatgcacgaagaaaatatgtaattactgggactgtaaactatatttatatcagataaaatagataaataattctattagttttatttttcaaatatatctgtgtattaggccgtttccttacagctgataaagacatacctgagactggacaatttacaaaagaaagaggtttagttggactcacagttccacgtggctgggaaggcctcacaatcatggcgaaaggcaaggaggagcaagtcacattttacgtggatggcagcagacaaagagcttatgcagagaaacctccagttgtaaaaaccatcagatctcgttgatgagatgagagcatgtgggaatgtgggagttacaattcaaggtgagatttgggtggagacacagctaaatcatatcaatccatttcctgaaatttgctctgtgataaaaagttaagagtcagattatctgagtcaaaaaaagatataaactggcattttagcttaactagttataaaagtataggttaatttaagaaaagctgagggttttaaaagaatatttagttttatgcatagaaaaaaggtataaaagtaaaaacctgctgctcatttgggtattaaaggtataagtgttaagtataaatgttatattttctaattggctagtaatttatgtacttttatttacatctttttgtgtattaatttttcccaaaacatactgaaagtttttgttttaatacttttctattgatcttcacaattttcaacttcttcaatccaaatttatcgattagtaatgatgttgcttttttctttttaaagtttttacctattatgttttctgccatattaatcagtattttaaaaaattactaatggctgtaataggagacacacacaatttgttaatgagaatgcatcaagtttctcaccattaagcataatgtttatctgtcttcatacagccatatatgttttatatatgtgtgcacgtgttcccttgtgtacgtgggttgcatatgtgtgtgtagttattatgttaagacataccatatcctttattaaactcattgaaattaagaaatgttaatatattcagatgcattttggtatctttggagataatactgtgatatttatttagtaatatgatatgatgaaaaatactaacaaagctattctcacattgttgccacgaatctctcgtggtcatcgactatctttttttttttgagacggagtctcgctctgtcacccaggctggagtgcagtggtgcaatctcggctcactgcaagctccgcttcctgggttcatgccattctcctgcctcagcctcccgagtagctgggactacaggcgcccgccaccacgcccagctaattctttgtatttttagtagagacggggtttcaccgtgttagccaggatggtcttgatctcctgacctcgtgatccactgcctcagcctcccaaagtgctgggattacaggcgtgagccaccgcacctggctggactatcatttttaatagaacgctcaattcagtttgctaatattttatttggtgcttttgggcatacattttcaggtttttaattggaattgcaatgtcatgctgacttcataaacataattccaagattgcctttctcttcaaatgttctgaaacattttaattatcaagggaattatctgttcctgaagtttggatagatattactcaaaatactggtgaaccctggtatctattactggaataggggaagtgatgagaataaaaagctgaggccttttgtatcttggtgatattctctttttatttattttgtctttattcagtaatctgctttgatatcctgaatcagtatttccttaggtggagagagttttcttatattgaatattagattctttctccaattttacttttagaactatagttaccattctgtacttagatctccacaacttattcatcctgcctaactgaaattttgtacactttgacaaatatctcttcattttttcttagctcctcatttattctctttttctattttctagaaacactgatttttacttggggtatatatttttatccccccatatatatccttttcttatctcttattgtctctttgtccctttcccttggatcctaaggaagactcctatgttttcattgacatcatttagtgttctatagctttaattcttttcttcattcgttctaatgcagcctctagtgttcctttaatattttaagtttccttacaatgctaccttcactcggttctctttttcttgccctgtaattggccagaaaaaatatttgctgtattttatattttatatcatgttttttcattttaaaatactttacagttacatattttaaaatatcttactcaaatattttaatatattttaacacaatgttttatctgaaatatacatttatatttcttgtaattattttattcacaaaccttttatctgatgttttgttttatcacattgttaaacatttctgaaattatcatgtactgtgtgtgtatatatatatatatatatatatatatatatatatatgtatgtacttatcattaaataaggcaggatctacacattgttttgatatcccataaacagagtatacaagtgtatcttggttccctctctatccatctgtctcagctcattttatgctgctataacagaataccacagactgggtaattaatttacaaaacagaaatgtatcggctcatatttctgacaaattcagaagactaagagcatggcaccagcatgtagagagggctttcttacttcttcatcttatttcttcatgttatggaaggcaaaatatgaaaagatgaaaagtgacaatgtacaaaccgtgtatgtatgtgtgtatgtacctaaaggtcccacttctcaccactgtagcattggtgactgattaagttcctaatacatgaactttgggggacacattcaaactataaccccatctgattattcgtagagttctcaacagatctcaggcagaaggctttttgataggtccagccctttatcaattgtagataattagaagtgatacacatctttaccaggcttcacgccttccttctgccaagcttacattcctaaacataaagcacatccacattcacttgaatttttcacctatattgaacttcttggaattcgaggcctcaaatcaatgcagaataaaaggagataacggtaaatttgaagaattaaatgatcatgaccatttttaagtcaggtctttcgcaatgaccgtggtcaataatggccaagacaaatggagatgaattatacatagaatgaatacattaaaatgtcatctacttttctttctccagaaggattcactgttctatgtgcgcctctcatctgcctttttattaattaacctttctactgaagtctggacgatctccaaccagtattcctagtttgtggtattgtagaaatatatttttgtgttttaacgagtcaacaaagcatttgtaagaaatcatcataaaaatctattaagcattcattttgcatcaaacatttattgcgtaaaataagcagatacaatgaaaattcttcttgatggtggaaaggtatcactgtaaaaaatcattatcatcttgggttgcaatacagcagtaaacacagagattttgatatatgtaggacctatattgctgagcttagctatgctctctgtattttgtttctttgcctttcttgtcaagttgtcagcaatcacttcacactactgaaaatataattaattgcctttagcagttccctccctgcttctaaccttatactttgaagcagaagcagaaaattactttggctgagagtcagagctaacctgaacgttgtattaagtggaggccaaaagtttctgaaaatgtactgggggctttattcatggatgaaagggtataaaacctttgttttattgatctgcacttcctaatttttatacttacaaccattgtccaaaattttatatattgcttcagatgtcttgtattccacaccaatggaaggtaccgcgtcttattcatccttcacctccaagttcctaccaaaatgcctgacatatgataggtacttactgaaaattgaatggaaccaacttactgattatctattctcccttggatatctcacatgcatctgaaacttagtatgtgggaaactgagctcattttccttcttccatgctcaacattgtcttttccctcctgtgtttcctattttgatgaatagcccatattctcaaccaattacctaggccaagagccttggagccaacctttctcttttcccctcactactcacaactaattgataaccaactgttgtctaccccctgccccccacaaaaaacagcagattaatccatgacctcctctccactctcactgcactgtcttggtcacagccgtcacaattcttcgtctggaatgtaatatctcctaatagtcctatccattccaattcactttccagattcctgacaaaaataatttttctgaagagaaatctgatcattaaatttagctgattgattgcaaaattaagttctccatgttagagatgagagtttgggaaaaagaaggcagcaagaattcacaaagaagaataacagagatcagaaaactatccacagagacagcttcagagattttcaggggatgtgcagatttattgaatcttccaattaatactgatcaacacaagtatgtgaggaaatggtcaaggccagggtacaaaccactagaaagggaaggcaaaaaagtctccagaattcacataaggtcataagtagtttgtgtttccattagccagggtagaaaatcctcgaatcagttagagtactcagaaggatattgtctcactaatgtggaaacaattctatctagactgaaaggtgctctggttctaccaagcaaagcttaaaagcaaacttcaacacaagcaaattattcctaagtaatttaactgcatcccagaataaagcttaactattcagcacaaaataaggtagaattcactatgtccagcattcgataagaatatatcaggcatagaaataggcagaaaaatgatacatattgaagagaaaaaaatcaatcaagagaaacagacccacaatgacacagttgctaaaattagtagataatgacattaaaacaggtatctatgtttgaaaaggtagaggaaagcatcaaatgagagacatgaaagagagagcaaaatgtgaaatcatcttctcgggattaatcaaacaaacatggaaacaatgtcttagatgaaaactatactggatgaaatcaaaagcagattatcaattgcagtaaaaaaacagtgaatgtaattgtttaacaatagaaagtatctgaaatgaaaaataaaaatgggaagagaacatcagtgggataacttcagtggcctattataagggtaactggattccccaaaggataggagggaaaaaagttttcaggaaataatgtatgaaagaatagttactgaaaacaattacatttaataaattgagctctcctcagcctaatgagtgtcaaaagtctcttcttttcttggactttctgctgacctgaacactgctttgagacaagtctacatgaaaaaaaaaatgaggcaaaggtaaagaaaaggaaaccttctcttggtcaatcagatgagatggctgaaaagaatgccaaatcctcaccacaagtgatggagtgaatggtcaccttggtccagagtgagaagactgtgagcctcaggatggttctaacacaggattacccactcacctggctgcagtccctgtaattcagacccatctttagggcttttcctcggatccacgagtcagcttcctgttttctcttatactcctcctgtctcggatcttcttagtctctctctaagctctacagaagtgtcttctttgttgtttccttatatactttatacctacctatgaattaccatcccctgaatgttatggcttctacgaaagataatgcaataattttatttttcttttgagacggagtctcgctctttcgccaggccggagtgcagcggcactatctcggctcactgcaagctccgcctcctgggttcacgccattctcccgcctcagcctcccaagtagctgggactacaggcgcccgccaccgcgccgggctaatttgttgtattttttagtagagacggggtttcaccgtgttagccaggatggtctcgatctcctgacctcgtgatccgcccgcctcgacctcccaaagtgctgggattacaggcgtgagccaccgcgcccggccaatgtttgtaatctagttatttcttagggaccaccagcactcactcttgtctgtgtttagcacaaagagcaaggggcagagtactcatcaactcaggaggaggaggagtcagtagagaaagcattcatgaaaaaaggcttacatctcagcaatttctaggcacaaaagacttatgaaattctaatattttattttgacagagttcttctttagcattatgttagatacaaaaatagattttgaaaaatcattttataataattatagtatttgcctatctgtttatgccacgtaaattctatgtataaataggtggagaggtagtcacaatattggggggcatgttgcatagtatcttgcaccatagctcactatcttttacataatacgctttagtatgttcagtaaaacacttttagtaaagggctcagaaattatgacagggtaataccagtcatagaatcaagaaaggcatctagttttatctacaaaagattttagaaataatcttataacatatccactaaattgaatgatgaacattagaccactttttattccattataatcttattttctctcataacgctatccattaaagtatagattctattgtaaaagcttctaaaaaagtatcaaatcttcctttgttccattccagctaagctgtgtttcccacctgttctgtgcttgctaaaaatataatgagaaaataaatgactatctaaagttgttttacaaaagactgtatcatagatcctgtgaaatccttcctgctttaaatcctttgagtggctggatatcttgaaatggcaaatgaattggccacagaacagtgcacactattcaaggtttgttcatggagtcttatttatcacagtgatctgtgggcatgataacataatctatacagtgttcatttttctcttaggtggtctgggcattcttcaaccatttattcaaacattatcttctcaattccaccttataatttttatttctaaagcgaagtgagcacagaccagatacctgtacctgggtagtggttttctaggatacagtaaaatgcaggatacattgaagagcaaatgggtgcagatgaattgaaaactcttccctctccacgtcaaagcccagttgaaggttggcatttgaacagaaaacattcatagacatgaatggggaaagttaatgctcagagttcacaagtgaaatgaaaccattcctactcactgcttctacaaatcactttataagtgatcctgaggaattctttctcatctctctctctctctcactctccctcctccctcatctcttccctctcctattctggctgaaactggcacctaagtcaaatgtagctaagcaaacagtgtctcagtacgagacagatatatatgtatgcacaatacacatatatatttacatgtatatatatatatacacacacacacatatatgtattattttttcctaattctacccacaaaagaggcactaataccttaagagccataagcgaattttgtgcccagatggtttttaatacctgtccctactgaaaggaacaagagcctcttggagaaatgtctggttccagggctgggacaaagaaggtacatgatgaaactggaacacctttttgtgccagaaagaaagggagtgctcaagaaaacaatgggaacatgtcaaaaagaaataggcaatagcttgaaggggctcctgctgaccaaatctagggacaatttgtctatcaaaataaatgaggattgcaacgattaaataaaataggatgattaaataaagtaggaaattattcatctattataataagcaaacaaagagatacgcgcatacataaatggataaataagcagaggagaaaagagaacatttctttattttattttatttttttgagacggagtctcgctgtcgcccaggttggatgcagtggcgcgatctcggctcactgcaggctccgccccccggggttcacgccattctcctgcctcagcctcctgagtagctgggactacaggcgcccgccacctcccccggctaatttttttgtatttttagtagagacggggtttcaccgtgttagccaggatggtctcgatctcctgacctcgtgatccgcccgcctcagcctccccaagtgctgggattacaggcgtgagccaccgcgcccagccaagagaacatttctttaaattagtgtgccacctgatacatgtgaaaggaagagtcatggagtggccgggtggagggaggcagggcggggaataccatttgcaactatggtggtaaaaaataatttaggcaagaagtatcaggagaatacttatctttgggaagagctggatgagaagcaggctgcttgcgtgttctcaaagtgtctcttcacagactgctattcattacaaggagaaaagtactaactaaacagtgaagaatgcaaatgacactttgaccttttgctgcaaagtaacctcaccaataagaggtatgtagatgtcttgtatttgggggatatatggtaccccgagaaggacaccacatcactgctgcattattccacttgcagctgtataaccaagtctaatcatgagaacacatcaatcaagctcaaatgaagaaacattctgtaaaattactagcctgaatttttcaaaactcccaatgccatgataaagaaaggcagagaaatgctgatagaataaagaaggtgaaagagatagaaaaactaaatgcagtatgtgattctagacatggaatatggactacatagattagatgaaaatattacttcagtgttaaatttcttgaattgtaccatcttcagatgcttatttgaggatatttaattcagtctggagagttttattgcagtttatctttcttcctagttggtttgggggaagaatttcttcagctgaaatgttttgactcatattttctgttttctacagcagcttttatattgcagtttttgtagttatgttttttattctgttcccaggtatcatagaaatggagttcctagttctagagtatccttttctataaatagagtaaaatgcagtttatttaataagagatgttggcactttgggcagaaagggagtggtaggcacgtggtacttctctttcatctggacatattccttaattttaccttctttttttcctttctgtgccatgactcctgatcaatcaaatagacaactgaaattattcacagatctgaaatgttttattatttctgttaccagatttgtagctcttcaatgcatgtttaacctgtgcacatagtctaattttcactgctggtgttgacagaaaaaaatatttcaaaaatggaagctgagggaggccgaggcgggcgaatcacgaggtcaggagatcgagaccatcctggctaacacggtgaaaccccgtctctactaaaaatacaaaaaaaattagccgggcgtgatggtgggcgcctgtagtcccagctactcgggaggctgaggcaggagaatggcgtgaacccgggaggcggagtttgcagtgagccgagattgcgccactgcactcccgcctgggccacagagcgagactccgtctcaaaaaaaaaaaaaaaaaaaaaaaaaaatggaagctgaggattgtaacataatgtaggtatataatggcaatggcactatttctgcttttcctgtgctttgggtctacctgaagagtagtgtgcacttgctgtgaatggtagagcccacctacattaggctgatgatttattgttgaagtcaaaaaaactagtgaaattttactgagtagactcttgatcagcagggtagcagatgtctcccagaatattttgcttctcaaatttacagggcttctacctttcatagaaaaccatcctcacctctgactcatgtgacttatcttcgggtactgccttctcttggcagtctttgggactacctcaaagcagaattcatcctaccctgctcagtgttccctcgactcttcttccattatatggtagtccactggtgtctcaacaggtctgtacattatcagactgtgagctccctgctccctcagccagacagagattgaagaggacaccatctctttcaactaaattgtgtgaggccattacaaatggccgacatttgtaggccactacatatgggctactactcacttatgttttagcccagcccttgagtttgtaaagtgtgttgggttaaatttgtagttagacaatttagccgagggaagcttaaatgttctgtgtagagcagtgggagaaatatgttcttgttatttttgctcttcttgaaacaaaagaaacggaaaagggagagaagaggtgaataataaatacgaaagagtagaaatgcagtctgcaacagatgacagcagactgaagctagaatccagaccaggccaaggaactttatgattttaaggaggatgggtaacacacaactggaggtgttagcagtgctacagtggtcagttgtacacattttttctggcccttgaaaacttgagtaagttcagttaaaacacacatagcatgagtaagaattttgattttatgaacactaaggaaaatgctgtgtttgttacatgatagggcaaaataattagaaaaagaaccctacacatagaacagttgcataattttgaaacgaagttaaatcagaggaaatgtggggggcaggaggagaatgaccacaaaattataagcctacagataatttggaaaaatcctgaggaggattttcaagaaaatgttcagtgaaagcttggagcaatttcatctagtgtttaagaagaaggatttccttgctgatttctatgatgtgtttttattcatacacaggtacagcacctacgtagcacgtaataggctatttacttagatagcaggtgagcccaagatataatacctgtactttagctgttatctttagaaataaacatctaataggatctattttggcactgcaatggaaactatcaacattggaaaactcctaagtaagtgttcaacaatagagaaatgactaaacaaattacagtatatttgctctatttcgtacatgtcacaatcacaagattgaaatccatctatataagctgacatgttaagttcccttacacataatgccatgtgacaaaaaatatgttgccctactatacaactgccctacttatgcaaatgttcagaaaactatgtattaacagcaattgcccccagttgaaggatttgattggagggaaaaaaacagatcttcactttcctcttccaatccttttatgttacacaaaattttgtcatgagaatttatatatatgcacacaatatcaatatatttatattaatatttatcttattaatatatttatattaatacttgcataattaatatattattgttatatttatatttatattattgatatattagtaatataattattaatattacattaatattttaacatattaatatataaattaatacatgtatactataaaacagaacatctgtttttggaacatggttagttgagctaatgcaaaatgctttctgttacagttaacatggtggagaattataaaacttgtgcatagtgttgggagttcacagaaaataaatggagatggcaacccatagatagtgtgaaaaaacagaaagaggtgagattgcatgacaaatgagtaccatgtaaggtaaactttgttggacttatgactcagaaataggctctcaaaaatacaggtttggaagtctccttttattcaactttactgtagaatttcagaaggtgacattcactaattctacttgtacaattcaacaagttttgatagaagcatagttacataggccctaccacattcaacccttaaaacaatcccagccagaaactcctctggtgcccctattctatatatatataaatatatatatagagagaaatatatacatagaaatatatataaatatatatagaaatatatataaatatatatagaaatatatacaaatatatatagaaatatatacagaaatatatagatatatatatagaaatatatacagatatatatatagaaatatatctatatatttctaccatgcccagcttctgtgcccaggctggagtgcagtggcacgatctcagctcactgcaatctccacctccaaggttccagcgattctcctgcctcagcctcccaagtagctgggactacaggtgcccaccaccacgcctggctaatttttgtatttttagtagagacagggtttcaccacgttggccaggctggtctcgaactcctgactgggaatctttaaatgaatttttgtccttgtagttttgtgttttctagaatttcatataaaggaaatcatacatgaagaagtaagtaaaaagctaagatttttacttagcatcatgcattttaaagtaagtcttgtctttatatatattagtacttcattacttttttttttttggttaaatagtatttcattttatggatatgccccagtgagtttatttatttaccaattaatggacactacagttgttttcagtttggggttgttccatataaaattgctataaacattcatgtacagatactgtacagacatacatttttattttccttggtaaaaacctggaaatggaattcctcagtcatacaataagtgcacgtatgaatttataacgtaagtgctaatttataacataaagtgctaatctgttttccaaagtggctcatcaaaaacatatgagcgttgggttgttcatccttaccagaacatggtttggttttcttatctttatttttattttaaatgttccaataaatagtgatatttccttaagattttaatttgcattcccctagtgattaataatgttgatcatctttttgtttgtcatcactgtcattgttttttggtgaagtgtcttttcaaatattttacctaatttttttaaccaaattgtttggcttcttgagttgtaagaattctttgtatattctggatacaaattccttatctgatatatgatttgcaaatattttctcccattctgtggattatcttttaattttcttaatggtgatatttaagagcaggagttcttaatttttaggaagtccaatttttctacttttaatttttattatttatctcattttcttgccttatctaagaaatcttttcctaaccatgttcataaagattttctcaaatattttcttctagaagttctagagttttacatgttacattcaggcttctgatctatttcaacttaatatttcttataacaagaaaggtgaagatcaagactcatcttttttcatacggtcaccaagttaatcaagcatcatttgtaaaaaactctcttctttcaccattgagaatcaatcattgtagaatactagctgactatatatgtgtagatctatgtttagacactatattctgttccaaattattctgtacatttctatactttatctcaatgcaactttatcttactatagctttatagtgtgactttaagtcaaaccatatgaatcctccacatttgttcttttaaaatattgttttagttattctcaaggcttgcattttcatataagtttttgaatcagcttgtcagttcaacaaaaatacctgatgggattttgatagggattgaactgaatttataaatgaattttgggtagaattgagatttaaataatatttagtcttttattccataaacatagtgtatctctctattgctttattttatattgattttttatcaatgatttttaatttccagcacacaaagcttgcttatattttactagatctattctgaataatttcatgtttttgatatattgcaaatggtattatgttttttaatttcaattttcagttatttttagctcatatacaagggtgtgattatatatatataaacatatattatatatataatataaacatatataaacatatatatatatgttgacctggcattctatgaccgtggaaatttcacgtttaaatcagtttagcatttttgtagcctttctgagattttctaaatagctaattataacatctgttaataaagacagttttgtttttcccagtttgcatgcctctatcgctttttcttcccttattcttttcactaagacctcagcctaatgttgaatagaaatggtgagaaaagacatccttaccttgttctcaaccttaggggtactcatcagtctttcacaatttagtattgtatttactgtaggttttgtcaacttgaaagtgttccttatctttctgatttgctaagatctttataaccataactaacaaatgttgaattttatcaagtgcatttctgcatgtattgagatcctccaggtgctgggatgtcagtgctcctgttgcagggccaggcaacaagatttgtatgtgttttcacacaaaaagctgaatctaagctgcctacataggcccaggaataaatgcagcaccctcagttgacggggactaaaaaattcctcctggccgggcgcggtggctcacgcctgtaatcccagcactttgggaggccgaggcgggtggatcatgagctcaggagatcgagaccatcctggctaacaaagtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattccgccactgcagtccgcagtccggcctgggcgacagagcaagactccgtctcaaaaaaaaaaaaaaaaaaaaaaaaagaaaattcctcctctccagttggagacgtgacaaggaatctcggttctgctctgattctgcacaccgagcacataatccagcctcaagcagattttgaactctaatctgaaatacaatcataataatagagttcctgatttcagacattaacatcgaagttgtttttgagttcattatagaatcaaaggctaaaatattctgaagagacatttctgccatacaggccacatgctatctttaattgagaataatggaagctaactctcctaaactcttcttactgtattgaaatttaagtagactatatgatagagcatatattttttcattcattcaacaaatatttattgaatgtgtctgttaggggtccaggcatttttcaggctctgatatgatgaaaggaaaacatgaaaagccgtctcttgttccaaggggagattattattattatttacatggtactgcagccaaatgtgttcatcttattagagtacatattgattgagtataacatgatagcctctcttaggttataaagtacttttatatcctaaaacgtttgtgagaccttttctaaataatcactaataatctaaaatacatacatatatgattttatatatatatcttcacttcattattattttcactaagaatatacaaaactggctttgttctaggaagttactttgctttgtgatatttctgcgtttatttatcctctgtacacctcttattacatagaattatgctgagttgctacaaatgaaataagccaatttctatacattatttgttttgtcaaataacaccatgttcagtctttgcaatgtgtctattcttctggggttattttaagatacatgcttcagtttatattgatagcaccatactaatcattttataaaaatatatgaaatttaattgctgatgttcaatattagacatattttatgctattttatccaccaaagcaaagccttctcctagtgcagatctgagtaaccaccattcccctctgctatcaaatatttccaaattaattagttatttccatgtttttgccctattttgatttgtccaactatttaatttcgaattaaactcatttcacttaagttacaaaccaagcggatgtctagatttgttgtttccagatttatttcagacattaagaaagttatattctgtctttaatatatttaacagaacaaaactcaagttgtcgttttgctaattattcgctatatagattaaaacattaatccctgttaaaatcatgctatttagtactaagtttttttttgttttgttttgtttttaggcggagttttcgctcttttcgcccaggctggagtgcaatggcacgatcttggctcaccgcaacctccgcctcctgggttcaagcgattctcctgcctcagcctcccgagtaactgggattacaggcacgcgcctccacgcccggctaattttgtatttttagtagagacggggtttctccgtgttggtcaggctggtctcgaactcctgagctcaggggatccgcccgccttggcctcccaaagtgctaggattacaggcgtgagccaccgcgcccggctagtactaagttttgttggatgaagggaggatcaaactggggcatgtcattttttgacaacagagttaactgagtgagtggctctcaatggttcattacgtgtaactttcctctaacactgttacatgcgagcttccggtaggagtgccttctcatggagagggtggttattcatcagtcaagaggatttaagtgtgtataatcaccagctagaacgttcagtatgcaacaggcttccttctgccttcatgtgcaatagtggtctttaaagctggagcttttgctgaatgttgttgatatactacaacaatatccagaaaatgcactctatttcctcgctaatccaaagcagacaatggcatacttctaaattaataagaacactgaaaaccacaaacatttaattccaaaatcttgttgctgacattaggatacatgtaaaaatttaatccaagttcaacttaaattcttccatcagtttttgtttagttgctgtggagttttataggaaattcagatagctataggtttcccctataagttctcttcaataatttgattcctgccaataataaatctgtccatcatggtaagtgatgcttttgttattcacattgccttatgtttatttaacacaaaactccatttgtatatctccactggaatccttggtaatttgtgattgtctattaaattgtgttttaaaattggcattgagtttcaaatcatactgtataaactgccaatggtatgacactcattgtttattttaaagccatgataaggataattcccttttctgctaaatggactcagttccaagtagaattacaaggaacaacaaaatgtctttttttatttaatttaatttaattttattattattatactttaagttttagggtacatgtgcacaatgtgcaggtttgttacatatgtatacatgtgccatgttggtgtgctgcacccattaactcgtcatttagcattaggaatatctcctaatgctatccctccccccttccctctacaaaacgtctttgaaataaactttgtagtagagaacaaagtaaacaatccttgataagaatcaagaaatttagattatcctcctggccaagcaaccacctgcctgtaattttgtaaaacaaacttggcttcattgatgtctctctccttgtcagtaaaggaagagagaaataattgaattcattattctccctatcagtaaacagtttattacttttaaaacctaatttccttaaactttgaaacgataactttatgattattgtctttaattattggtaatactttgaataatttaagaatgctaggctaggcatgtccattgtactcattttatgccttaaaaatattcacaattgatggcttagttgtatttagaaaaacatgcatagctctaagtataaaaatgcaatgtcaatttgaggggttttgttgctgtttctcatcataagttcacctgtaagattttactttcaatgtagcatggtatcattgagtttacttatgtctgttatttttcatttttcactgagtatacaatatgtctaattcttcagtgttgttattgtttattatgtcaggtagcaatgctgatcatttagggtttggaatttttgaagtcaatgccgtaggctttcaggataacaaatgaaacagcaaaaggactcattttccatttggtatcttctaaatataattatataaggaaattccctttacccactataggattctgctctcagaaatgtctctgtttctagagattttcgaagcaaatggcctgcaaatgaaaaatctcacttaatacaaacatgcttccaaatgttttagacatattaccaattttagttcaagtttaatattttaataattgtgttatgaatactagcactaaagcatcaattataaatcagtattaggttctatgctggaaatacagtgcatatacaggccagatattcttgaaaaaccacataatactagagcttatgattgaatagtttaagaccttctaggaaaaataaacctgataagttaaaatttgcatacatttatgaaagtccctaaggagattttgcccattaatggacttaaaaaaaagacagcatacctcttttatgaataataattggtggtgtacagtgacatttttcttttagggttttcttttttaaatttttttaaaattttactttaagttctggggtacatgtgcagaacgtggaggtttgctacataggtatacgtgtgccatggtggtgtgctgcatctattaacccatcctctaagtttcctccccttgccctgacgtgtgttgttcccctccccgtgtccatgtgttcttcttgttcacctcccacttatgagtgagaacatgcagtgtctggttttctgttcctgtgttagtttgctgaggatgatggcttccagcttcatccatgtccccgcaaaggacatgatctcatttctttttatggcttcatagtattccatggtgtaaatgtaccacatttcctttatccattctatcattgatgggcatttgggttgttggttccatgactttgctattgtaaatagtgccgcagtaaacatacatgtgcatgtgtctttatagcagaatgatttatattcctttgggtatatacccagtaatgggattgctgggtcaaatggtatttctggttctagatccttgaggaatcgccatactgtcttccacaatggttgaactgatttatattccccaccaacagtgtaaaagcgtacctatttctccacaaccttgccagcatctattgttttttgactttttaataattgcaattctgactggcgtgagatagtatctcactgtggttttgctttgcatttctctaatgattagtgatgttgagctttttttcatgtgtttgttggccatgtaaataccttcttttgagaattgtctttcggtgaatttttatttaccttcctctaatttccagaaacttttcaagattacttccctgattgttttgttgatatgttgctttactgagagtaatatatatgtttagagttacttttgtatgcatgtaatatttctttcgatacttagaccatttctaattttatgatttactgatattgactccctctagctcaactgtggttatagcaaattagagtagttccaatctcttcctatcaacattcatcaactacctaagggttatctcatctcagcctccttcacttttcctgatgcttcttttccaaagttgataccactagtttattgccagttttacttctatttttttcaacctccagttccctggttgttttgtttgtttttgctaatatttccacaaataagtaaatcaaggtctatttttactaaaaccataacttctaaattgaggtaaaggataacaggaatgatttcagaataattaactggaattaatatctgcaaataatatccatcatctgaattcatagcttcttaggcattatatcatcttaaaaagtaactgatttgataaacatctaccaaaaaatcctgcattatacttaatggtgaggaactggaagtgtttttgctaggtttagaagcaagtccaggatgccctctcttacaactcctattcaacattttactggaagaaatagctgatgtaatatgtgaaaaagaaggaaaatgtttatagattggaaaggaatgaaataaaatgtcttcatttgtagatgacatggtttgccatggagaaaattccaaagaaatgttaaaaaataaaaataccaccaataaggtcaatctatctatatatctatactatcaataaggtcaataggatacaaagttaatatataaaataaattgctttcctatattccgcaaacaaacatttcagaaatttaaaaaagaatgatgcaatcacaatagcaccaaaaacctttttcattagcaccaaaaaatgaattacttatgtataaatatatagagagtctataggtagaaatctacaaaacatgataaaagactaaaagaagatctaaataaatggagaaatattccatattcatggattggaagactcaatattgtttgatgtcaactgaatatatagattcaaaataaaagcaataaaaataaaaattgtatttaatagctcttagcaaattgattccaaagtctacgttgaaaagaaaaagacctaaaataggcaagataatactgaagagaaacaaagtttgaagactcatgctacctggttttagtatttagtataaagctaccataatcaagacaacatggtattggttaaaataagatacacagatcagcggaagagaagagacggtctagaaggagcacacacaaatatagtcagctatctttgaaaaaggtgaaaagacaactcaatggagaaagaattatattttcaacaaatgatgccgaagcaaatatacatctgtaggcaaaagaagaacctagcaacaaaccttatacatgttgcaataatcaattcagaacagatcacagatctaactatacaatataaagctataaaaattctagaataaaatacatgagaaaaatctatgtgaacatgggtttggttatgcttttagctttaataccaaaagcacaatttgtggaagaaaagtttcatgttggactttattcagactaaaagtgcctgttctgtgaaagacaagtgaagaaaatggaaacacaagccacaaactggggaaaaatgtttgcatagcaaaaatctgataaaggactggtattcagcatatacaaacactcttaaaagtcaacactaaaataacaaacatcctaattttaaagtgggcaaaagatctgaacagacatcttacccacgatgatatacagatgacaaataagcacatgaaaatacactctaataatctgtcattaaggaattgcaaattaaaacaacaaccagatatgcacgtattagaatggctaatatccaaaaaaccaaaaataccaattgctgatgatatggaacaacaggaaatctcattccttgctgatagtaatgtaaaatgatagtcactttggaagacagagcttggcagtttctaacaaaggtaaacatagtattatcatttgacccagcagtcatgcttctgggtatttactgaatgttttttaaacacgtgaccacacaaaaacctgcaggtaaatgtttatagtggctatattcataatagtcaatttggaatcaaccaaaatgttcttcattaggcaaataaacacactattatactttgatgcaatggaatgttattcaacaataaaaaataaggagttatcaaaccatgtaagcacatggctaagtcttaaagtatatattgtcaagtgaaataaaccaggctgggccgggtgctcatgcctgtaatcccagcactttgggaggccaagtcgggtggatcatgaggtcaggagttcgagatcagcctggccaacatggtgaaaccccatctctactaaagatacaaaaaattagctgggtgtggtggcatgtgcctgtaatcccagctactctggaggctgaggcagaagaatcgcttgaacctgggaagtggaggttgcagtgagccaagatagcaccattgcactccaacttgggcaacagggcgagactccatctcaaaaaaaaaaattaaattaataaataaataaacataaataaaccaggctgaaaaggctatggcttcatactgcatcacttagtttatatgacagtttgaaaaaggcaaaattatagaggtagttaacagatcagtggtgtccagagtttcaacatggggtgagagtggtaaagcacagggcattgctaagcgtgcagaaaatgttctatatgatattgtaatttttgatacataatactatgttaaaaccaattgaactataaaacataaaaagtgttccttagtatatgcaaattaaaaaaaaaacaattattggccaggactggtggctcatgcctgtaatcccagcactttgggaggctgaggcgggcggatcacgaggtcaggagatcgagaccatcctggccaacatggtgaaaccctgtcactactaaaaatacaaaaaattagccaggcgtggtggtgggtgcctgtaatcccagctatttgggaggctgaggcaggagaatcgttttaacctgggagccacaggttgcagtgagcgagatcgcgccattgcactccagcctgggcaaaaagagcaaaactccgtcacacacatacacacacaaataaaatttaaaaaattatttagaggtcaagggcatccccagatagaatgcagaatgtaacaaaaggatctaactacattacaagctctctgagggtgaggaggatgggaatgctgaagtaaggaagtgctaaagcaaagcaaagcaaaacaaaacaaacaaaaataccccaaaacgctcagtgatgaggatatgtcagggacaaagaaaccaaatgaaggagttctcaacaaaagctatagcaatttgagcaacagaaaaaaatacagtagtattggattataactcaaagtataaataactacgaattcatacaaacaataaatgatgtgtaaatcaataaatgggaaaaatggataaatattctggtcagaagaagtccaaatggcttatgtggatactctgccctcagtgagatagggcataactccttgttttttaagtatgggctgtgcatagggacctctttccaaagactgccatatgtgagttgactgagtgtcaacttgattgaattgaaggatacggggtgttgattcctatgtgtgtctgtggggtgttaccaaaggagattagcatttgagtcagtgggccggggaaaggcggacccacccttaatctggtgggcacaatctaatcaactgccagcgaatataaagcaggcggggaaacatgaaaggagagacgggccgagcatcccagcctgcatctttctcccgggctggatgcttcctggcctcgaacactggactccaagttcttcagtttggggactcggactggctctccttgctcctcagcttgcagacagcctgttgtgggaccttgtgatcctgtaagctaatacttaataaactcccctttatatatatgtatatctatcctattagttgtgtccctctaagagaaccctgaccaatacaccatatgaaaattgaaaaaaaaatcgagtaactttgcagtggagaaatttgacaaacactaccccagccaagcaatcaaagtgaaaatgaacagcgatatgccttgttgataatatgtcattgaaatggtgtgacgaaaatggcacttttccactgtggtcttctccagaacacataacctcagtctaatcatgagagaaacatcaatcaaatcccagttgagggtcattctacaaaatacctaacaaggacttctcagaactatcacggtcatcaataacacgaagaccagaaaaactgtcacagacaagaggagtctatggagacaggacaaccaaatggaatatattattgtggttgggatcctggaacagaaagaggatactagagaaaaactaaggaaatctgaataaactgtgggctttagttaatactatatcaatattgattcgttaattgtaaaaaatgtaccataggaatgagaaatgttaataataggagaaatttgatgtgggctgtatagaagtctctttactatcttagtaattttttggtaaatctaaaactattttaaaattgaaagcttattaaaaataaatttaaaatgtgattgataattaaagtcgtataattatgcagctgatgctataattaaactaataagaagaatataattagattcacatgtactgatatggaagaaagccaaagatacattatgttaaaaaaaagcaaattgcaaaaacatcgattgctgtgacccactttatgcaaaaatgtgaacacatatgcatacacctaaatagttgaagaggtacacactaaagtatggttacttcaaagatagcagtaacattgaggtggttgtaaaaaatggagtgaatgtgggcataggcctttttttctatacatttctcttatttgaatattttataataaacatgtatttgtagatacgtataagttctttatgatttaaaatgcttttcttagatatatcttaacttcttttgctaccaagtctgccttaatccattattccctttcattaatgtaacatcaagtgtcttctccaatgcttctttttgctaggcacgtaaacaagactaagtttctcccaggttaaagaggaaaataacaaaacaaaataaaacaaaaagctaccttatgcctttcagttaccccgtattttttttctgccaaatttcctgaaggtgttgtctatggtcattatttctacttccctatgtagctttctctgtcagttcactgcaggctgtcttctgcctttacctctctactcaatccagtgtatggcaaccttcctgacagtgtggtggagagggtaaagctctgggcacatttgggctctgtgtctgagaatttgcatattttgctttactttcctaatctcaatttccttacgtctaaaatgaggacagtatccttcttgccaacttctagtatagaaactgatacataacatatttttaaaaatattgatcagatgatctaaaaagcaatctcgtcatagcatcatggcaaagatgtaatccctcaccatctttcctctagattcttgcggtggtctactagtgttatagatgaactaacctccctaaagagtctcagtgtgtctgccctcacaacccttcaaatctctgtcaacacaatatccagagtgggcccattgaagcctaaaaaatgtgcatgtctcctctcctcagaaccttccagagcctactattgcacaagaatgtgtttgtgtagtgtttgtatggcatgtgtatatgtgtgtgtgagagagaatgtgtatttgtggaggtaatcctaggaatcaacaacactggagtggaaaactatggcagggaagaaaggaagccattaaagttttgttatcaagcagcatactgctgtgggcaccaggtgcctaggctcagtaggaaactcagaagggtagggtgaatatgacccagaggagttccaaccaaggttctaagaagctgagaatttggtccacactatctggcagttattggttgatggctgctttggggaaggatgtggaaggaatgcattactttctaacatgtccaatctactttatctttaagcctggcaaactgtagcagccaaagagagcgctcagttgaagacctgtcaatagggagcatacccaagaatggtgaaagccaaggagatatggatgggttgctgacagcatctactaaaatgtcttcttttcaaatatctaatgtatttgtatttcctttttaaccctatgcatcatgtaaggttctttaggaaatagaaggcatattcacaggggataattaaagagaatttaacaaaatggctatttataaatatgtaagcagttttcaagaatttcacaagttagaagaaagctagatggactaaagctatttccattgtctaaaggagcaagggtagggaacagacacttgaacctattagatgtggctttaagtaacagaaatcaggcaccgccaagctacgcctcagcagggaaggatcctgagaaatcacactcagattgatctctcctccaacctctgatctgctctttgtgttttgttggtcaaagcaataacaagtcagagtatagaaagtgaagcagtactgaagagtcagtggccagagctcaaagctcactgaagtatgagaagtggagccagaggagcaggtggagaatattcagcatgactagggcaatgtaagttgtaagagagcctgatttttgtccccctgtttcctgcactatcccctacaaatagaacagtgcctcatacatagtcagtactaaatagatatttgttgaatgtttcagtccattcacaatacttttgctattcattgtaaattattccaagattgcacttcgtttaacttttgccttccaaaaagtgcaaattgatatctcgatattgtgaatgaatacccttaaaatgtttaagtgcttcatcataggggagtgtcacagcttcgaataatcgtgatgtaaagactggttttttaaaaaagtcgtcttctcttgtaactcaatatttccatttcctcttctcgatgaagcaataaaaatggttttcctgagttgccagataaagtccttattcaaaaactgtttgacttccatgaacccaaaataattccacttgataaagtatattttattagtatttaccatcaccttaaggaaaggcatatgtaggagattgcctagtgctgatattggaggaccatatatcagaaaaacatatattaaattacacttgatcatttctatatttctaacttgagagaatatttctgtcagtcagtgattcaggatcctgtatttaattagctgttaaacatttattacaatttttgattttgtcattttttattaaaatagttttaacaaacatgattcattgaaaataatattctcatcccacgttaaagatagttttctacttttattttttctactcaactctttttaccttatattcatcaaagaaaagtagaagtaaacgtatccccccaaaattcatttctacttgggctctgtgaatttgactttatttgaaaataagatattttcaaagataatgaagttaagatgaatttacactggattgctaaagatctgaaatccagtatgactgatgttcttataagaagaggggaatttagagacagacacaggcacatagaagagatgcgtgtgtagatggagacagaggttggagttaggttgccactggcaagagtaccaaaggttgatggcaaccaccaaaaactagggaagaagcatgagctcgattttccctcagagcccacagaaggagccaatcctattcacaccttcatttcaaatgttcagactccagaaccacaagagaatgaatatctgttgtttgaagtcaccaggtttgtggtgatttgttacagcagtccaaggaaatatatacagaataaaatacagtaccagatctgttctcatccactggcaaacattttttggaatattaaatctggaaatgaagagtggattgccactttcttttttttttttttgagatgaagtctcgctcttgttgcctaggctggagtgcagtggcacaatcttggctcaccgcaacctctgcctcctgggttcaagtgattctcctgcctcagcctcccaagtagctgggattacaggcatgctccaccatgcctggctaatttttgtatttttagtatagacggggtttcaccatgttggccaggctggtctcgaacacctgacctccagtgatccaccctgcttcggcctcctaaagtgctgggattacaggcgtgagccaccgtgcccagccaattgccactttgggagtatcaagagtcggcccttattagcaagtatttctatctgcccgtttgggttgagcaaaattagaactgacaacggactagatgcttctattaccagtatttcaacctccagaggatccagataacagttttcaagtaactctcatagtagcctaagcttacttaaactctgaaatgaaagaatagaaatagactcaggatgccaaaaagtcatacatttatgatttaaactcatcaaactgaaatttaaaataaaaattatcttgaaaacctgctacatagcaaacactgtgttaggttctgggaatacaacatcgaataagacaatttccctgacttcaaggaatttgaagtatgactgtaagatacaatgaaatgtacaatgaaaagggaaacaggaggctacagaaataaaatgaggcctatcatatttagctatatgctgaaggcatttgcaagtcgttgaggagtttgaagttgggaagcaacaggataaaatttgttgtttagaaaacagcacggggtagagtggagggtagtttgggcagatgcaagcctggaatgactgggagatcagctaggccagtatagctgacattctgagaaaaaggtgaggtggcttcacatagagttagcaatgaaaaaatgaaagtgaaaaaatggacggattacaaggatgtttaaatggttaatcagcaaagtttagggatttaattgggggtagagatgggaaggaaagacagtggggagggaaaggcagattccagttagtggaagttagtggcatcatggtgcagttttctctaggcaggaggcccaagatgaagggcagggtccaggtacacaacggagaggcaggtacaatgggctacattcaaggaaacagattttctgttatttacattcaagttatttatatacccacccactcacagacactctttttttattctttcaaatgaattagcctactcctctctatttatgaacagcatttggttgatttggctcattatttaactaaactaagttcagtcaactttcaaaaatagcaaaaacaggccaaagtgggaggatcacttgagaccaggagtttgagaccagcctaggcaatatagtgagacccctgtttctacaaaaacaaaacaacaacaacaaaaagtatccatgcctggtgttacgcatttgtaatcccaaattacaaaggctgaggacagatgatggcttgagctcaagtgttcaaggctgcagtgagctatgctctcaccactgcagtctagcctgggtgacagagagagaccatgtctcaaaatttaaaaaaagtatttcttgatattacacagctagatattttcaaaacataattaacaaataaaagaaataatttgaggtaattgtaaaagacataattttaagtaaaatttaaaaatcttcacgaatattccttgctctcattagatggtgaatatttaaccgaactttgcaggtgatggcagagacacaggctaataataaacatgatgacttgaagtagtaactcaatttattattttaatatatattaaagttaagtatgataaatttatttaaattaaaagaaaaagtcatatttaattttgtggaaatactaagtaaataaaaagtgtaaacattgttccagaaataaaactgcaaccctttaatgatctgatcctaggcctcaacctggctctcagttctaaagtcttttcgttctaagtgtttgctctaacactggatccctgtgtgttttactccaaatgcagatcccagggtacaaggatgagacaaattgcatataatcaaaaggggaaaaccaataactatgactaaattagagaaacaactggcacggaagagcgtgagtcagaactactagttttctagttttttcttttaattcaaaaattgaagtatggacaggtgtattctgtgtcctgtgaagctgtggggcaattttaaaggccatcctttcagtagtgtcaacactggtaacctcaatgttaaccacacgctctgcacaatgaatacttcaaattttccaagacaagtctgcagaaaacaggaaatggattcttcattctgcacttttttatttctaaggttacattcttttaacttttcagactgttactacagtttatatcacatactgaatgtttcctagaaaactaacaaagttgagatcacctgaattgcttttctattttcctgcacactggtatgaatcatacttctctaagcaaatatgttccttaatgtattacttttcttactttgaaaactctaaaactacctactctaatttataatatcacagaactttaccctgtgtttactatacatttacctcaattttatcatttttattctacatacaaccctcatgagattgtcactgtctttcttatcatctgtgtgagcattagtcatgaggctggaaacttcttggggtaaaaaatattccaatattcataattatatcggctagcttccagcatcatacatgacatagggattttatctgttgtttgaaattgacagagccttctaaaaccatataatcactcattggcttggcactctacatggcaatatttatcaatgactatgaagtgcaagacacaatacaaagtgtatatccaatcttatagagagcatttggggacatctatgttgcaaaatttagagttctctttatttggatttgagaatgataatgtgacatgtatgctgttttaaagccacacctgttccagcactggacagcaccacgttttgcctcccatgtttccagatcatgttttgccaccaaatgagttcaaattgtgtcaagtgttgttgaataatacaatatgtaaaaatctagttttaagagctggtattttggttttattgttgttgttgctgttgtttcaggattttaaactgtggaacacattgtcagtgatccaaagaaggaagagataggcatttcaggaaaatgacataaagtgtaagaaaatagagatgagggaaaaaaaaaaaagaaatactttagaaaagacatgtaatccagagagctgggagcgtagatcttgggaaggggtcaagtgcattacagctggagcaaggcatcagggttgaattataggagatgtatgttttgctcctattttttttcctgctttattgagatataattgacaaataaagttgtatatgtttaaggtatacaacatagtgagttaatatgtttatgtgctgtgaagtgattaccacaatcaagctaattaaaacacccatcacctcacatagttactcattttctgtatgtgctgagaacacttgagatctactctcggcaaatttcaactctacaacacagtgtcattaactatagtcaccatgcgtacattacatcactcgaacctattaatcttataactggaagtttatatcctttggtcaatttctcctcattctcccaacttcctagcccctggcaaacaccattctaccctctgcctctgtgaattcgacttctttaggttccacatataagtgagaccatatagtatttgtctttctttgtctaccttatttcacctagcataatattctccaggttcatccgtgttgtcacaagtggcaagatttcctctgtttcatagctaatattgtactgtgtatataccacattttcttcatccattcatctgttggcagatgctttaatctgtttccataacttggctattatgaataatactgaggtgaacatgggagtgcagatatctcttcaagatactgatctattttcctttgcatatataccaagaagtgagatagctggatcatttggtagttcactttttatttacttatttatttttaaggaacctccgtatggttttccataatgaccatacccaattaaactctcaccaatagtgtacaaagattcctctttctccacacccttgccaatgcttgttatttcttgtcctttttaaataataggcatcctaacatgtgtgaaatgacatctcattatgattttgatttgaatttccatgaaggtttgtgatgttaaccattttttcacgtacctattggccatttttatgttttttttagaaaaatgtcattcttgtgtacatgtaccctagaacttaaagtataatggtaatcaaaataaataaaataaaaaaaggaaaaatgtcattccagtcctttgcccatttttaaccaggtttttcttttgctattgagttgtagtttcatatataatttggatattaacctcttaacagacatctggtttgcaaatattttctttcactccctgggttgccttttcatttgcttgactttttttttttttgcctcttccagagcaattaaatacactattagctatgctagtccttatttattcatgactccctatctctagacagaaaactctggggaacaactggcccctatatcctcccacttactagatgtgcatgttctacagacactttaaattcaatttgtctaaccatattcatccattaatttaataagccattattagccaatgtataagacattggaggttcaatggtgaaagtcataccaattgcatttttggtgcaattacttcaataatgtaattattacattacaaaattacaaaccgaagcatactctgatggaaggaatgaatgtccttctcagagagtatctaagaaggtagcttttccacatctggtggggctgatgttctctgaggaagtgaaagctgatctgggatatgagagtgaaaaggaaaggaaggaaggctaccagaatggaaacaagcatgtgcaaaacccctgtggcaaggcagagtggaaggaatcagagaaagtgaaagaaacccgtgtggaaagaaagccaaggaaccacagcttgtatatgaaaccatcactgttagccctctagaagccttctgtctgctcagccccctttcttccactgaaggaatagtaactacactgttcaaatatttatggcaataattccttattatatttagttaccactcttaagaatttccttttaagtttatataaatggaaccataaagcatatagtctttgtgtatgattttacctacagtacattttgttttccaatttgtttgtgttcttgagtcgcacatttcattcattttggatgctcgagaggattctttgtttgaatatacaataatccatgaacctaatgctttgatgatgaacatttttgatgtttctgtgtttctagtgatcacaaatcatatatgattaaacatctaggcacacatatgcacgtcatttctctagaataaacagcaatatgtatatatatttgtatatatatatgaacatgaacatatgcaaacacaagttcatgcataatactaatataaaattatgtactattctatctcctttcacatattttctgtttttgtctctcttttcatcattattgatgttttcttcttccctttcttccatttaatgatctctctgcatcttatccattgaattcttagtttaggctatttcacatattacattgttttagttctagaatttctattactttcttttctgaaaaatctgcctgacagatctcttagtctacacaatctaacacgattttctattatgatggaaatattctataaatcagtattgcacaatgcagtattaaccaaccacacatagctattcagctcttgactaaagaattgaatttttacttttatttatttataattatttcaaagttaacattggtagcaacttttatattagatagaaggtcttctatgattctattttcaccatccacttaaacttaaaagaaaaaaaaaaacctaactcactcaggggaggcatggtggctcatgcctgtagtcacagcactttgggaggccaaggcaggagggttgtttgactcaggagtttgagaccagcctgggcaacaaagtaaaatccgatctctaatcataataatataaataattagctgggagtattggcatgcgcctatgctcccagctattagggagggtgagatgggaggatcacttgagcctgagagatgaaggctgcagtgagacctatcatgcctctgcactctgacctgggcaacagaacgagaccctctctcaaaaaacacaaaaaacataaaaactaaaatgctcaattggaaaaatttgaaaaaaaaatagacaatcataatcaattaagactcaattgtcaacactcatagtgtataaattatatacactaaatgagattgtgtgcatactatccatatctacacacatacacataaacaaaataaattttagtaatgttagtttatgtattttatagcctattttttcaaacaatatttataaaataattttatggcattaaatagtgtctaaaatcatagactgtaatgactgtgtaagattttactcttggttctataataatattgtcttattactcgacatttagacgactattttgatactgttgctaacatgattatctctagctgatttcttaggattattgagataaaagtaggattgctggaataaaatatccaaatattaaaacatttttggtatttattgtcaaattgtttttcggaaaagttataccagcttgaattgccattagagtaagataagaatgcagtgtgaatttaagtcctgtttctcctctaccttttcctatctcctctctttctgtatcaccatatgacatttgtcatagtcctgttcttcttcaatatctttgttccataacctctgttttaaaggttccctctccccattccatgttcagctctcctgtcttttttttttttttctgagacagagtctcgctctgtcacccaggctggagtgcagtggcgcaatctcggctcactgcaagctccgcctcccgggttcacgccattctcctgcctcagcctcccgagtagctgggactacacacgcccgccaccacgcccggctaatttttttttttttttttttttttttttcagtagagacggggtttcaccgtgttagccaggatggtctcgatctcctgacctcgtgatccggcacctcggcctcccagctctcctgtcttaaatgctaaatctcacatccatatttccaatctgtcatgtcttccaagatcaagttccacttttccaacatgtctgctatatatatatatgcgtgcttgtccctactgactctcatcgcatctagagctcaatttttaacattatctcttcccccagcctatcctaataactcaactccccatgtgttcagatttcccttttctgtaagcaatcctattgtcacttgagcacaaaactcccactctttgtcgcttttcctttatctcacaaatgccgacagtcatcaagaatgattaaattttcattcgcaatatgaatccaagacatgtcttcccttgcatactgctgcttccatgctagaacaggcctttatcaccatggcaattttcttttaaatactgttcctgcatttagactttccttccattaatctattctactcaatgcttctaaactaatctactcaatttatcattttgagggtaccactgtcttcatcaaaagtcttcaatgtccccctgttgtgttgtaagcaaccccaagttgcataatttgtcatttatccatttgtcttgccagccagccattcaaaatttatggagtgcctacatgattttttttcctttggagaactgctggctactggaactactggcccttgcttaaaaagggtgtgaagtgcctgggagtttatatccccttgagatttccactaaccagtgactgaaagatactgacaaaagcctcacatccatagtctgaattataatagctctgaagcttagtttacactccagtttccctatggaatcaggcgaaaggctgttcttgggctttgcacggcgatcacactcttgcctgacttccttgtcttccttgccctacttcactggttgccttatttatctaccctggagcccttccttaataaattatttttatgtgaattcttctcttaggttctgcttctggaaaatccaaagaaaaccacttttgttaagaaccaaagacatgatcactactgcgaatgaactcacgctgagtagaaaaatagacatgcaagccagcaatttaaattttaatatgctatctaccataatagtgggatttgcaaagtcctgtgagatgaggaaagaataaatacctatctcaggtaagggaagtcggactggaaagtcttcccctaaagtaatatctgatctgaaattcagataagatattttttttaggcagaaataataggtaaactagttataacaaatagtgtgggaaaaatttaatgttataagaacatgaaattcttcaggaactacaaataactcaacgtactattatcagaggcaatatgtgatacaagaggggggagggaactgattcgaacaggtgagtaagatggccgaaatgtgaattcaaaacattctctgagtgttgtaaaaagagctcatctagtttatctgtcaaagatggcaaacaatatggagaacccaggagggcaatgcctttgattatagagttgtagctattgctctggcagtattgtggaggactgcatgtggaatttgcaagtagggctagtctggagaaagaataatcagaaatcaaataccatggtgagcacaaagggctgagaagagagataatgtgagatattagaagaagaaatggcagtagttggtgattgattgggtctgtggtaagattctaggctttggatcaccctgccagtcaccaaatctgatagaatttttttgacttactttatcaagatagcagcattttccttccttcttcagcttcctgtttgattgttttgctaacttttgtacgttttccaaattatccatattgacaacatattattcttttacttgcaaagtggagtaggtggtaaaaatgaaatcatagcatatagacaacttactagaaattattgagttaatcagaaaaagcatgctgataattaaaatacatgtgaaaaaacgtccaacctcaatcataactgtttaaaaaatgtcaattgaaacaatatcagattaacaaaaattttagttgtaaaacattcaattttagcaaagataaaggaaagaaacatgctaatgcaccacctgtgagactataataggtccaaatttttgaagagccattgcaaatatctggcaaagtaaaacactcacttcctttcatccagcaatggcaccactaacaatttacactaagaatcaatctagatgaatatatatgaagatgcttattactgtattatttataatagcaaaaaagtccattaatataaactcattagctatactataaaatgaccgttccgtggaatattatgcagatgttataaagaatatgttaatataaatgtggtcaataaatattgcattacaaaaagaagagtagaaattgagcttgtagagaataatttcatcaccacttaatgagaatatatatacactgaaaatttctgaaaggatccatccaaaactgctaacattatttaccactggggcttgaaaatgatggagatttgctcttgtcatttatttttttccccaagaacaacagtaatttggcgataaaattaatggaaaggggcattaacaagataattgagggacagtgtttagtttttacatgtttgtggaaggagatgaggaattaaaactttatataattctgttgaaataaaataaaaataaaatccttagagtcacaactctaagaaaggacaagcacttacagataggaacatagacgctaaccccacatcctgtaagtgtcaaaccaacgactaggattcagctcccctgacccttgccccagtgctctttctatgatcctaagcgatagtatatctatgcctagaaaatcaagccaactgaggtggaaaagatctctgccattatttctgtcttctccgaatatacgggactgattttgagttcataaataaataagaaatgttgaagggttgtccatgggacactaaagttccactgtattctcaaccagaatttcttaattcagtaccattgctctaaaaggatgctttctcaagcactgaaaaatatggttccatttatgtccctaacttaagggaagagacattttgaattggaggcaaataatctatgttgtaacacttcaaagctaggtcaggaagcttatgctaaatgccttatgtgtacttgtgacttttgtattctgaccctgaatgtattacacagataagctgacatgtctccaataattttcctcctaagtacggtataaatgaaatattagctcatattatctcggcaccccaccaactgatcagtttgttgctataaagtgcaaatgcccaatcatataaaattccaagcattgctctgttgaaaatgagaaggcatcactagaatgtgagtgaaaagaatattatgtgcttcccttttctatatgttagattgcttcacattgaaaaaataagttcaatctgggaggctgaggcaggcggatcacaaggtcaagagatcgagactatcctggctaacatggtgaaaccctgtctctactaaaaatacaaaaattagctgggcgtggtgacgtacgcctgtagtcccagctacttgggaagctgaggcaagagaatcgcttgaacccgggaggcagaggttgcagtgagccaagatcataaatagtcttcactccagcctggcaacggagagagcctccatctcaaaaaaattaaaaaaatagaataaataaaatataaaaaataagttaaataacatactacccaaaaacttgtaaattactttatccatctacttctaggaaattacaaagaacaaatttcattattttagcataacagggatggattttcttttgtaatgttcaatatattaacgatagattttttttcctagtgttctttaggatacttcctgcaatacttcattcaagttatcagtgatttttactatgtattgtaaatgatacatagccaccatatataaatatttgctgaattcaagattactacgttaagaaactggggtaaataaaatggaaacaagacatccgtgaatatttaaggatataatatcgcaattgcatgtttctgctggcttttcatgatataataaaccttgttttttcttctaatttaaaaaatgctatcaataataaaaatgctaattatacataatcaatatttttatacatatatcaattcttacaaatgttctaattgcagtttagtaaactgatgtgtaaatatactttgtaagacagataattttttttctatttgtaggtattttatttttatgatattgtaaataatatatttttaatttttttattatactttaagttctagggtacatgtgcacaacgtgcaggtttgtgacatatgtatacatgtgccatgttggtgtgctgcactcattaactcgccatctacattaggtatatctcctaatgctatccctctcccctccccaccaaccccacgacaggccctggtgtgtgatagtccccatccaagacagacaattttataagaagattaacttgaagttataagtagactagtgaattaaaatttccatttcctatgctgcagagcacttttaatgcaatttggagggagaacattagtgttcagcatttataatttatcatttgacatttggactaaaaactctatttccaatactgcacatgctaccataatgcagggttttacaaagagattagcgtaattcaatggttaatcatatttcaaaaaggagctatattgtggactttatattcccctcatagttgcttctggaagggatctcatttgttactccttctcagcattgggttctattcagttcttaagtgaaaacgggaaaaaatgctaccctatactgaagcatttcaacacaattggaaacattatgcatgattttcaatagatgaggatatacatttacaaagtattcacaaaaagatatttttggccaaatttgaatttgttgaaagaaagtacatctctgatctacttttttagaattttctgggtttcaaggtctttaacagaggtgtgtacgtatgtgtgtgtgtgtgtgtgtgtgcacgaaaatgtactgtgttcataaaaatgccactgttggtgtttccaaaatgaagctactacaaaatacagaattggtgtaatctagagagggagaggaattgataatgcagagagcactttgaaaataaaactgtggaaaagaggccacagtatggaccagaggtaattacccgatcactaaaaaagagagaagagaaagaaaaatacacaggaaaacagggtcagagaggcagaaagtgaaaaatcaaacagtatatttggcactgtagagagtaaaagaatgagagattttccccctttctgttcatgggttatgaaattgaggttttccatataattaagaaaggatggatcttggcgaagggcatattgtcatctatgagagagctgcgagaagtgtagggaagattggagaagatggctgacattgctgctttggggtagttgctctaaaacttctgccattcagccatgcggatgaggtgagcaggtatttggggacatgtgtgacacttgatcacatgtaacaataatatatattacatttagaacaatttatatcataatttatgtgtggaacaggatgtagctcaacaatgaatattcagaaactttacctaaaagccaattcataagttattctaaaattgttgttaacctggtgggtgtattttctagggatttcaagtgagcaaaaattgccaagaaataaaatccgtcaggaataatgtctgctttgcctgtgaatcatagacacacttaagaggcatttaacagtttagttagagcaataaatgatctttgctttaaaattgaaaaatgtgttttctttaaactttggtttcattttcttaggcgtttattcaaataatacatatgtgtgaatgtatgtgatttttagactataaaatactttgaaactgttagataaatctttgctaataagacatttcgttatggaagaattttgggattccttttgctctcagtattgactactgtcattgtagaagttctgacaatatgatgattgtatgaagactctgtgttcaaatgcatcatcccaaggcactgaaaacatattttcatgttcttgttttatcatatttatgtataacggaaatgggaagactgaaagatttcattatcacaattttggagggcagagaaaataccgacaatctgcatttccaggctaagtttaagctattcagaagccaaaccttctcactattcagctggcatatcacattcagcgagaaaatgtttcagttttttcatagctatgtttaactttaaataagagattacataattaatgctaaaactgcctgtcactattatattccttaaggttttccattctttcttagcttaagtcctgatttttattttcattgttatcattgttatttttcttttcatagaaaagtactacttagctctataatcttttgtttgagattaagggatgaatatttttgacaaaggaaaaatatgcttgaataagtttgtggtcttccgtgaaggtttaaccttatagagttggattttttacatttttgataatagcaatgattacataaaccttatccaaaaattgttataattattgagattaattttgaatcaattaaaaagtttaaaaataaatattatttgaagtgtttataagatcagaaaacaactgaaaagattcatggttatacatcaataattgcttatagtgtaaatgaaaacatttgttaatttctagaaatttattgcatatttgattctactttccaggcaatattcccacattttaagtttgtcttcatttcaataaaactgtatccagaaaattaataaaactataatttgaatgtacaaaaatttcaaataatgactccatatatgctcaggaagtttaatgtcttgactttaatcataccaaagacttcttatattaatacaattttgtatatatgcaagggtttcacttctgtatgtaatcaagaactcaactaagctgtttatcctctccatgttcttccagaacattctcccttaaggatctaattcatggttacttcttactctatttttaaatttcaccatgattatgcatctcatttacattttatttcctgggtctttcctcacctctcaaaaactacccagagagcatgatagcagccttttcttgacttccacaccttacacacacacacacacacacacacactcttactttcacaaatatgtgataaggggaacagtgttgctacatttatattattcttgacagatgaaactgggcacctgtttgctgcatatcataggcttggccaacatcaggcagatgctgcccagatggcctttcttcatctagaaacatggagccatgctggccatctcactttcctcgcaccctcaacctaattgtccccaggtcccaatcagcagttgaatgcatttcctttccttcattttcctttctgctatccaggcatttgtcctcttggaaagcaagacgaagccttcctacctcatgcttaatctgctccagtggcattagcctaccctcattcctcagagagaacagatccttcctaactcagaatttcacacaaggcacgtacccaggagtcctcgccactctattccaccccatgtcccctcatattcaatagccataggctttagtctagaggtgacacctctgggacaatgtacctgaagccctagacaaggagctttgttatttgccatcacatattctacgtttttctacatgacatttatatcaataatttttgtttaaataatttttaatattttagtccctctcctcaacatacacgcttctaaaaatcagtgtgttgctcactaccaatttccagcacctagcacagtccttagcatatggttggaactcactgaatttcagcattataacgaaatgaattaaatggatgttgtacacatgtgtgaggagccatgtggaatgtaaatggcagcatacctatgtgtaaagttgtcagaatcaaggaaatggagctacattgggagccagaaagctaatccatatggatgtcaaggagatgaggcttgagacacagagcagtgagcaatgtgagggatccaaagggtagggaagtcccacaggaacacaggagatgattcaaagaacccgtggttgtcctgaaacattgcttttcttcatgggctagaggacttccttggcagagggctgaagacaaatgcgtgcaaaagtgctttctctaaatgtctcaccagcttatgttttcaatgtataattccagaactatatatcacccatctctccgtgctgttcagttcttttcatcctgctaaatcttttctgcatctctatttagatgatttctcattctttccatctgagactgatggttatttccatgtggggatgttacgaagaagagtatttagggtctagttagcaaaaacagaccatagaatttttttttaaggtctgcccagcatttaagaagatatcagcctgttctccaagtgtccagtcctatctcgtgtctaccagcttttagcctttttctaaggataagctctcgcttttcaaattctgtgtgacatttttaaggccacatacatgaacacattttcatttattccatcttgcagtcctgaagcagtaacgtgactacctgttgcagcaaaaaggctgctccttggcctgatctgcatcttccggggaacttgcctggcgatctacgatccatcaaattttccccttagtaaatctcagaaaaagatcacccataagcatagcacaggggtattctgaggtttgactagtatttcagagtgctgtagatcctaagatgaaagtagtaagaaagttgaaaaaatagtattatttattcaacagacatgctagaaatctcagagcttccctagtccctattttctgtcctaagcatgtaacataaaaccctgcaaaatcagaactgagttctctgtaaagacattcagaaataaacaagaccaaccttgaagggggaggccttgtaatccatggtttattcttcttgttatggctgatggcagcacctagattagagtaggtgctcagccatggattcactgaaataatgctttaaaagtatactaatagagaagaaaagagagaagaatcaaatagacacaataaaaaatgataaaggggatatcaccaccaatcccacagaaatacaaactaccatcagagaatattataaacacctctacgcaaataaagtagaaaatctagaagaaatcgataaattcctggacacatacaccctcccaagactaaaccaagaagaagttgaatccctcaacagatcaataacaggctctaaaattgaggcaatagttaacagcctaccaaccaaaaaaagtccaggaccagaaggattcacagtcgaattctaccagaggtacaaggaggagctggtactattccttctgaaactattccaatcaatagaaaaagagggaatcctcccgaaatcattttataaggccagcatcatcctgataccaaagcctggcagagacacaacaaaaaaagagaattttagaccaatatccttgatgaacattgatgcaaaaatcctcaataaaatactggcaaaccaaatccagcagcacatcaaaaagcttatccaccatgatcgagtgggcttcatccctgggatgcaaggctggttcaacacacgcaaatcaataaatgtaatccagcatagaaacagaaccaaagacaaaaaccacatgattatctcaatagatgcagaaaaggcctttgacaaaattcaacagcccttcatgctaaaaaccctccataaattaggtattgatgggacgtatctcaaaataataagagctatttatgacaaacccacagccaacattatgctgaatgagcaaaaactggaagcattccctttgaaaactggcacaagacagggatgccctctctcaccactcctattcaacatagtgttggaagttctggccagggcaatcaggcaggagaaggaaataaagggtattcaactaggaaaagaggaagtcaaattgtccctgtttgcagatgacatgattgtatatctagaaaaccccatcatctcagtccaaaatctccttaagttgataagcaacttcagcaaagtctcaggatacaaaatcgatgtgcagaaatcacaagcattcttatccaccaataacagacaaacagagagccaaatcatgagtggactcccattcacaattgcttcaaagagaataaaatacctaggaatccaacttacaagggatgtgaaggacctcttcaaggagaactacaaaccactgctcaatgaaataaaagaggacacaaacaaatggaagagcactccatgctcatggataggaagaatcaatattgtgaaaatggccatattgcccaaggtaatttatagattcaatgccatccccatcaagctaccaatgactttcttcacagaattggaaaaaactactttaaagttcatacggaaccaaaaaagagcccacattgccaagacaatcctaagcaaaaagaacaaagctggaggcatcacgctacctgactttaaactatactacaaggctacagtaaccaaaacagcatgctactggtaccgaaacagagatatagaccaatggaacagaacagagccctcagaaataataccacacatctacaaccatctgatctttgacaaacctgacaaaaacaagaaatggagaaaggattccctatttaataaatggtgctgggaaaactggctagccatatgtacaaagctgaaactggatcccttccttacaccttatacaaaaattaattcaagatcgattaaagacttaaatgttagacctaaaaccataaaaaccctagaagaaaacctaggcaataccattcaggacataggcatgggcaaggacttcatgactaaaacaccaaaagcaatggcaacaaaagccaaaattgacaaatggggtctaattaaactaaagagcttctgcacagcaaaagaaactaccatcagagtgaacaggcaacctacagagtgaacaggcaacctacagaatggaagaaaatttttgcaatctactcatctgacaagggctaatatccagaatttagaaagaactcaaacaaacttacaagaaaaaaacaaacaaccccatcaaaaagtgggtggaggatatgaacagacacttctcaaaagaaaacatttatgcagccaacagacacatgaaaaaatgctcatcatcactggccatcagagaaatgcaaatcagaaccacaatgagataccatctcacaccagttagaatggtgatcattaaaaagtcaggaaacaacaggcgctggagaggatgtggagaaatagggacacttttacactgttggtgggagtgtaaactagttcaaccattgtggaagacagtgtggctattcctcaaggatctagaactagaaataccattcgacccagccatcccattactgggtatatatgcaaaggattataaatcatgctgctataaagacacatgcacacatatgtttattgtggcactattcacaatagtaaagacttgaaaccacgcaaatatccatcaatgatagactggattaagaaaatgtggcacatatacatcatggaatactatgcagccataaaaaatgatgagttcatgtcctttgtagggacatggatgaagctggaaaccatcattcttcgcaaactttctcaaggacaaaaaccaaacaccacatgttctcactcataggtgggaatggaacaatgagaacacttggacacaggaaggggaacatcacacaccggcacctgttgtggggtggggggaggggggagggatagcattaggagatatacctaatgtaaatgatgagttaatgggtgcagcacaccaacatggcacatgtatacatatgtaacaaacctgcatgttgtgcacaggtaccctggaacttaaagtataataaaaaatatatatatataaaaaaagatatagataaatgcaggtatagaacatattgctggattgtaaggtatcatttctcctgaaattgatatatacacaatacaaatcaaaatcccatcaggcttttatggtcgttttataataaattgtgaaattaggtaaaaaaaaaaaagaagaaaatgtggcacatatacaccatggaatactatgcagccataaaaaaggatgagttcatgtcctttatagggacatggatgaagctggaaaccatcattctcagcaaactatcgcaaggacaaaaaaccaaacactgcatgttctcactcataggtgggaattgaacaatgagaacacatggacacaggaaggggaacatcacacaccggggcctgttgtggggtcgggggaggggggagggatagcattaggagacatacctaatgcaaatgacaagttaacgggtgcagcacaccaacatggcacatgtatacatatgtaacaaacctgcacgttgtgcacatgtaccctagaacttaaagtataaaaaaaaagtataccaattcacagaaatcctccacacttccaattacaataaaactatccatctattactctaaaatttgtgaatattaatcattctatctttccagcttttcttctgcatttgtgacccctttgtactatttttttctgttaggatacagtcaagaaaactgaaatcatggtagtaggtactttaaagacggaattggttaccagatgttagaaggctctagaagttcttgagcaggagtaattatagacatcagtttaccttaaatgggcagaattcagatagataacaacaacaacaaaaagagactgtggaggttattcatagtggactaatttgtttggaaaaaataagtagctataaatcagtatattctagtatctttgagacaacaaatattggaaattgtttttcttttcttttctttttttcccagcaagtgctgtgtttattttccaaacaattttattgaaatgtcccaggagtagatgggcagcacaaatgtatgaacaggaaaaaaaaatcacatgtacaataatttttttaaagtgaaggttaatcttgggagatatcagttcccctctccctccccctgcagacttccagcgtttccgttaaggttaagcctctacgaacctagcattaaaaaaaaaaaaaaaaaaaaaaggaatacaagatcttttgcaaataacaaaaacaaaaaccaaaaaatggcataaaggaaagagaaataccttcctgctcagatgggactcttcctaggcacctaattagaaggcgtgctgagcggtggagaaacacaacttcagagtgtaagggtatggaccattgggtttttcatcaggtaatggttcaggaagcccggagtctccagggcatcgctcttggattcccattccagcagtccagaggagctgcgctcgctttcgcctgagaatactttcacagaagatggccgcttcactcccagctcatcatagatctcaaagaagttctcctcggtcgcctccagcggggcgttgaagaagtgcagcacgttgctggggtgctggatgcggttcttggctgcctgctctggggtggagaaccgattgttccgggattcactgaagtctttgtaactgcaagacccatcttccaacccgtatgactgaccgggcatgatggctggctgcttggagacacagacattcagcttctgcccaaacatgaagttgttgttgaggtgggtaatgacccggtccacagcgtagccatcagccatctccaccatggcgcccccggcttgcttttcaggaatttcaccttctccacattgccatacaagcagaagacattgaagactaggtcacagttcatcttagattgatgcaagccttagaccacgagcacagggctgtcggcgtgagggccatactcgggtggtgggggagggggtggggggtgcccatactggggggccgtagcgacttgggccccgacagtgacccccgactggtggacccatccttctcccttcgtagtgaggtcgggggggcccgtggccctcatcatggtaatggctgtggtacccaccgtggggccctccatattctgcggggtgatctcccaggagagggggctgcctctggcgtttgttggggttgctgccagggtcaccttgtccactgagattggggtttgtgtagtcccaagtatcctgatcattcttgaacacattcaagcgtgtaggctttgcgtattccatcttcagagtgcaacagccagaatagataccagccccattgagagaggccttggcccgctgggcactttgaacagagtcaaattccaccatcgcctgaactccattcttcctgaaaatgataattctctggacagggccacaaggattacagatagtgtaaagaacatccgtggtgatcgaataaatggggttcaggatggtaaagagaagcacactgttcacgctccgggagtcatccgagtccccggggagggagatcttctggctggtagagtagttgacaaaagctgggtgaccggcaatgtatatttggttgtcggctgcgtagctcacggcgttgcaagcccccaacacatcttcaaactccaccagtgcttgtctctttttaggcattaccaccgcatagctgatgggtccaaactcctgcaaggcctccacaaggtcagcttccaccacatcgtcaatcaggcccctgctgtggacaactggggaggcaggggttttgtgcaggtcatggtagttctccccgccgccgcccccgccgccccgcctcctccaccgccaccgccgccgccgccgcctccgtgctggtcgccggcgttgccagtcttgagccgcttaggggcaccgccgccctcactgccgccgccttagtagccgccaccgccgcctctgccgccccccgccgccatcttcatcgctcccgaccgcctctgctgctcctcccgctgctgcctctgctccagccgccgacgccgcttctcccaggaaattacttttccaagttagtttggtaaagtttaaaaggttggtgctttatcctgtagacaattgagagtagtttctgtatttaagaaggataaataaaatgttctgtgtgcagggcggattagaaatggaagacattggaagcagagagaagttaaggaagaatgttgacattatcttaaagtgttaagaacctgaacgaaactccttgcaaaatcattgccagggaatacagtgtagggccattgactgactctagtagtggatgaggacaactcacagagagaaatctgacaatccatgtttagcagagggaaggaagccagaaatagttactaataagtgcaagacttcagttttgttggttttttgttttttactcccagcaagctaaatttgacaataatgtagctcaatttctccccatctcattttgttaatctctataatcttgccccagaaaagccatttgtaccccagctcagaaaattctgtattcatttgtcttcataagattgtaaaaatttcaaaactgtctgttcatgataattagagaaatacaaatcaagactacaatgagataccatcttacaccaaccagaatggctattactaaaaagtcaaaaaataacagatgctggtgaagttgtgaagaaaaaggaatgcttatacactgttagtgggagtgtaagttagttcatccattgtggaagacagtgtggcaattcctcaaaagcctaaagacagaaatagcattggaccctgcaatcccattactgggtatatacttaaaggaatataaatcattctgttataaagacacatgcatgcatatgtacactgcagcacaattcacaatagcaaagacatggaaccaaccaaaatggcaatcagtgacacactggatcaagaaaatgtggtacatatatgccatggaatactatgcagccataaaaaagaacagagaccatgtcttttgcagggacatggatggagctggaggctattatccttagcaaactaatataggaagagaaaaacaccacatgttctcacttgtaagtgggagctaaatgatgagaactcacatggacacacagaggggaacgacacacactggggactttcagagagaggaggcagagagatgggagatcatcagggaaaataactaatgggtgctaggctcaatacgtggatgatgaaataatctgtaccacaaacccccatgacaaaagtttacctatgtaacaaacctgcacttgtacccccgaacctaaaataaaagtttaaaaaggaagtgaaaaaaactttaaagtagctcaataagttttatattaatgtcaactttaaataatttttatgcataatacgttattaaaattcatttacctttttaaaaaaagaatgtgaaattttagcagagttttcaacaacaatgttgtagttaacaagagaaaagcatccctgatgctttacaaactggtgtttcaatgaattagtcttttttttctgagagggaatctcgctctgtcgcccaggctggagtgcagtggcatgatctcggctcactgcaacctccacctcccaggttcaagtgattctcctgcctcagccttccagtaccagaaggcgtgcaccatgacgcctggctacattttgtatttttagtagagacggggtttcaccaggttggccaggctggtctctaactcctgagctcccaaactgctggtagtacaggcatgagccaccggacctggccaaaatgaattactcttaattgtgttctattcatttgtttttcctgcattttcatttcatttcactttgatgaaccaaccgaaatacccgatggaatacagtgacagcttgaaaagcttcatgttaacaaagttatcattccacagtagataaaataatatgtgaaagtagtgagaacttaggaattcctctaaaatcagaatttaaagacataccacttaccctttgttaaaatagcttacagcacagaagtcttagaaaatgggcattagagtgtcagaaagctagtcatgttagaaaaaacctttcaaatcaaggctagccacctcattaaataataaaatgaagaaactagttataaaaccggtgttccattttcaattttaaaaaaatgctgatggtaaaataaccattaatttaaaatatttttctgctcacttctagaaggtggagcataaaccacttaagtgacctattttagccccactaaagcaaatggcaaatattgggattggattaccaaatgtatgccttccatttcattggccatatatcttattgtttcatgcatggataatggcttttctccttcttcagtaacccaaaggaaaagctgacattctaacctggagctgcacattcaagctttgacacatgcctctcactggtttcgtctaatgcttataataaacctgtagagtcagcaactttagaaagatgggttgaagaagtgtctttatcatagtttgaatttttctctggggcacttggcagagtcacctctggtgtttcaaatgtgcttgaaagttatctggctgccctctgagaagtctgcataaaaactgctttacttaaaagcaggcaaaattaaggtttctgtaacaaaaccataggcatcgcattgagataggacaaagaccaaatatcctgcttccatgtggcagagaaataatgaataacttggttcaagagctcatggagtggcatatcatcacaccattattaatagagaacattgctaatttctaaaagggcttcatgtcatgattattttatcctcttctttctgttaaatttttaacatgtatgtccactgcaaagtacgcaaaggaaataaattagcactaaaaaaagggcttcttcacaaccgcaaattatatatatatttctttcagaacatcactttagagagaaaatagcaaaaattcagcatcatcactttttgacagttcactagccaatcaaaatatagaaaaagaaggagaaattaagtacatttgtattcactgtacatttttagctatttgtgtagaagaaaaacaattagcttatttaaaaaccctaaggtgagtatgcagtttttaattattatctttgctgttgtgatttatatttgtattttatttatgtaaaaaccagtaaataaacctatgtcaaatacttctttatttttgatactagttcaaaatattggtgacttttttagatatgaatatctcatatgtatcttttagaaattatcagagagttataaaataatattggggaggtaaggaaggcactagacataagaaacttgtatagacaaatactttgtcaccaaagttgtatatttaaaagtccctattctttgtctcttatcgattcaaaattaattcattagaaaagaattttcctcaacatttaatccctagttgttcatctttttcactagtttgtattccattactcattgcttcatagctaaactctgtttaaatctgttaactgaaatgattttaaaacgttttggtggagcgctgcgggaggtgcgtgcgcgccccggccgccgaacaaaggagcaggggcgccgccgcggggacccgccacccacctcccggggccgcgccgcggcctcccgtccaccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcaccggcgctccttcggcggcacggaggaccgcctgtcgtgcttcgcgcagacggtgtcccccgccgagaagtggagcgtgcacatcgccatgcaccctcaggtcaacatctaccgcgtcacccctaagcgctaggcgcacctgagcgcgccgccggccgacgagatcgcagtggaccgcgacgtgccctggggcgtcgactcgctcgtcaccctcgccttccaggagcagcgctacagcgtgcagaccgcggaccaccgcttcctgcgccatgacaggcgcctggtggcgcgccccgagccggccactggctacacgctgcagttccgctccggcaatgtggccttccgcgactgcgagggccgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatccggacgaggagaccgaccaggagaccttccagctggagatcgaccgcgacaacaacaagtgtgccttctgtacccacaggggcaagtactggacgctgacggccactgggggcgtgcagtccaccgcctccaccaagaatgccagctgctacttcgacattgagcggcgtgaccggcgcatcacactgcgggcgtccaatggcaagtttgtgacatctaagaagaatgggcagctggccgcctcggtggagacagcaggggactcagagctcttcctcatgaagttcatcaaccgcgccatcaccgtgttgcgcggggagcacggctttatcggctgccgcaaggtcggggcaccctggacgccaaccgctgcagctatgacgtcttccagctggagttcaacaatggtacctacaacatcaaagactccacaggcaaatactggacggtgggcagtgactccgcggtcaccagcagcggcgacactcctgtggacttcttcttcgagttctgcgactacaacaaggaggccatcaagatggacgggcgctacctgaagggcgaccacgcaggggtcctaagggcctccgcggagaccgtgcaccccgcctcgctctgggagtactagggcccgcccgcccttcccggttcctgcccacgtggcggctccttccaaccctccctgctaaccccttctcctccaggtgggctcccccgggcgggaggcaagcccccttgcctttcaaactggaaaccccagagaaaacggtgcccccacctgtcgcccctatggacttcccagtctcccctccgccctggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatctcttgcccctcccagccacctcctcccagccccccaggagctgggcacgtgtcccaagcctgtcagtggccctccctggtgcactgtcccgaaacccctgcttgggaagggaagccgtcaggtgggcgaggactgagcctcggtgtttttttgggtggtggctggaaacagcccctctcccacgtggcagaggctcagcctggctcccttccctggagcggcagggtgtgacggccacagggtctgcccgctgcatgttctgccagggtggtggtggcgggggggtaggggtgtgggggccgtcttcctcctctttcctttcaccctagcctgaccggaagcagaaaatgaccaaatcggtatttttttttaatgaaatattattgctggaggcgtcccaggcaagcctggctgtagtagtgagtgatgtgggtggggcgtctcagcaccctccccagggggtgcatctcagccccctctttccgtccttccggtccagccccagccctgggcctgggctgcggatgcctgggccagagcccccgctgtgattggtgcttcctgggcctcctgggtggatgaagccaggcgtcgccccctcggggagccctggggtgagccgccagggcccccctgctgccagtctcccccgtcccgtccccgacatgcatctcactctgggtgtcctggtcttttattttttgtaagtgtcatttgtataactccaaacgcccatgatagtagcttcaaactggaaatagtgaaataaaataactcagtctgcagctcccccccccaaaaaaactttttgtccattttttacctattccatttgacattggtctcatatgatatcatgatataaaggaaaatgaccccgcaatgatatgattcataattccactataaatttccttgatgctttgagagtgtgattgatttattttgcccccttccttttttttttttttttaactataaagcaggtacctgtacaataatgccatttttttaaactccaaataaatagaaacagctataggactaaagtttctaatatgaatcttatagtttacttagcacatgctttaataaagttacctcttcaggaaactagaatattgtgtctggtgtaagactagatgttttgtcaaaagcatatgtaatattcatatagcggagctttggctttatgccatgaacaagcaggaggtgtttttggaactgacctgttgattttcacacgttatttattagaaatgactgctgccattcccacatagtcctaagtgtaaacatttaccatatgtatgtggcttcaagattattttgttgttcacaaaatcacctatgtcctcccatcaaaacactatcctcatcttaaaagtaaatggcactattttattcaatgatttacattttggaatcctaaccagatatttttttccttaaatttcaagcactgcattacttccaaagacatgctatgggtatgtggaaattatatcaaacatgagtaaattttgttgaccaagactgcagaaataacaataccatcacataaatatatgaatacagatgttgatggttggtgaaaattacccccaaatagccaatgccacgagtatattttgaatagctagtttgatttttattaacattatactaaggttatttctaagcctgcagacaaaatttatagaatatactactcagatacttgagaatgtactacttaaatatttggatatttttattccaaatatatctccactgtgattttttaggagatacaattgccatcacagtaagatattgctgattccaatgaaatttttaattaactagaaaaatcaaagaatgcaattctttttcaagatttcttcaaataaagaaacaagcaaaattaggctgtggtgctgtgaataacaccaagaagtatggagtcaggcaagcctcaggttcagtcacagttctactgttaagtagataattctaagggtgcgtctctgtgtcttaggtttgtggagacctacagcagcgttccacagaccaacactgagcctaccccacgactattcaacctgaccattattgggtagctttcatctaaccagttagaaagaaaacatctatgaaaactatttactaaagaattatatattttaattaagggtactgagcacggtcaagttagagaacaatagagtagaaaacttctattcaaatataattgagaccagttttttgatagttaatctaaaaagtgagttaaggaggaggatcatggggttaaaaaaaaccagaaatgtaaattatttggccaatattttgatataagtccaggaccctttgattattactctactaactggagtttctatacattgtcttctttgtataaattaggatcataagaagtcaattataattctaaatttttacttgtttaaagtagaacaaaaaaagtaattgaagtgcaaaaaccttttagcttattaaatttttgctattctgattattctaattttataattttttcttaaaaatttacattgcttagccctcctagtaatcagcttagctttttctaatcttttcaagacccagatatttttacataaatagcaccactctattataatcacatccctgattttatttatgtcacaaaagaccaacttgaatacaacctaaataaactgtctggtagataagttaacaacataacgtcaatttgaggcaacagacttacataggcataatagaaaacacactgttattttacagggagaatgtacagtgtccgttcattcaacaagttagttaaacacaactcaactaaaacaatgtcattgaaaagtagcaaattctgtttttgctccatggacttacagccaatgagtcctgagaaagaagagagaatttaaagagcttcattggcaggtgaatctgtacttggccttttagcttagagactgaagctccatattcaaagcagaagaatagtgagacatcccatatgaagaaagaaatcagaacagacatgcaggggcaaaagtagccatggtctgcgtcctggctcaggaggacagtatgtgttgaagagcaaagcctagaatgggctgatgcctgtaacctcaccccatctcattgctttatctactcacactgcttgcccagaaaatctggtgccccacagtgagaacaggaactgggcatcccagctaatcttcagctgggtgggtctcatagggttgtcagatttgaaaaaaataacaataggctttgaagaaaaagacttggagatgaagcagaatgctcttgccaaagcttccctcaattgacataagaggaacaaatttatttcccaaattagttatagtataatttaccaggtatccaaataaatttgtttagacactaagagttttcccctcgaataatgcctgaccataattttacatataattcctttattcaacaaatgctcaaagtatgtttgttttataccaaacacttttaaggaattaggaataccattgtgaataaaatagacaatctctactaaatgcttagttatgatggaaggcaaacaaatacataaaataagtaagaaatacagttttatgcctcatgatgtcagatgatagtaagtgctgtgtccccaaaacacttactcattttctcaaactattataaaacagggacggtgcataaagagtgctggacatgggactgaagattctgttttaaatatggttgccagggaagtcctcactgtgtaagaacattccatcgaggacttgaaggagatgagggaagtcatcaagaggatgggaaaaagaacactcccagtaataggaccagcaaatgcaaagaccagaggagaaagacatctgctttgtttaagggacagcaaataggtctccctgctacagcagagtaaatagagtggaaatggtagaagagtttttagttgtaaggcaagaaggggaccaaccatggagagtcttagatgtcattgtggagatttctattttactggaggtgaaatggaagccactgaagacacttgaaatggaggctgatatggttcacagctttaatagtctgctgtctgctgagataagaattgactataggacaaagggtagatttaggtagtgagatgttattgcagtcacctaggaaagagataggatgatttgaactagagtggtactggtaagaggtggtcgtattttgaaaatatctttgaagtagagttgacaggatttggtgatgaatttgacatggaatgtgagtcaaatttcatagcctgagccaaacatccctatttaattaggttgaatataatggaaaaggtggggggaaatggattaagaaaagaaagaagtttgttgtgggaaacagtaaggtgaagaaaccagcagagatgttagatatctaaatctgagttcaggagttttgaatgcatagaaaatttgatcattagcatggggctggtatttgaagccatgagactggacaaggtcattttagtttagtgtatttccacagattatatttcaagcatcgtgctaggtactttaacgtttggccattttaaaagccccttggtaaatttcacaggaatcaggatttgactgacctgtttttctcagatgtctgacctcagtcggatgcatgattttattatatttaattccctataaaattccaaaatatcaaaataagacctatatttattagcaggatttttcaggtacaatattcctactcagatagaactatatcacttaatttcacagaaatatccttccctggggtgatgatactattatatcaccaatcatgaagtcatgctgacttgcaggcaacaatggagctcacatttagatctaagctaatttgcatgacttacttaaattatgaaaagacacacttttagagagcaggcagattttgttaattctgaattatgtcaaagtatcacttaataattctcaagggcccaactctggcgaaaccggatgctgcagcgtatgtgtttcctattcccttccaacttttttcatcatgattcatcagcgaatgctatgaagtctagaaatttaattaatggatatcagggccattggaccatgcatttacacaaattgctctgtgaagaaggaacattcactctctctctctctctctctctccccaatgttttgtccccctctttctctttcaagagcagaacattttagtgacctccagttaactgtctgaactaagcagccatctcttaggtaataatgcattgctaacaaacctcagcatagacagtaacgctaccactaaagcttctgttcatgttgttctagggctaataaaatggtacattgtattctagctctgaggaaatttgagattgtctcatattttctcagttaaaccagataataattaattatggggaagggagaggaattgctgtggcagagccagcgtgagacataatttctatttattctcaatgtattatctgttttctccctagaggcttccttttgttactcttatatcaaaatcccacttaattttcctgccatctcaactcaaaaatcatacctacaaaagagctaaagtgttcatctttttgcttttgcacaaactctgtgccagctatgagagtgtaagctttatagttatatatagatgtttttatttataatctttctcctgcaagaaaggattaaagtgaagcaaaaagaacatgtaataagatgaataatgaatagaaaaataatttgctcttaagacaaagtaaaggaaactataaaagggagatgactagaactatttagcaagaagagacctcgttctttccatcaaatagtgtggtgtaatttgcacaatgcacccaatggttaatgaatacatatttgttgaggatagcattaataaatagatgaccaaagaaaaactaatacaaaagatttttacccttcaggaagtaactattaggtaggtattgtaaattctaactttaaaagatagaggaaaagatatattgagctgacccataaatacaacaggaagacacagagtaacaattactgcaggtgaatttcagctctcagtctatctaccaaccagtgtcaccaggaaccttcttcagactcatgtatccaactgcttatttatcttttgcacctggatatccctcagctacctccatttaattcatcttcttcctccaaactggtcagcatccaagcagatccagagaactgtgaggagctattctagtctctgccctctcccccgttgctgatccagttaagagggccaaagaatatagttgagaggacaccagctctgtatctagtagcatttagttttaatctcatcccttaacttgaaattggcatggccttcagtaagtgatttaactcctctggatatcaattgataaaatgtgaaaaaatttccaaaattaattgcagtgagtattaaaatagcatgttttgtacatcatgatctctcaataaacaattgcagtattattcaaattggcacacaggcctatcactgctccttccttttagattttttttccttctgtttttgcctctgaatgccccaagccaatctcccttcctctatcacctttttaggaaatccatccccaccccactcaccccaccactcctcacactcctttctctcctaccctggcctccaccatagctcctccattcccacctgtaatccagcctctgcaccactatcagcgctgcgcttctgaaatgcaaatctcatcatgttgcaccttataacatctttgaatgactcctacttgtctcatgatgaattctaagctccttagttttaggttgaccatgaccttttttgatctgaccctgtccatctctccctcctaattctcatttctctccaccaaatactccacccttcgtactgaacaatgtggctctactgtcatctcttcatacttatattttttccttgatccttaactttgttcacaatgttcctgccatctggaatagcattttccctgttggcctggaaaatttgactattcctttgcgatggaattcagtcttcacttccccatgagtgaccttcttaggacaaattgacagtatcttatattgtagtcccacagtccattaggcagtcttcaagtgtccaataggagagtgcatgatattagttgtttatatgcctatttctcccactggctttgagaaacttcagggattgttgtaaccatttgtatccccagtgtctagcatagcgtgcatctatttgtgttttgaatgagtgagtgaattaacgagtgatgagaaagccatgacctatgtttgtctctaccaatcttaaatgagattataaacagactgattcaactgaagattgcaggtcctattccttttgcagttgttattgtacatgttagcaaaaagcttcagcctttccaaaaatttcttcagtggtagcaataaattcattgtcttctgggagcaacactgtgctccctctctctctgtctctctctccctgatttgcctattgctactttgaagagtatgtgtttatgactttataatttgctacagcgcatgtaataggagcccttctatttcttcagaagtggttataagaaatattcacacttgcttatgttttgtgaacatctatatctggtggagcacatgttattataatcttattttaagcggaaatatagattaaaggattttctcttactgttcttaatgtaatgcttctaaattagatacacgaaagtgctcatctaggagataatggaagcataagcaaaacacagaaaaagccttaccaagaatgaattataaccaacaaacaaatgttagttttattgcaatagaattactgaattagtacatgatggaacaaaaaatctataacaagtttagatgtcagtaatgtattcgacatggattgtatacactgtacccacaaaattctatcaaattgtttctatttcaagaaattttcagtttattcatgttcaacacaaaagttaattatacatgaaatataaactcaatgcagaacattggcattgtatttcctggctttctgggaagaatgtgggagcagggttaataatgaaatggaagagaaagctcttcactcctctccttgttcccaggataggacaaaatacacatggccaagaatgaggaaagtaggacaaaacccaatatagtcaagaaagttatgaacctgaggtatgaggtaagatctggccctgggaatgttgactgacactgcaatatttagtatctagactggaatgattagatatgaagtgggttaacctggagtccttagagatggcgctattcccagaaagataaatgagatccagtcctaggacaaaaggacaaacatcattggtcggaaaaagaaaaaatgatttagaaaaaaagagaaagagaaacaaaatgtagaggagaagaagaaatcccaaggatggagaccaaagggtttgccaacagtctgttccttgggaatgcgagttacaccgcagcctggaagatgatgctacttccaagcccatgattctgtctccatgacttaggacactagtcacaaagaaatagaacacatctttctccttctagatctcattgtccattgaagaactgctactcatggcctgcaagagtgaaactcattggttctaggaatgaatgaaattggacctgctggaggcctttaattattatgtgggcctcagaactgatgaggattgatgtgggtgttatttcaataaagagttataaacaattcatatatgaaaaatttattttcttaatttatagttaaatacactaatattgtatttcaatgttgttattcaaattcaagaccatgtcagttcttagacacaatctctcactgtgtattaatttcaaaaagacattgtagtaaccacagatatattttatatatagatataaattaatagacattactttttgagctgttttatgtttagaggcaaaaattagtgaaagttaaagtgcctgtctgtagactctctcactccacccccatttctcctatttttaacatcttgtggtatttttaacattagtgtgttacatttgttacaagtgatgagaaaacgttgataaattatttttatctaaagttcataattatattagggttcactctttgtggtgtccattttatggattttaacagagatgtacccaccatgacaatgttacacaggattatagtttcactgccctaaaaatcccctgtgctctacctagttattcctcctttctttcctccccaggaacccctggaaatgactgatctttttactgtctccacagttttgcctttttcaaaatgtcatatacttgcaaccacatagtgtgtaggctttcatattggcttctttcactcagtaatatgcatttaaagttcttccatgactttttgtggcttgatagctctttttttatatagaactggttaatattccattgtatggctacaccgtacagtgttagtccatttgcctattgaaaggtcctttggttgtttctgttttggtaattatgaataacactggtataaacatttgtgtgcacgttttgtgtgggcataagttttcaactcatttggcaaataccaatgagcacaattatggaatcataggctaagagtgtgcttagtgtcataagaaactgctaagctgtcttccaaagtggatgtaccattttgcatcccaactagcaatgaataagttatttctgctcattgttcttaccagcactcagttgtgttgctattttggattctggccattataagagctatgtagtagcatctcattgttttggtttgcaattttctaatgacatatgatattgagtatcttttcatgtgcttatttatcattagtaatatgttgccatcagtaacgttcctttccctttccattgccagtgagatccagcatttttttttttttttttgagacatagtcttgctctgtcgcccatgctggagggcagtggtgcaatctcactgcaacctccacctcccaggttcaagggattctccctgcctcagcctcctgagtagctaggattacaggcacctgccaccacacctggctaatttttttttttttttttactagagagggggtttcaccatgttggtagggctggtcttgaactcctgacctcagatgatctgccctcctcagcctaccaaagtgctggattacaggcatgagccaccgcacaaggccagatccagtatttcttaatggaaatgaaaaattcaccagttactgcatttttccccatatatttgtaataagttccgacgtctgataaggcaagtccaaccctccgcattttaaaaaattaatcaagttatttattaaaaattaatagtctacgcacattttaaaatcaatgaccatattagatttactggaaaaataatgtaatttaatattaatttatcacatccattaacatgataattctccacttatttggatttcctttaagatcaattcctaaaattttctatatagatggttttaggatttttttttgtagcttaactacaagatactttgtagtgtctcaatttttattacacttttacaccttcaattcaattattgctgatatggaaaaacttttttttcaacatctattttagatttagtgggtacatatgcagatttgttatatgggatactacttgatgctcaggtttggagtacaaatgtatccattaatcagatggtgagcatagtatgcaatagttactttttcaacccttgtccttcttccatcccccatctaatagtctgtgactttgtactgttttctattatgaattggggaaaagccattattatattagcttcagaacaactaggttcaagtcatggaaaacaatttcgcacaaacaactttaggaaacactgctttgaaaactgtaatctgaattatagctgaggccacagaaaccaaatatttactgaaggttcttttaagaaaaacaagttagccaggaatggtggctcacgcctgtaatctcagcactttgggaggccgaggtgggtggatcatgaggtcaggagattgagaccatcctggccaacatggtgaaaccctgtctctactaaaataagaaaaaattagccgggcatggtggcacatgcctgtagtctcagctactcaggaggctgatgcaggggaattgcttgaaccagggaggtggaggttgcagtgagctgagattgtgccactgcactccagcctggtgacagagcaagactctgtctcaaaaaaaaaaaaaagaagatgaagaagaaaagaaacaagttgtattgaaagaggacatcattaacagtatatctcttcaataatggtttattttactatattctcattcctctcttactgtgtcccaaatctctttacaggctaaaagaaactgttcagaattaatcctattcataaagaacagcacttactgagtattgcattttcctcttcaaattcttcagcatacattgggactacaccatatggaccatttttacatttttacttttgggtttttgttttttttttcctagagaaactgcaactagatttaggtcctcattctattaggtcagtatttgtctagtaaacttcagcttaagcaaaataaaatatgtgttgctttgaactgaaactcctcaaaaccgtattttaaaaattacagaaaaaattaaatgaaattattattttaaaaatcttgtagatgaaaagatatgatatatagtaagtttaagtacctatttcaatggttcccacagtggggccctcagacacccaggtccaaactattttaacaggaatactaacatggcgacatttggtgtaagggtgctaatacaataccgggtaaaaatgcgggcagtttagcacaaataaaggcagtaacaccaaactactagtaatcatagtattcttcactatgcacaggaaaggtttgaaaaagaagggcaggttgggcagtgtctcacgcctgtaatcccagcactttgggaggctgaggtgggaggatcaccagaggtcaggaatttgagaccagcctggccaacatggttaaaccccatctctacaaaaaatacaaaatttagctggacatggtggttgcatgcctgtagtccctgctacttggaaggctgagacaggaggattgagcccagaaggttgaggctacagtgagctgtgatcatcctactgcactctggcctgggtgacagaacaaggtcctgtctcaaaaataaaaagaatgtctatgatgaagcagtgaaaattttactacatcttaatccttgaatatgtctttttaatatttcaagtgatgaaattggaagcacacatgagcattcctacagactgcctgaggaaaaaccctcatgtgactaagtcttgaagtgaattaaccactttaatggagtatcatttttacttgaaaggagtactgacaaacaatgttatttcaactggggtttttgggagacattttctcaaaaaatgaggttctgtcatttcaagaaaaacaacagacaggccataataaaattcaataataaaactgctaataataaaattaaagcttctgaataaaaaattagaattttagaaaatatatccaccattgctttccaaaagtattctgctgagattgatggtgatattgatgaatgtattttgatactgtataatcaaatgtatcaacatgtagaagatctcggtgaaccattattttctaaatgaccaatgcatgatgttataatatcatgcaagggtaaaagatccaaagttcaagaaaaaccaagttttgatggagtatcaaaaaagaagcctaggcaacatggcaaaatcctgtccctacgaaaaaaaaaaatacaaaaaattagccaggtgtggtgatacacacctgtagtcccaactactctggaggctgaggtgggaggatcacctaagtccccagagactgaggctgcagtgagctgtgatcacaccactgcattccagtctgggcgacagagcaagaccccatctcaaaaaacaaaatttatatatatatataaatatataaatatatatatatccacaatgatctaaaatggctatctgtatgagattggacattgttcacatttcttcaaggaaatatcacacaataaattgaatgcagatgaaaatgacataccagacatcaaggaaatttgcaaaaaatataagattgtgctactttgggtttagaaattttttcataaaaacatttataacaatacgtggtgagcttttaaagaatagtttaaatatttctgatttaatttctaatgataaataccagtagatataacctacataaaccaaagctccttgggccctcaatatatttttaagaatgtaaaggagtcctgattccaaaactttgagaactgctgccttcccctccactttcctgccttccctagaatttcttccttggaaggaacatccctttgccattttaacttacagagttccattcaggccagttttgctacctccctcccatctttccacctccctgtcttgacacaaaatctgaccaaaggactctaccagcccaccccatttccagtgcttagctgtcaaggtgggctaagccaagaaaatctgggttttctctgagactagacctctttttctgggagatctggaatcacagggacaaggttggccaccttgggatagtcagaattcatcttgcctcaaaggggagaggttaggcaagtttctacaaagccaaactgcttcctagaaagtcaaagataattatactttgtgccacaactgtgagaatgcccattttattgcacactttctaacatttttaccaaactgataaataaaagctggtacctagaagaaaaaaaggccaggcatggtggctcatgcctgtaatcccagcactttgggaggccgaggcgggtggatcacctgacgtcaggagtttgagaccagcctggccaacatggtgaaaccccgtctctactaaaaatacaaaaattagccaggcgtggtggcaggcacgtgtaatcccagctacttgggaggctgaggcaggagaattgcttgaacccaggagggagaggttgcagtgagccaagatcatgccattgcactccagcctgagtgacaagagcaagacttcatctcaaaaacaaaaaaaggttccatacaatataatttgttccatctctagaaaccaattcagcaatgagaactgaaagccaccacttggaaggtttcaaggatttagctctacctaatgacgtctaaagcattagttaaggtagaaaaaaatacacacacacacacacccctatgtatttagtaccaggaaacatgatggactagatggtatagtcatccaacagaaaacacacaataactgaagccactgtagaggagtaagttatgatgtggatctacaatattgttgagtgaaaaagcagattacaaaaaaatctgatttttcaagggagagggaacacatacaagcacaggagaaaagagatgagcagatgactggaaaaatacaaaattctgatagtggtaccttctgagtgggagaattatcggtaacattttctagttttgcctaaacattttctaaatttcttaaaataaggctttgttatccatattataaaatatccacctcctcaggaaacttaaccttcagcacaaatgctacaacatgttcaaagtttgttcagtttaagagacaatctattttgaaagacatctaaaatgacgaccaatatttaaacctatgcattaatatttttcaatcatatgctttaaattttgtaattttgttaaggttaagctttatatccatctggaaaaaagttttctatttgtctttaaaatatgacctacaatataccagtttttaaacaatgaatggtgctcaaaaattgcaatataaattcaggcagtgttccttacatagaatgtttaaaggcttctaacactgctcttcttcaccggttatgaaaacacattaccattatctaagcatctaattattcaggtcctttgtttctcctctattctattaattttatagtaattttaaggcctgtgaggatgaagttgtctgtgacagctaccacaaaggttactataagtggacaaatttcaaacaagtttatcaccactaccatccccaccataaaactgtcttaatcaagggcaacacatttcaaggttaaccaagacaacctctttacctgtcactgcttaagaaaaggactttttggtcttatttagaaataactttctctatctatttttctccataaatccactgagatcaatgtatggctctatctcaagcaccagcaagcaaaactacctgccagaatgtgcagtttttgtatctttccaagtgtaggacacagctatcttttgacatcacaatttttaaaaaattgatgcacaaacttcttcttgaacgttcagccaggcatggtggctcatgcctgtaatcccagcattttaggaggctgaggcaggtggatcacgaggtcaggagttcgagatcagcctagccaagatggtgaaacctgtttctactaaaactgcaaaaattagccgggtggtgtggcaggtgtctataatcccagctactcaggaggctgaggcaggagaatcacttgaaccggagtggcggaggttgcagtgtgacgagatcacaccactgcactccagcctgggtgacagagtgagactccaactcaaaaaaaaaaaaaaaaaaaaaaaaaaggaaaagaaaataaagttcagacatacagcagttgtaattctaagttcagacatacagcagttgtaattctaagttcagacatacagcagttgtaattcctctgaaggctggttatgggacacatcactttcatactttgctgttcaataaatgtgggctggagaataaagtaaactgacagaattaccatataaaataaaattctaagtgctctgacaacaagagaaccttaaaatacacacacacacagacacacacacagttttccctgctaatcattttacaactaaacaaccaagtagctaacgcagagcccacaaaagcggagtaaaaattctaacacttcgtaaaataaaaatgcacatatacccctgtgatctaaaaaaaatgcttaagtattcaaagacagcaattacagctactgagaacatcgttgtgagcaaacagaggcagagaaaacaaaggtgctgatgaggatttgaagcacctaacctgcagaaacccactgggtgatttcctaggttccagggtggcattatctttcagaacgatcttcaagaagaggtcacatgacactgttacaaaggatctggagaaagagacccttgctttatctctccggctctccagtcatgcttcacattttcgcttcttacactctttcacatgaagtccatttacacacctccatcaagcccttagagacctttttgcactatccatgacaagttctggatgtcatctctgcacttttgacaaattcttagcagttaacttacagggcagttaagatttttgttcaagcacaatatagctagaatagggtcatatactcaataaaacaaatatttaccaagcacttattgagtggaagataaaaagcacaaagcataattacaaaatattctcccctgccaccataaaagaatttcttaaaggcttacagaatatagcataacgtgaccaaaacaaaaatagtaaggactgaagaggggaggaagggaaaatatcagcatgaactcaatatgacccagaagagccttgatggtcagacgtgtaaagacgagttgggtagggttaaagggtggaggtcaggggcacaggtcaggggcacattctacaagggaaaaacagctgatacagaagcctgaaaggaaaagcgggcagagcacctgtacaggactcttacctgcggcatctaccatacaatgcgcctttccagaacacagcagtgcgcagccagcccctggggagagggatcactcaaacagcaccagaggctgcattccaacttttcttccatcaacgactccgttttcattgttagtttctccttcaacacaaacttgaaaccaattggctgaacacgcgggagcaaggaaaacctgactgaagaatgaggcgttaaaacttaagggccttgggtcctggcgcggtggctcacacctggaatcccagcactttgggaggcagaggtgggtcatttgaggtcaggagtttgagaccagcctggccaacacggtgaaaccccgtctctactaaaaacacaagttagccaggcgtggtggcgggcgcctgtaatcacagctactcgggaggctgaggcagcagaatcgctttaaccagtggactgtcaagagagataggctgcaatgagccgagatcgcgccactgcactccagcctgggtgacagagtgagactccctcaaaagaaaaaagaatttttttttttttgagagaagtctccctcttatcccccaagtttgagtgcaacggctggatctcagctcactgcaacctccgcctcccgggttcaaacgattctcctgcctctgcctcccaagtagccgcgattaaatctcctgccaacacgcctggataagttttgtatattttagtagagacggagtttcaccatgttggccaggctggtctctaactcctgacctcaggtgatcgcccgcctctgcctcccaaagggattacaggcgtgagccactgcgcccagccaaaataccgaaaatcttaaaggtctttccccttccccgcctgggctcaaaaaacgccggagccgccctgcaccgccctgtcgcggtctccggagcaggctggccgactgagggcgaccatgggtcccaagaaggctccggcagtcgcgggctcccacctcggggcgcggcgacgggggcctagaggggccaacagcccccaagcttacgccacgcgaggagtcggagagacgcgccctcccctctcctcccacccaagcctccggcagtcccgggccggggctgggccagttgcgggagaaaggggcggggaactggggcctctctggggaaggctcccctttgtcctgggactccgggcgccccctctctgccctcgccctgccccgcgaggccgccgccgggcgcctcacagtcatgttgcagtggagcgtgagcgggggctgcggctcctg

SEQ ID NO: 345 - DNA, 148848 bp, Homo sapiens
atgaagataccaatgagggcaagaggataaaagattaatggcatcaagggccttattttcctgtctttcagttggtccctaccccatttataaaaccgaaagccataaaaagcatctagcacttagaggatttaataagaatgcatgcgaaagtgcagggcgctgtgcttgatgtacagtaggttagagacaggtcctcctcccccacatcttattccataaatagctcctatgcccaacagaaaccaggtgcacagatctttccactttgggcctaggaggcagagggctgtaaacagccagaggtccagttttcagacccgaggtcattttctgacactgctcaacagcaatcttagagtaccgggggatatgggagacaagagctcggccccactctgcaagggagagaggctgccaggagccaggatgactccataggctgccttggggaagaagcaggtaagcaaacctagcccctggagcctgcctccggggaggtgatgacagcagaaaccttggacactccctccccacaccacctcccagctcccctaggctggcgcggccctccacttcctgtagccaacctccctctcagcctccctgcccccaccgggaggtgctgcagtgcggggtggaggggggttggagggagtgggaagagggagtgtaggaagggcacagggtcgcaggctcccggcccagaaacgtcttccctctaagtcatgcctcggaggaatactcggcacgcccccgcccccgcccccacccccggcttcccgtagactctaactccatcctagccatcaggctctgcagaatgtaatccgcattccccagcgtccttcatctctccaaccccagggtcccctgcagccctccatccccacctactcagtttttccacatcttcgagcttgtctatcgcccaagcccgcagcgtcctctccaggactccttgcccaaccgcggccgcccccacgtgcgcacccccggactcccgctccgcaagcctctcagccatctccttctcgtggatccccaagcccacctttgccagggctcaaatggccccattttcctatcctcacgggtccttccgacgcccgctccccacacattaccttaaccctctggaggcgagagagatgtaactcatgcacgaaggggttgggggatgctgggggtccgggggtgggatctaggggggcccagtcccccggacttccctggctcatggcgggagaaggtgggagggagggcaccccggccctggccccggccaccactctgcagagcagctgctgctgcagcagcggcggcggcggcgctctggcccgggccccgcccggtgcaggcggccgaggggcggggagcaggcggcgcagcccagcccgcccgcgttgtcagggcgccggccgaggggcggggcttccagcgccctggcgcccctgctcctccgcgcccgccgcggcgcccgcagccgctcgggccattgttccgcggctgccagggctggagcgggctgcccctgggcttctgcgcctccgtcgttcctctctgaagacctggcctccgcctcggagtgggagtgggtctgggagctgagcgcagagctcagagcgccctctgtccccgcccgggcgtcgaggtcacccagcaagcgcagatcggggtgaggctcttgggttggtaggcagggagggacaggtgggccggatgcagaggccggcagctcgcgggtgaggcggcgccccgctcttcctatgggctccttggcccggtccgcgcctcctcgcaggcggaccacctttccttcccggtccgtggggcgccatcgcgcggggacttgaggcacttgcgtcctctggcggctgcatggcgccccgcaactctccacctccgcgtcctgcctgtgctaggcagggccgcctttactggtgtgagggttgcttgaacccttgaggcgccaggaatccctagtacactgacgcatgtgcttcccatgagcccgacaaggtctggcaggggagaggcagtggttcctgatctctgtcactctctgggtgaacgcagaggacacagtagtaattcccctcacccacaagctccaagctaccctagaaaacaaattgtttagcctcaggccatcgtttgagatcagggaccagggaattaagtggactctgagatccattgccatgacaaaaggggtaagagtctcattgcttgaggaaagaatacgccttaagttcactttatgtcttctgcccattgcatggcagttaggggagctgaaggaagaaagtgaaagaaaaagagacctctcataaccaagagtgtttgccgccactggcttctcctttaaaccaaactccaaattaatctgctccaggaaattttctgagcccaggctgagagggttgaaggctcatgcatcctactgagaccaaggagctgcactgggatgtttttgtatataacacagaggtcccaacacaaatacatcatttccacattttatttttgtatagatagggtctcgctatattgcccaggctggtctcgaactcctagcctcaagtgagcctcccacctcggccttccaaactgttgggactacaggtagtgagccgccatgtacaacccaaaccttttttttttaagcagatgatttcagctttctcaccagaaccgagaaagtacaactgcatgtattagtctcccttgccttgcctttggggagaagtttgtgtgtgtgtgtgtgtgtgtgtgtgtgtgtgtgtgtgtgtgtgtgtttgtcttttgttgttgttgttttgggacggagtcgcgctcttgctctgttgcccaggctggagtgcaatggcgtgatctcagctcgctgcaacctccgtctcccggctccaagcaattctcctgcctcagcctcctgagtagctaggattataggcgggcaccaccacacccggctaatttttgtatttttagtagagacggggtttcatcatattggttaggctggtctcgaactcctcacctcatgatccactcgcctcagcctcccaaagtgctgggattacaggcgtgagccaccgcacctggcggttttttttttttctttttgagatggagtttcacttttgttgcacaggctggagtgcaatggcacaatctcggttcactgtatcctccgcctcccgggtcaagcgattctcctgcctcagccacctgagcagctgggattacaggtgcctgccaccatgcctggctaattttttttttttttttttttgtatttttagtagagatggggtttcaccatgttggccaggctggtttcgaactcatgacctcaggtgatccacttgcctctgccaaagtgctgggattacaggcgtgagccaccacgcccagcctagaaggaggtttaaggactaagataatgttcataaggtgggagacagggaaagatgagagtgtagggaagtttaaatttttcccttgaatgtttgataatttgagtctataaaacaaactgattacatagattaaagggaaaagaggcctacgcatttttttttttttttttttttttgagacggagtctcgctctgtcgctcaggctggagtgcagtggcacgatctcagctcactgcaacctccacttcccgggtcacgcgattctcctgcctcagcctcctgagtagctgggactgcaggtgcacgtcgccatgcctggctaattttttttttttttttttggtatttctagtagagacagagtttcgccatgttaggcaggctggtcttgaactcctgacctcaggtgatccgcccgcctcggcctcccaaagtgctgggattacaggtgtgagccactgggtccggtctcctacaaattttatttgatgcacgcatgtgtgtgggagtcatacaaaatataaaaactcaaagaaatgcccaatggttgcttttataccaccttgaggttacagaaagaatgagagcttgcatctgggcaaaacaggttatggtggcaagacaggttatgggagggggagaagaagaggcctggccagcaaagacggtcttggtgaacaaatgaaatctcacagacagtagcctttagaaggaataggtggtaaaggtttctgttagaccttttaagatgtcagactctcagttaatctttcctaaatctggacaagggagagcaccagagaaagcctttctgcatcgatgcagattctctgcagatgcagatctcccccacaaaagacagctttgcaggctttctgaacagtcatctcaaaatacatcaaattcagaatgaaaatttttggtgctcttcaagagcaataaatactatgaaaacccaactacaggggtagagttttgataatcaaatatttgccggtgtcagtcatccaggatgaactaagaagttcatttctatgaatgagtcatgaaagcatccacatttcccctttttctagcccctcaccaaactattatgatggcctttctgcaggcagtctgagaaggggcaacccagttgtaaagaataacgttgagaaattgatcatctctggtagcatctgtcactcccttgaaaatatccaccaggctagacaggtttctcctccacctgacccctgtatctgtatcagtcaccattacctgggagtactggagacaatgacatatcaatggaattctggattattggataccattaatcttctgttggaagggggaaccagacagaagccagaagttacttctgtctagactccctcccaacctcccatgttttatagcctcaaagaaggcagtcagcattctcagcattcttttcttctttttcttcttctcttcctccttcacctcctcctccccttcttcctcctcctttcccttctcctcctccccttccccctccctcttcttccttcttccttctttcttctcctcctcctcttcatcccctccctcctcctttccccctcctccttttcctcctcttctcctcatcctccctctcctcccctcctctccttcctcacttcccttctcctcctccccctccccctccctcctcttcttccttcttccgtcttttcttcttctcctcctcctcctctccgtcccctctctcctttctctcctcctccttttcctcctcttctcctcctcatcctccctctcctcccctcctcctcttcctcctcctcatcctccctctcctcccctcctcccctcctcctcttcctcttctccccttcccttcctcctccttctcttcccccacttcctacctctcctactcctcttcccccatctcctcttccttctccttctccccctctcctccccctcccatctccttctcctccccccacctccttctcctcctccttcttcttttaaatagaggcagggtcttgctttgttcgtcttaaactcctgggctcaagcaatcattctgcctcagcctcccaaagtgctgggattacaggtgtgagccactactggtggcccgtcctttttaaatttttaattttattaatcttattttcatttctttttaatagagatagggtctcactatgttgaccagactggtctggaactcctggtctcaagcagtccttctgcctcagcctcccaaagtgctaggattacaggtgtgagccaccacactaggacaagatttatttctgttatgaactgaatgtttgtgtctctcttcccccagttcatatgttgaagccctagaccccaatgtgatggctatttgaaggtggagtctttgggagataattgggtctagattagatcatgagggtaggacccttatgatgggattagtgcccttaaaagaagagagagagggagagggagagagggagagagggagggagggagagagagagagagagagagaaagaaagaaagaaagagatctttctttccatgagtacatatggaggaaacgacatgtgagcacacagtgagaagacagctgtctacatatcagaaagttggctctcaccagacaacgaatctgcaggcatcttgatcttggacttcccagcccctagaactgtgataaataaatttctgttgtttaagccacccagttgatggcatcttattacagcagcctgagaagattaagacaatttcttaaaggttcttagagacgattccatagctttcttttatctcttatttaaaggagggcaggtttctgtacatcttgtgttttccaagatagttccaataattttataatttcattttttttcaattaaggcaattcatacatgcatagttacacataattttacttttatgactttaatattgtatttttttaatgtgcacttttattgaactggtctcaagtcagtgtacaggtaaccccttgctactttcacacctccatccaatcccagggagaccaaaagccttcatacacctcaagtttagggacaaaaagtgtggccacaatggctcattcaaaataaaacaaaataggccagacgcagtggctcatgcctgtaatcccagcactttgggaggccaaggcaggctgatcacttgagctcaggaatttgagaccagcataggcaatatggtgaaaacccatctttaccaaaaatacaaaaaactagccaagcagggtggtgcacttctgtggtctcagctactcgggaggctaaggtgggaggattacttgagctggggagctggaggttgcagtgagctgagatcgcctcactgcattccagcctgggtgacagagtgagaccctgtctcaaaaaagagtaaaaacaaaacaaaaacaaaatacaaagttattaaggctaagatttaaaacattttgcattatgtaatttgcatgaaagcaatgctatcacctcccctgtgtggacttaggagaggactgggccattttccttagatagaagtggagtggcttttgggagggcaaaggaacttcctgtaacaatacatttcatgatatttgcaatgactattaaaaaaaaaagaacaggcctggcgtcgtggctcatgcctgtaatcctagcattttgtaaggctgaggcagacacatcacctgagcccaggagtttcagaccagcctgggcaacatagtgagaccccttttctacaaaagatagaaaaattagcaaggcacggtggtgtgcactgtagtcccagttatttgggaagctgaggtgggaggatcacctgagccctggaggttgaggttgcagcgagctgtgattgggccactgcactacagccttggtgacagagtgagaccctcagagtgaggccctgtctcaaaataaataaataaaataaaaattaaaaataactatgtacaatccaagttcttggccacattgtagaactttgggggatgctcattccaacagactgttgtcactttcactgttccagtttgtaaatcctgaatcatcaagccaaaaaaaaaaaaaccaaaaaaaaaagaaaccccaaaccaaaacagaacccgaaaccaatcaaacaaacaaacactccccaaaaaacaaataaagccatgccaatctcatcttgttttctatgcaagttaggtttttgttaagaaagggtataacacaactaagtaacagtctgcttagaagcatttgcagtagaagatgggggcgagagaagtgggactcgtattcctgcctgctgatccacatctgctggaaggtggacagcgaggccaggatggagccaatgatacacatggagtatttgcactcagcaggagcaataatcttgatcttcatcatgctgggagccagggcagtgatctccttttgcatcctgttgggcgatgccagggtacatggtggtgccgctggacagcactgcattggcgtacaggcctttatggatgtccacgtcacacttcatgatggagttgaaggtagtttcatggatgtcacgggttccatgcccaggaaggaaggctggaggagaggccagggcagtggaactacttgttgcagatgtcgatgacctggctctggagcagcttgtagctcttctccagggagaagctggaggacatggtggccatctcctacttgaagtccagggcaatgtagcgcagcttcttcttgatgtcacgcatgatttcctgctgggccgtggtggtgaagctgtagccacgctcggtgaggatcttcgtgaagtagtcagtcaggtcccagccagccaggtccagacataggatggcactggggagggtgtaccccttgtagtttggtagtgtgggtgaccccatcactggagtccatcgcaatgccagtggtacaaccagaggcatacagcaacagcacagcatggatggcacatatatggcaggggtgttgaaggtctcaaacatgatctgggtcatcttctcgcagttggccttggggttcagaagagcctcagtcagcagcatgggatgttcctcaggagccatgtgcagcttgttgtagaaggtgtggttccagatctccatgtcgtcctagttggtgatgatgctgtgctggatgtggtatttcaggatcaggatgcctttcttgctctgggccttgtcacccacataagagtccttctgagccatgcctgctgtcatgtactggttccgtgggcaccccgtgatggaaggcaagataccctggggggcattgtcactgcaagtgtgaagatatcatcattcatggggagctggcaccaagtttggactggtggaggagtgtcgagcgtgagggtctgtgcttggggcagatacagtcttggtctaatattttaacataaattaaccatatcagaaagagttattaaacttaggactcaaacctatggagtaataatttaatactataattaaattaaacacaatcacatacacctaaccctcaacgatatacagagaaagttttgatactaattttcaattctttatctctatgaagctgatgaaaaattcttaggcagtgtgcctggtgtgggattttgtaaaccaaaaataatattctaggcttcccaatcaactgaatagacctatcctctcagccaagggcattccaaaattaacctgaaaaactagttcagaccatgatgagatgcaggagatggggcatgacttatttacactctcctgtctttggaatgcaggcatgggtgaccagcattaacattaaaatagagatcttaagaataaaacagacttcctgtagcaataagacaccaaattccagcctgactaaaataaatcgaatatatatatatatacatatatgtaaaacactttgatttcttacatatatattattattatatatattttgttatttttttgagatgaagtctcactctgttgccagttcggagtgcagtggtgcgatctcagctcactgcaacctctgactccatggttcaagctattttcctgcctcagccgaccaagtagctgggattacaagcacacaccaccacgcccagctaatttttgtatttttagtagagatggggtttcaccatgttggccaggatggccttgatctcctgacctcatgatctgcccactttggcctcccaaagtactgggattacaggcataagccaccgtgcccagccccaaaatatatttctttcagagatatatatatatatatatatatatatatattatatattatataatgtgtgtgtgtgtgtgtgtgtgtgtgtgtgtatattttttgatacagagtctgttacccaggctggagtgcagtgatgtgatcttggctcattgccacctctgcctcctgagttcaagcaattctagtactttagtttcccaagtagctgggattacaggcgtgtatcaccatgcccaactaatttttgtatttttagtagagatgaggttttgccctgtttgcgaggctggtcttgaactcctggcctcaagtgatccacccaccttggcctcccaaaatgctgggattacagacaagagctaccatgcccagccttctttgatatattttgaaatggtcctgcaaagctttctctcattgggaaaatgtatattctatagagaatccttgattctttcctgatccaggaaggaattaactgagtctgacacctttttgggtctgataaatgtcaggcctgtgagcccaagctaagccatcatatccccagtgacctgcacgtatacatccagatggcctgaagcaactgaagatccacgaaagaagtgaaaatagccttaactgatgacattccatcattgtgatttgtttctgccccaccctaactgatcaatgtactttgtagtctcccccacccttgagaaggttctttgtaattctccccacccttaagaatgtactttgtgagatccacccctgcccgcaaaacattgctcctaactccaccgcctatcccaaaacctgtaagaactaatgataatccaccaccctttgctgactacttttttggactcagcccgcctacacccaggtgaaataaacagccttgttgctcacacaaagcctgtttggtggtctcttcatatggacacgagagacaataagagctctgaggcctgctacctgaaggtttcatatgcatgataaagccttgatctccacaaccccttatcttaacccagaccttcctttgtactgattccaggtctttagataataaactctttctctttttggtagaagatagcttaaaaaacacacactccaaaaaacttctttcaaccaattgtcagttagaaaatctttgaatccacctatgacctggaaggaaccacccctcgccccctctagttgtcccacctttcctgaccgaaccaatgtacatcttacatgtattgagtgatgtcttatgtttccctgaaatgtataaaacccagctgtagcccaactatcctgggcacatgttctctagatctactgcggctgtctcatgggccattggtcactcatatctggctcagaataaatctcttcaaatattttatagagtttgaccttttcatcaataacctctattcttttatcatttgttttcctcatcttttgtgtgtcctgcaatgtccttgcttcttgccactccttccctggttgttacttcattgtattatcagaggagtttgaaccagagtgactccatcttgaataggggctgggtaaaataaggctaacaactactgggctgcattcccaggtggataggtattcttggtcacaggatgagatagaaggtcagcataaggtacacgtcacaaagaccttgttgacaaaagggtatggtaaagaagatggacaaaacccaccaaaaccaaggtggcaacaaaagtgacctctggttgtcctcactgctcattatacactaattacaatggattagcatgctaaaagagacactcaccagcacatgacagtttacagatgccatggcaatgtcaggaagttatcctatatggtctaaaaacgggaggaaccctcatttccacaaattgcccacctcttccccagaaaacttataatccaccccttgtttaacatataatcaagaagtaactataagtataatcagttgagcagcccatgctgctgctctgtctatggagtagccattcttcattcctttactttcttaataaacttgctttcactttagtctatggactcaccctgaattcttgcttgggtgagatccaaaagccctctcttggggtctggatcaggatccctttctggtaatgtcttctggttgaaccacgaagggacaatattgaggaaacctctgacccaaagaaaacagcaataccaattggccgactttgagtaagaggaggggtacatttaacgtgggtaaaggatggaattgggttagaggcccaacttaggagggttagagtccctactaagacagagttaaaggcctccttaataaaaggcaaggacacttgaccaaacttgggttagaggcccaacttaggaaggttagagcccttcctaagattcagggggttacaggttagaggtccctctcagtaaagtccctcttggttaaaaatggatttggaattatgggatgttatctgctattctctttggattaatctgccttgcactgtttgctgatggctgtgggtgacaggattaggcatgtacaggatcaccagatgtgggagcatttttctccctaaagtgggaaagatgagagctgatgggactgttggaagagctcccttcattactgaaaagcaggtgcctgaacttttgattcagcgtcgctgcaatgggtgggtctttctctggcctcccggagctatgtaccctgccacagacaatgcttttctccccttttctcctttctcttttctatcttttctgttactcagagccaactgtctgctgtttcatcttgcccagagaccacatgttgaaactcctggttggaagatcattgtaccccacttttctttttagcatataatcaagaagtaactaagtataatcagttgagcagctgatgccgctgctttgtctttggagtagccattctttactcctttacttttttttttcttttttgagacggagtttttgcttttgtcacccaggctggagtgcagtggcactcttgactcattgcaacctccacctcccaggttcaagcaattctcctgcctcggcctcctgagtagctggaattacaggcacccaccaccacacccagctaatttttgtatttttagtagagacggagtttcactctgttggccaggctggtctcgaactcctgacctcaggtgatctgcccacctcggcctcccaaagtgctgggattacaggcttgagccaccgtgctccatgataacttttcagaaaacttttttctactttttgccacaacttttttacatttttatccgataactttttcaccccaaaacttttttaatcccataccttttttatgttgtgttctttcaataaacacttgcatagttatactacatttttgtaacaatgaaacagattatctcatgccaagcatgcccagtatttgcacaatatcaatacttttaatactatagttttcaagacacgcaaaataaaattttaaggcaaaaacagcactttgcaacaatttaaaaatttattgcattacagtagcatcacatcagcagtcaataatgccactttaagcaaaagtctttcagtatttccgttacacattctgttaacaagaactcatacattggtaaaattcattctaagaaaacttggcaaataacgctttggcctggaattggcatttctttctctacttttccttcccaccatttcttccttttaaactacaggatttatattttaaaatgttttatttcagaacattaagatagcagttacattttttaatatttatattattttaaaatgactctttaagatacagttttaaacccatgggctagaaatcatacgactgttaattagccgcattatttggtctaacattttttatcattctgaaactggatttgtgtaatacattgataaattcatacaatttggaagagtcagttgaagttacaaggacccaatatctgccctctttcagtgaatgccggcaaatctgttattccattggcaaaatcgtattgctgctctcctgttaatctcacatttataaaaggatcatgaggctgccaagtgctaaaaatggagatggtctagtaactagaaaactccccaccccagggagcacacctacatatctccctacaacctaataatgtgatgtgttttggaacacagacattagaacttcatgaagttttaactgttgattctttcccaagcatcatcaagttatgatttaggcaatgtatgattgaaatgcattcattcatcatgcataggcacaatcacagaaatattgcacaaagtatgtccctgactgaaaatgagaggtacaaaaacgtatttcactcttcgtaaagaagtttgtgaggaaatacaactctgcgatcgtatagacatgtttcctgataatacagacattcacaaacagtagattgcaccacagtgtgtaaacattttaagttgcataaacttctccttgattttcaaagataatataatactgtctactaaaattcctttttgtttcaactaagtactctcacatatattagtttataataatgtttgttattactttctaaagtgttttccactcaaggaaaagaagtaaattcctatgtcagagtaaccgaggtggttgaagaataggtattagccagagaggtctagatagtaaaatcaaacttcaagcctcaaagaagctccatgaacagagaggaatgccaggtgtcacacagctttccttcactctaattcattcttgactagagcctgtatgcctgtttcagagacatttaaactcttaaaggatttcttatgatcttcactaaatacattaagaagaatgccaaccagcgccctttcgtgtactgggacaggtagtcatgtgattaaaacagggaacacgaactctgactttaaaatgtattgtagatacaaatgctctaagctaggaaaggtttttcacacccacagccaatgatggcagcctttcattcctcggaaataagccctttttaggtcactgaaaaagagtgcaactgctgcagctcacgatgcaatatcttcatgagcccagagcacatacaaatccaaagggaactgccacagtacactgctcattcttggcaccggaacagatgaaacacactgtatcctgcacatacctgccagagcaggccactttcctcttctgtgagatttagaaagctcccccaaaaggttatcactcccatcaccaatacacagaaaatggaggaaaggctgtttccagttctcggcctttaaacagctctaaatgtcagtactcacagtggcatattacaaagtaataaacagtgcacacttgagggcaaaccgcatattgagctatagaagagctcactgtgattaagatgagatcaaacatcatagcagaacattagcaaattttatctgaattctgtaatggacatccatgctgcaataacattagaaaagcacgggagcctattccaaaccagcgagaacagttttgtgcaaagagtgggtctttgtgtgtttgaactcccaccacgtaagggcaaactcgatatgcatgctaatgacctacaattatgaaatgaaaaaagaaaaatgctgaaggatgccagagtgaacatcagtgagagccacagagacccactctcttttaactttttacaaataaacttaaactataaattagaaacacaaataatcatgagtagctctaacattcaaatgaagtaaatgaattgtgtaggagattaaccccataactttgtttcgtttttaaaaatttcttgagcagctctttgatgatggtggtgtttatctccttcttctcggcagccaagcccagcaaaagcatggcacacagcagttgctgcccaagcctgggtgctcctggtggtcctgcatctcaccaaggagctgcacgactggctgtgcagtagggttgtcctgggaagaaccctccctggcttctccttgtgcaggctccacgctgttggtgaggctcgcctcacaaagatctttggagagagggaggcggggatctgagtggagtgctagccgccccccgctcctgcctgctcaccccgcctgggggctctactcaccaccatgcttgtcggcagccccgagctcctggggggctggggctcctggactgggttcagcagcagggttccgggcagcggccaggaatttgccgtgcccctcgctgtagctgccacaagccgcaacaccatctcctgcagctccagcagcttcacctgaagggacgggtgctcagctgtcaggccgctgctggcgcccaccctcatgcccaccccacccacacccccaccccacccccacccccacagggatgttgcacaccctaccttcctctcctccttgtcctgggccagcctgatgatggcctcctcccggtgacgcatctttggcactgtcccctggctctgttagaaggcgatgtactttcctgcgggaggacagggctcagacgctggggcccctcccatagccctgcagctccccctgccgtgccctggcctcccactcactgatggcatctctctctccggtactggatgaatccaagttccagtttctccacatgctccctcaggtccgccttctcctccaggaggtccataaggccgctctggagccaaaataatggggtcacatctcagcagcgacctgccccagccctgcccttcttggcccatgctaggactcactcccctccagcttctccatgacttcctgcagggcccggagggtctccccactcacagactcgcccccagtccctgaggctgggactgctgcctctggctccttctcggccgaggtgagcgtctccatcacctggcccagcttctcctgcagctcctttacttgctgctccaactgcagtgcgctcttgttctcgtgcttctggacagagagaagcaatcagcagccacccactgcagctggagaccccagaacttggtgtctgcctcccatggcaccgggaagggtggagccaagttagaaaaatactctcctctctcccacagccaccagagcaaagctctggctcacaggtgcctttggaagtaatatttcatgtgagggctacactgccccattttacaggtggggaaacaaaggcctggagggctagggaggagggcaggctccccaggtggggcaacccaccagctcctccaagtcgctctgtggctcggccagctgctgaagcctcttctcccgttcccgaagcctctcctgctgctcctgaagcctctcctcctgctcgcgaagcctctccttttgcccacggttcaggagactgatgcactgattgttttccacctgagcctggagctctcctgccactctctccagctccttcctcaggtcttgcagctccacctcagaggacactgctggggcatccgggggcagtggctcagctgagaaaggaagcagatcataagggcctctggattctcaaaacaaaaatcaaaacagaaaaaacaacaaaacaccctcctgttggcgcacagctcctctcaggctcccaaacttggcttcactgctaacgatccctcgcacccggatggtagccagtcttccaaaccactttcagatagagagcactgcgggtggctgacaacgggccctctttgctcatggggacactgaggctcagggagatgacaagacttgtctcctggcacagacctctttccctctgcctcaaagccctgccatccacccacctccctggggcactctaagccacccccacagccctctgatgccagtcctgctcccaggtcatgccagccccatcttacccatctggtttttgagtctggacaagctcctctccagctcctctacccgatgcgtatcatgcttcttctcctccttcaatgtgcaaacctgcccaaagcacagggggaaagggccctggagagaggggctggtggctggacaggctcccatctccctctctgcccccacctccacaaagcccagacccaggaccacctctggctgcactattcccattttaaagaggcccagaaagatccagtgacctatcttaagttgttggtggggggggggtggggcgggaggctgaagggtcagatctcacctcctgcgacattttcctcatcctctgctgccactgggccctctctccttttatttgttcagcatattgatctctctccagctggacttctttaagcgactccttcaactgcaagaatggccacacaagttaggaagggccgtcactggtcctcacctgctcctggccacctggggtcatcttccttccacatccctccctctgcaaaacctcacctgtgtcacgtgtcctttcagcagtatctgctcccgtatggactgctctaactgccgcttgagaagtgctttactgcggctcgagaactggatggtgaagagtgagaagtttcgatctggggagcctgggccattccacacagtgccccttaaaagggctagggctaggctcaatatacaactcggtcagtaaagatcaaggcatttccaagcccgtggtctggttttgaaaaaaactcagtgaagttggaagggacaaggagagagatcagataatattgctattgttattactcccactgtttgaacctttgtggagtgcttcagcaggtaccttgctagcaatcccatttaatcctcgcaaccaccagaggagacagttactatgatgccctctcttgggtagatgaaaaaacatggagtgtttgaggttaagtgcttgcctaagatcacttaggcagagctaggatttgaacacccaggtctatcagattctctaagcccatttttctgctgggggtgggggcacggttaggaaggggaaaattaatcttttgttcactttttgaaaagatgatacattcacatagtccaaaactcggaaggtatcaaagggaagtatctcccagccaccctgctgctctctcctgagttgtttacgaacacttgcagacatgttttatgtatattatcatactatgtacacacacacacacacacacacacgtttcctctctctacagaaatgggaacatactaaaggtacccttctgtaccttcacagtacaagtacccaataccccacaccccacctaggacttggccaagaccacagccaggtaagggcagggcaggcacttggcctccaagctctgcatccagtgctcgctccccaccgcgccccccgactcacccacagcagctgactcagcctcaggctgcctctaacaaccatacacaaaagcagtgagaaatggccatgctgccttctgggcaggacactccatcctgcagaagggacctttaggctcactcctccatctgtgaagccgggctcccaggggacagggcaggtgactggactcaccccatccggcttcttcttctgtgtggcggcgacagcacagagagaccactctaactctcctatacgctgcgatgaacgttgcaggcggccggccagatccttggactcttctgtaatgacagagttgacatggggctcaaaggactccgccttacagacctgtcaaagtgccaggttgaaggatgacagggtgcccagattcccaccttcaaagtatctgagagaatgtttcatgtgatacaggtccgtatttagtttctttttctctgtgttcaatctctggatttgaccctttgggagaaaagccaagcaagtgctgaaatagaaggaaagaaacattctccggaggacaggaggaaacttcacaccctccactcacctctagctccctttcagctttctgtttctcattgtttgctttcttttcctataggaagaggaagacagagctcttaccagggggaggcagagaaggcacagcaagagatatgcccccagaatgccaccaatgccccaggacaggcccacccatgggaccaggttatcagggaccctgtggggatggggtggaatctgaggggtgagcctccttccccaggctgggagtgggtgagacgagactggggcctctacatctgagtgtcccccaaacccagcagtcatgtcgccagcaaacaaagaaatcacgttacttcttccagctgatgttccacttgtttcttctgttgtttctgtggggagagtcaaattaaagtgatggagggtggccccctcaactctattccccagacaggaagcggcaggcaggggccaggaatggattttaaaggcaaagttctcagacccaatgggaacaggaactgttcccaagctcccaaggacagaggatttgggtctttgttggttttcagccacagcctcacaactcaaagtctgaatcaggaatctcttgagaggacagtaacataaacctctagagatggagtttgagaaaggctcccccttctgccagcttgtgatttagaaaagtgtgttcattcaatagacatttactgagcacgtacgggccagggatggttcttcacagccgatataggatggaaaagaacagacaagagcccttggccctgagctttccattctagggggcctttaaatctcagactctcagagctaacacagacctttgatactcactacctcctctggaaacacgagcccaaaaaggagaggtggcttgtccagaatcaaagagcaaattagggactgagtcatggcagaaatacggggcccctgacaaccagtcaggccagcacttccccaagaggcaacaaccccagggcgtgtgtagcaaggactcgagtaggggtgcctggagaggagagagtcggcaaagagggcagcaaaagaagagccatgctgcatgctctggggtcccgccaggtgaggcctgggcgccccagctccctatctgcccttggcaccaggggcccccagcccccttcttcagggccccaagaggaaaccggagcccaggattggcagcgtggaatcaggggaccccactggactcttaccaaagatttgatggtgtcattcagtcgactgatttttatggacctcgagttcaggactgctgcttgttcttggcacgggctctgacgcgcatgcagagaggaggaggcggaggaggacttgggggagaggtagagagaacgatcattagggctgggttgtgtgtgggctgtctcagctggcagaggggcacccagtccccgctgcgggaggaggttggagggctggcctgcggggtcactgcacctccgcccagagcctcctacctccagatccttcagggtagcagatgatgtagggccctccccgtggatacctgttgctgactataagagatgagactgcacatggagatgttctgtccccctcagtgtctgagccctccgacttcctttcttccccatcaactggcaacattttcttttctgcctatcttggaccctttgtcccataactcctttgtgccaacttctctcacggttcttatctccccaccatcccaccctgggggccttgcagtgactcctgatgggaagtggctgttctcattgtcctggcttccccttgagactggggatgaggaaaatcaaacagcaaagaccatatcctgggtgtcctgggtgttgacagcaggccatgtactagggattaacataaaatcgacaattatcaatctcattgaaacttcacaaatacaagtcaaacaataccacctctatcatacagacgtgaaaacagaggcccaaagagctcaagcaacttgccctaaatcatatccctagcagacggagaggcaggattcaaacccagaattcttttcttttttgaaacggagtctctctctgccttccaggctggagtgcagtggcgtgatcttggctcactgcaagctccgcctcctaggttcacgccattctcctccctcagactccggagcagctgggactgcaggcgcccgccaccacgcccggcttttttttttgtattttttagtatttcaccgtgtttgcctggatggtctcgatctcctgaccttgtgatccacctgcctcggtctcccgaagtgtggggattacaggcgtgagccactgtgcccggccaaatccagaatccttcaccagtacccaacagtccatccacaatcttaacgattgccctctactgctccttgggccccctgtccccaaaagcctgtccaggcaagactcacagcctcagatgagtggcaaccaccagaagcggccgtctcagggctactgccatttgctttcgtgttcctcttcgctgctgctggaacaccagggcggtttctctgccaatattctttgaactgtgggaaagaagagcagtaatactcatgagaactatcagcccctacagccacatcctcctttatagtttttataaaatactcttatataccatctgatttaatgacaccaacaactctataaggtgtcacaatcatttagggactgagagggatcgacatcatggctagaaaaaaagaaaaaagaaaaaagcgatactggaacttggaaactcagtcttcccactctaagctctggggttttgccaggcaccaaacccagaggcagaggtagaaaagtaaacattaagtaggcaggagctgtatgtcatgtggtttagagtcgtacatcttcacacgtctgttattgggaagaagtgcaccagtacctctcaaacttttatatcaatgtgtcctcatggcagaaggcagcctttctgtgaaatctgggaatttatcagaaagaggacaacccaagcctcatttcagagagaagtctggtatactcttagaaacctatgggactgccatccctaagtacattcatgttttttctcttatctcaagatatctcaagagaatcaaaggaaactgatgcttcagaaagatgtcccacatttatcctgtggtactcaaagcaccccagcttgagataatatgaggaagattcaaactgtcaagttcagtctcccaagatctattccacagaagatgaggaaatctcacttcagagaccactgactgaaggtcccagactgaagtctggtcccagaaccatggagaattagaatatgaggtggagaactcggaaaaaaatgttaaaatctctttggaaagtagaagcttgggagaaaaaccaaaccaaacccattctcccatcgccacccagagacactgtcaacgttttgagctcacgggggaagtgtaggcttttcccactgtcaatgtctatggtaagggagtaaggcagcctgaaacctcttgctcccaggtcccatagtctccatttcccttccagctggaaatttctgctgtgaccagaagaaccagaaacggggtgacaacgtttaggggactgggtcataagaccagggccagtcttccagtaatgacagttagtaggcagactgtgacatcactacattccactcctcctagtgcgggggagggaccacatcagcgcgatgtccgagtctccactccacaacgcgggagggaaacacagggttgtgacccaggtccttggagacgccagcacaaagagctcagggaggtcgaccttgaggcagcaggaggggagggcagagtctgcagcagggagccccaggagtcaccagcccaaagtcacccagggacaactggcgagggcggggcctggggctggggggcccaggtccttggatatgcgagcccaaagagcccagggaggtccaacttggggcggcaagaggtgagggcccagtaatggagtggggcgccccaggagtcacccgcccaacgtcaccccggggtgatcggcgagggcagggactgagctgtttgctgaaggggcagggctgactgacaagacttttgtagggggagcccagaagcgccggggttggggggcaaagtccggtgtgcgtcaggagtagtatggactgtggcagcggtcttgtcgtcggaggggatctgtggctgggttagcgggccatgacccggtacgtctttacctttttcttggctgcagctaatttactctgtccagtttcttctgccattgtggggtggggagggaggcggggctggggccacgtcagccaaatcccagcgagcgctgatcaacacatccagtcacctggaagacagctgcgtaactgacccagaggcagcgtaaccagggccacagtagaatgcagaataggggcgtggccttaatgcttcaagcccattggccaacgagaaagatgacagggaaagggggcgtggccaggcggcagtgtgtccagagggacctgtggctcatcaggaaagctgcccatgcaaccgctgtccccacccactctgagagaggggaggggccgcccgctctgggagagtggaggggctggcttttgctttaaaacccttaaaactttaaaaatcatatgtgtgtatactttatatatatgtgtgtgtctctctgtgtgtatccatgtgttcctccagagctgtcttcattaaccagcttctatgcaaggtctgtcattttggcctatatttttcatcttcaaatactgtataaaaattaccagtattacctgaactgagatacagatcctataaaagtgggaaatccacagcatgcttgatgattaatgaagcagactatattatccaacattccaatgagataaaataatcaaaatgatttcttttttggaaaaatgtttctcttattctcctacattgttgctgttttttctttttaaacaggaaacatggttaatatccgtaaaaacacaaagcttttgggctgggtgcggtggctcacacctgtaatcccagcactttggggagcccgagtctggtggatcacctgaggtcaggtagtggaagtgtgagccatcacacccggccggcttcatttcagaactctttccccagcactccatatactatgaataattcctttcttcttctttggatagcattttagtcatatctctattaccccacttgtcacatgataatcagtggctcacccatccatctcccttgattgctcatgagctccttgagaagagtctgattttcagcaccttgaacagtgtgccacacatacatgcttcatacgcagagaaggaaatgatttcactacagtgtaattattcccagaattcaatatctgtatttctaaattgttctagatactctgccaacaacctgagaatgttatgttttttccccaaaacttccatccattattgtgtgtctatggtcatagttaactcaattgtgacgtcacctttggacaagcccattaacagtttctttttttttaggtgatttttaattttaatttttgattttgattgtttcttttctgttttttaaatctagcagtgtttggtaaacttcaacatctctatatccccgtgtctctgccccgctggtctctgcttggaataatgtctcaaggttttagtcacctggaaaaaatttctactcacccttaaagaatcagaaataaataggctgggcatggtggctcatgactgtaatcccagcactttcgggaggccaaagtgggcggatcacctgaggtcagtagttccaagactagcctgcccaacatggtgaaaccccgtctctactaaaaatacaaaaaatagctgagcatggtggcagaggcctgtaatctcagctactcgggtggctgaggcaggataattgcttgaacctgggaggcagaggttgcagtgagctgagatcgtgccattgcactccatcttgggtgacagagtgagacatcatctgaaaaagaaaaagaaaaagaaaaagaaaagcttaaataataccttctctgagaagcctttatatcttcctattctttcaggaagtgttgaaaattcctcaacttttgaaacatttgtgcctctattactgtgtatcaggcagtgaactgagtgcccaggatagaaagatgaaactgtagatcctgcccttacggagctcatggtctagtatggaaaacagccatatgaacaaataaccacactataggtcttcagagctcaagtcctatcctaaatactgtgaaattaatgttctgtgaggttttgaaagtactagggccagagacaatatggctgcttggatgactttccatccaagttaacattcggccctcatcacaaagggaatacatgcgtgcatcttccttgcaacccaccagtgcctaacacatcatatcaccacttttgaaatcaggaaacaggctcagaagtccaagagcttgaccaaagtaactcagctggtaggtagcagagccaggtcagtatgattcttcttcaatatcctgccagccacatgggcaagtggcctcaaaatcaacaaaagacaggtagaggttgacatgcatcaatggagagaggctcaaaaggaggattttatacacaagaatagaacagaaatgttctggaagtatatctgtggatgtgaagcaggagggggcacaccaggtttcaccttggtcaagtgaatctataattccaaccggggcctcgccgccccccacccccccgagctccagacttagctatctgtctttcttactctaatataaaatccacagggcaggaccttaatctctagcttgttcacacagattaaagcagagtctggcttataataaggacttaataaatacatgaatgaataaataaactatcaaagaagctaaagaaacattccacattcttgcgggaagggattaccatgaaacagaccctagcagtcacttacaaatacagttgaccctcatcattggagtatcccatattttcaaattagcttacttgctaaaatgtctttctaagtcccaaattaatacttgtggcactttcaaggtggctcctggatagacatgcagtagtgaaaactctgtcactctttgcacacgtcccaagctaaggtcaaacagtgaccttggtctgcttgtttcaactctcatacaaagatgacctgaggacagagacagtagaggacactgcagggtagcgcaagaagctgtggctctggggccagttgggcggggtctgaatcataacactggcacctgttagtggagtggcctcagacaaatcacttacaattctgtacttcctttattcttttggaaagaaagaaaattcaatctaccaggatgagttgtttttaggaattaagatgataacctatatgacatatgtatttatgtacatatttaccctggaaacaagggtttgctatttgattaattcagtgttccaggcaactttgtagaatattactcctgcaaatagtaagaattggctgtaattaaagaaataacagagatgtagacaaaacaattatttgggtgagctacaggcagtcttcaagaagcttctgaagaaacagaacttcagcaggcacttaagctgtagaaaaggcttgcaaggagatagaacagcacctacagagagaggtccaggtggggtcaggaaatggcatttcaggaagtctagagcagtagaagatgaggccagaacacggcgccacagtgctgctctgcaccctctatacaccctgtactgcagaacctcactctctgcatttagttcttggtttctaattctctcttccattaaactgtgagcccctcaaggtcaaggtctctaagaagaaaccatagctacagtcctctaaatttgaaaacaagttattaaacacagatacacccaagaagaccgtacaaaaataatgttggatttcaattgcagtcatagaaattcacaactggtatacatttgcaatctgtccaggatttttctctgatgactgccgtaactctgtcataaacccttttcattatttgagacaccgagacatttgttagaatgtttgggaaagacattctaaaagggcaagaaagaccttgatcttttttgtgtaactgattgactggttgactgactgagatgggatctcattatgtagcccaggctggtctgaaactcctaggttcaagcgatactcctgcctcagcctctctagtggctgagattacaggcgcacgccaccatgctgggctctagtgtgatgtatttacgaggcttaaacatatggttcattacacaaggctggcacctcagagtaaagattttttaaagttcactctaatagacttatttctctatatgcaagatacaattttaccacagtaaaacacaaggaagcatactgatatacatatatgttacaacaggataaaaaaaagcaatataattttctccacaaaagcttgcaaaatcctggccaaaacacagtaaagaggatgttaatctcacagctcacgtttctccactgagacccaggaaaaacaatgccagtttttgtacagtcacaaaactaagcactgtgagaatttacaagatttggttaacttgtatattctccccaccctgacagacaagtcccaaaggagcctagcagttttaccccaacatttcaatctcctccaacctccaaaataaaaccctcactgtccaatatctcaatttatattttcaaacgtctaaaatcttaatcgaaacaaagagcagtgcattagctttgccgccatagaatgcttggtataattttacttaggcacatcacagattgtgctattgcctaaaaacatatgggtagaaccaacattcctagaaaccaaacgcatatattacgaaggtgaaagggaatagggagtgttgtttttaaacagatagaacgctgtgattgtccactcataggttaggtgtgatcaaatcacatcgtgctgtacagctaagtatgtcctatattgtatgacaaagtagggtaacacattatttattgaggacctgttgggtacacagaggcacaccacaagctgtaaaagacttcattcttgccctcaagaaacttccaagtttctagacagcctgatagaaggtagtcgaaagcaaatacttcaagcactagccatcacaattaccttaggtatttacgctacccttctacgagtctctgaatatttcgaggccccctttcctatttcccatgggctctatggctcaacattctttacagccacaggctttcctggactttacgttattattgaatcaacattgctcactatccgcctcctttgccaattaaaattccactttacatccaaccaccactttggctttgaagccactgcctgatactgacgctctgtcgatgtacaatgactattcttacacgtctctgtctactgaggaggatcctactcttttaacagaaacagtgccattgacttccaatcaactagtttccataatatccaaaatattagataatattccattatactcccaaaacaaataatgagtgatgttctctcaaatacacgtataatcaaatgtgacattgagaagatggggcgacctttgactcagagattgtattcaggcctttgtagatgcatttatttgacataattatgcatttaaaacataagttaaattgtcatcagcctgaaattataggggcttttgttggtgagaaacctattttatatataatcgtttacccatagaaatgtttttgattaatgttatctgttaaagacttcagttcacaatatttcccctgttaatagtatatatgtttttggagttgatctggagaatttgaggaccacgttctaatcgctatctgatgctattctgggaggacaattcattgcctttgggttgctgggggttggaacttgaaggcgggtctgagtctggagaccttgccactgacttttggaaagtctgttgattctacctttggaagtgcctttacatgccttatggaaggccgggcatggtggctcacgcctgtaatcccagcacctcgggattattgatgaataaatcaatttgggaaatgcttggtaaattcaacgggacctctcagaacaatgaatttatatggccacgatgttgttttctggtttgtttgtttttttgtttttgttttttttgcaaagagcattcggaagactttctagtacaccagtttgggaactgttggtggaggagtcagggtaattaggctttggactattccaggtacaggttgtcactgtattcaaggaattgttcttagtctttgtatatatccgaattaactatagcaaattaacaagcagaaatataagaattgggccttggagggagggagagggcgagagagaggggtagatagaagtttcctattttaactatggttcaattctaagcattctaaaatttcattggattcttttaactatgaattacaagggtgtttaatttccaagttcatgaagcctttggttaatctcttcattattaacttctaaccttaactgcttcatatttaaattatcaattttatggtgtggattgtaccaattgtttttcaatcttctgacgtgcttaatggattaatacataattaatgtttctcccacagtccacatatgcttgagaagaatacagaatatctgattattgggtacagaggtctatatttgtccattacatcacgtccattcacgggttattcaaatctatatatgggcattctgtgtaacttacttatggtaagcagggtatgttgaaatctccaaatacaatggcagactcgtcaatttctccctgtggttttatcagtttttcctctgtattttgagtctattttgataggtacataaaatatgaaaattgctacaacctcctaattaacagtcagttggcatcaagctgttactaatgctttgtgttccaacatcctatcttgtttgaaactgaagctccatcagttgttttggttaatgtataccggcatatctttctctctctctctcctttataaaaactttcaatcttttcacatcctcatagtttcaataagatggattagaacagctggatatcgttttattagttccatctgtctaactggtaactttagtccatttacagttgttgtgactcatttatgtggacttccttctgtcacctttagaacttccatttctctcactttccaatataattttaatatctcctcctgggattccactaagacgtattttagacctcattctgatctccctctccccgccaaccccaccaacttctgccctgtcatttatcctcatatctctctgtgtaacatatggacttactttttggagataatggtctaaccaattaatcctttcttctggtgtctaatccatccactcggtttcttatttcaacaattccattttatatttccttatttcattttattctgagacagagtctcactctgtcacccaggctggactgtagtggcacgaacctgcagccctggcctcctgggctcaagtgatcctcccacctcagcctcctgattagctgggagtataggcaggtaggtgccccatacacagcttttttcttcttcttttttttttggtggtggtggggtattttttggagaaacgagttctcaccatgctgcccaggcttgtctccaactcctgggcttatgccatcctcccgcctcagcctctcaaaaagtgctgagattacaggtgtgagacaccatacccagctatatattttatttctgtaagttctatttcatccattttcctttcaggtcttcctcatcattcctggtggtcttactgctcctgctcgctcaattttatgagtccatctttttcttatataatacatttatttcacatgtaactattttctcacaattctaatatttgaagtctgtattctgtatctgataattccaaaacctacagtctttgggaaacattcattgtttctgataattctcaaatatattgggttcactacttgaatgctatgatttcactgaattcatagttgcctgcttttaatctttgggaatcctacaggcttaagttagagatggtttcctagaaaaagtatctgtgcgtgcttctgatgagagctgtggggacaactaacaagagacccctttaccaccgtccgtaatcctgatattctcttggattctcctggagaatgtcaggattacacaaggttctcaaatttggctccccaaccttgctcatttatatacagaagactagactgcttagtataggtgatgactcacttcctcctaccctggaaaaaacaaaacagatctctcatctgaatgtgatcacagactaggaaattctgaaggtgaataactggaggctgtaggcagcagggaaagacaggtgtctttcctgaccatagaaataggtcacaagctgccctaaaggctgtgtgctccaccaggatttcactatttagctcaaccagcagtccctctgtaagagtgaacggaagcttcttagagcaccacgctgcctttaaaccacaaattcttgctaaaagtcatggtcatggtaaaaaacctatggctttgcaaggctttcttggtaatgtcctagaattaaggttaagcctgcgtttcatggtaactgaacaggaaaccagcctgaccaacatccttctccccaatggcttgctctcagctcctcttgcttgggccttgggcagccagacggtctggttttaatccttgctctgccacctgtgaccttggacaagttacctaccttcagttacctcatccacaagatgcagatattagtaataccctctttttaagttattaagaggattgaaagagttaataaaaagtaaaaaaaagacttggtaggcataggcacagaggcgggaaaaaagcaataataaagaaatgatacttctatattttctatagatcatctttgtaacaagaagaaaacaaaccaaatgaaaatgaaacaaattctctcaaaaagaattaagtcaagacaggcagaaggctcacaaagtaatataaaatatatcttatggtttatggaaaattcttaataaaataccttctttgctccaagctgcactctggctttgcctttgagtcacgtggcatttctttgtacgatgaccggttctgtcgagtaggcactgcttcagccctacaggaaggaaaaaacatctctagaaaacagcagcattcctgattcccacttgaggaggcctaacaaaacggcatatgcctcaacagcagcacatcagtgttaaaaagtctggagtcaaggggaaaaagtaaaattggaccatttccagaatctcaccaaaaacaacaaacggatgttgcaagtggcctacatgagcaaattagaaccttaaataaaggtcactcttaatgcctatcccagcatagatgcagcaccaagtacagtgtcattttactgggttacctttttcattcttgaaagtaggagctatgaaaaaaaaaacactaaaatttcttgaagagaaccttctacttacaacctaacttacgtaatcgaaacactctattgagggtgaaaattgagtattataagaaaataatcacctgttttgtgagaagttcaatacgtaatgctcctccacacaatacataccttagaaagaaaaaaggaaacatacaaaactatctcgagaattattcctgcttaaacaatttctacatgccattactaagaaagtatgcacacagtaaacatgagaagagaacatgcaagcatgaacatacttgttagggatacaggactatgggtaacttaaaaactctgttggtattactctcatgtaattgctctgaaattctagtcaactatttgcaatggctcttagaacagaatactttgaatttttatgatatcaaaaactaagaacttagccaagtattcccaagaataggaatagtaagcatacttagtaagtattccaaagaataggggcagaagaacgcatttctttaaagcactacctcagaattcaatttagtaattccgatgctgcctgtaacatcagaaaacaacttccttaaaaacatagcaagttggatttaccaagttgctgaccaggtcgcattccctcctgccctcaatcccatctttgtgttatactttatctccagtaccattttgcttagtattcatggtgctcaagttgtcactgtggacatcagagcctataaatatatattgttctggctccttcctgtacatctttccaagtcatacctgctattctccaaagtctgtgaatcccgacactaataacttggaaattcagtttaaggtcctcttcagaaggtcagttagctcaaggcatcacatttttctcaggactcttaagaaatactccaaccacagaaaaaggcccttctttctggtatcaggagccattggccacaaacacaaatccaatagagtttcagccatttacctcccacatcgtcccttccctgaagttctagctaaagcaggaaaaaataatgaaaacaccacctgcagtcacgaatcctccagtttcctggccaagatttcgtatttccttcaagatacctcccaaagaggacatgacgagggaggggcacacagggtgctacaggtactgataaggttttatttcttttatatatatgtattttttgagacggagtttctctcgtcaccaaggctggagtgcaatggcacaatctcggcccactgcaacccctgcctcctgggttcaagtgattctcccagctcagcctcccacgaagcgggggttacattacaggcgcccgccaccatgcctggctaatatttttgtatttttagtagagaaggggtttcaccatgttggccagcctgctcttcaactcctgaccgcaggtgatctgcctgccttggcctcccaaagtgctaggattataggcatgagccaccacgcccagccaaaggttctatttcttaagtttggtgttgggcatatggatgtatgatttaatgttttaaaaaaggaagataccttcctagtttttttgtgttttgttttttttgttttaggcctgcgtgctttattcgttaccccgtatgaatccataaagaagtagccattagcaaattcaggcaatacataccggattcatacttcaggaagacaacccagttgacaacgacaacagtttctatgataacaaaagtgagagaaaatactgacattagggtcatatcaagaaagttcaatcataagatatatccacaagcaaaaatatacacacaaaaagctaagtacgaagcttttagaaaactactaccatccttagagtaagtacaagaaagtattcttttatgtctgtttttttcatcaaaataccgcatatagccatagattttaaaccattacatcttatctagattccattaacatttcttctagatcactaacatttcttctagattccatcgttattcctttgtaacctttattttcagtatcttaaaaatactttattaaatataacacatacattcagaaagttacataaaatatacctgaaggtataccttaacaagttattgtaaattatttgcccatgtaaccaccaacctggtcctgaaatatattccagccagtatccaagaagcccacagatgtccctttcaggtcacacatccctacctcccacctggatggactccttcccctaacctctatgtgatcacctctttgttcttaatagttttactgcccaagtatgaatccagaaataagtgtttctctgttttcttttcacttttgtccccctaagaagcctttttagaagttttcttcctaattctatccccactccccatggaattttaacaccacagatatactgtatgtcggtttatgttatacggccctttggagggcagcagaccattataataggtaagattttctttcactctaaggaccaattttcactccactgcaggcgatattgcctccactaagaatgtatgccctaaccaacattagttttccctattgttgaactctatatagaggaaattgtacaaaataggttttggggctctggtctctttcgcttaacatagtgttcaaggttcgtccatctttcccacatagctgtaagccattttatgaataccacaattcttcattttcttggaatgaacacctgggttactttctgtttggggttatgatacatgatgctactctgaacattccggtgtctcctggtgcctatgtactcatttcttgtggagtatatatccacaagattcctgaaccatagtgtatgagtatcttccactttaccaaattgttttccaaaacacttgtacaaatatacactcccattagaaaaacagagtcccgtaacaattttattaccttaaaagataagttaagcaaagtatctcctatgccttctttttcttttaagatctgaagatcactgtgcaaaggactagcagggtcaacccgaagaatcacaaaacaaaaaacagttcaaacaaaaagatatttttttttcaactaactcaaaaatgaaccaatctgaaagctaaaatagagcacctagggtaagttcaagaaagagaagatcttaagctgctctatatcctcaggaaaaacagaggtcactatagcttccagctcctttagaatgaatgtccaaaagagatcataatagcctaaatctaatctaataagggggttcagagtttgcagtcattctaaaggaaaacagtcacatgtatataattttctcaagaattcaaaagaagtttaatatgctttcctaaacttgtattattagtcaagcagttcaaggagaacaatttgccatggacggaactatgaaaagttaaatcactaaaaaatcggtatttttccacaactgtcctatatatagatttctaatatgactcccatcccccactcccttttcgtttgtttgtttgtttgtttgttttaagagacaaggtgtctcgctctctcacccagggtggaatataatggtgcaatcacagctcatgtgcagccttaacgtctccaagctcaaaagatcttcctgcctcagcctcccaccatccatagtagcttgtactacaggtgtactacaccgacgtattttaaaagtaataacataactacatctacaataagagttaattatattgctttcaaaactgggggaaaagtcataaaaatcaacttggcaatcattctctgtataatgaaatatattactcttgtttactttccaaccaatattattcaagcttgagctttttcctagaagataaaaatcaagcaagagttcactctatcaagaaaatgacaaaaaaatttcgatggacctataaaaacatttccaacactcaacatttcaagaagtaaaaaaaaaaaaaaaaaagtccaattaaatgaagcattatgaagtttcaagagaatataaaactagacacaagtctggttcgtttcctatttcttatcatctgaaaaactctagccaacatgttcagaccaccatggactccatgatagcacagaatttagtatgagtctattccaaaccccagcaatttttgaaaatgctagaagacactcaaggtgacacattactgactaagagagacttccattcataagactacaagcaagaatattacacagatggtctagttcacacattgacacactgagaaacacgtgtacctacatgcaactggtttcagtttttcagtgtggggacttctctaaagatgaaaacacatcgatatcttatcctaagactaagtagaaatggaactactttttagtcatgtgaaactaaaggttttaaagactgcactatactttgaaaaagaaaaaaaatcaagtttacgaagatctcacttcctagatatgtaaccatgacctcatttcctatctataaaatatgagaagtttctcctatctctaaactatgaagagcacctatttcacacagcggctatgaagactaaatgagagcatctataaagtataaagtacttaacatagtatcggtcatgcaaaagtgttcaataatttatacttgttttgaagataactcaaactggaatcgatcacaagacacggaaagtacagtaacattatttcaaatgctacaaactcagttttttaaataagatatgagaaatggactaaatttctttcctctgggaaaaattactaattaaattaatatataactaagactgaaggagggagagtaatctatctggtttcaacacttggcatctacttgcctaacaattcattccctgttttggagaacctgtgcccaagacaaagtaactggtcctcggctttcatggagttggtaaatagctctaatacaaggcaggaagtagtaagtgttcagacaatcatctgacgtttccctactctgtctgagcatttcatgtatacacacacatcattctcattgatttttcacagcagtcatccaaaaggtatgtactatctatccatactttagagttgagcaaagtgaaaccaaaaaaggtgtgtttgtcaccacactcagtgttcctttcacatcctgccacttcacataaaagagatgttaagtcaaaagagaagaattagttttgatttggtcagagcaggatggaccaaagtcaccttcacgaaggagaaataatttgagttgtgttttgtaggagagaatgaatgtgaatatacagatgccacagaaggaaagtaagcagagaaaacagcataaacaggctggaaaggggcatatacagggatcagcaggtggttccaggatgtgaacagcagatgaacagggtaaaaagtggctgttcatagatgagaaagataaccttgggcaagagaacatatgaccgtggctagggacggtggctcatgcctgtaatcccagcactttggcaggctgaggtaggaggatcgcgtgaactcaggtgttcaagaccagcatgatcaacatagtgagaccccatctctactaaaaatctaaaaaatcagcctggtgtggtggctcatgcccatagtccaagacacttgggagggtgaggcaggaggatcactggagcccgggagatcaaggcttcagtgaactatgattgtgccaccgcactctagcccaggcgacagagcaagaccctgtctcaaaaccaataaacatgtgactgaatctaccactaaggcaggaatggaggagagcagctgagattggcatgttcatgaattgcctgggattaactataattacttaaacaaaaatccaggctctagctatttatacacacttacgcagttaaatgctcttgtctttcagtcttcctaatttctctaatattgccaaattttctttttcaattccttcatcctccaactttttcccactaatgggctctgctttcatctcgtagtgatctaagtcttctatatcctgcaaaaagaagaaaaatgttagcttattcaacctatttttcttcagcagtttcttatgccaaaagttaaattattcttgactcaatgggggacaagaaacagaatatatctatcctacggggagagaggaaaagcccccacattccattcaagaggctcccaccttctatatcctacattttatttaaaagctacactctgggtaaagcagatttcaaagctttacaaagtcataactattaagaaataagccatcatttatttatttacttctttaatttttatttccttttttaaaacagagtctcactctgtcacccaggtgggcgtatacaggggtgatctctgctcactacaaactctgcctcccaggttcaagtgattctcgtgcctcagtctcctgagtagctgggatttcagacacccatcaccacgcccagctaatttgtgtatatttttagtagagacagggttgcaccatgttagtaccagcctatctggggctttataaagttaagaaaagagcctgtatgcatgctgaaggctgtgtgaccacagggcttttaaaggatgcttctgtgttcccacagttaggtgggagctcttggaaggatctcttttatcccagtgctcttgctaagaatggaaagcccctctgcataactgcagtagctggtgccatcctctgttcacttgcatcagagcctgggaggttgtggtctgcaaagctcacctctcataatgggacgccaatcaatagtatccgaagttgatatacccagaaagagagttcaaaaattatttagagaggtggaaaataatcaccagtagaattaaaatcagaaacgacaaagttggccagcggagtggggaagtccagattggggaatgtgatgtttcattataaggtctttcagcatttgcttgctttggtctgagtgaaagaattgtctcatttttttgagggccatgtacagcaaaggactcaccatctgtcagacacactggtcagttctggcaaggcagagttggaggttcctgtcctcaggtgggtgggcagggacggcagcttgccgtaaggtatccaacagcaccagcggcaggaaatgaaaagtgctcagtgattggtgggatagtggtgtctagcacaatgattcctgccaaaatcttaatggtggttgggcatagtggctcaagcttgtaatcccagcactttgggaggccgaggtgggtgggtcacttgaggtcaggagttcaagactagcctggccaacatggtgacactctgtctctactaaaaaaatacaaaaattagccgggcgtggtggcacgcacctgtaatcccagctactcgggaggctgaggcaggagaattgcttgaacctgggaggcagaggttgcagtgagcaaagattgtgccactgcactccaggctggccaacagagtaaaactccatctcaaaaaaaataaacaaataaagccacaaaaacaaacaaacaaaaaaacccaatggtgtgcaataaatgaaaatgctgccccagtcagacgggactagcatttttcagcaactttcaaggtcttgtgtcacaagaatgaagatccgagtatttcccacctgtggagggggctggtgaaggagttttcagtcccgggcaccctgggctgtgctgaaagcctctgcgtcacactgcgtgagttagctgggaaagagagctcccactgttctcttttaacccttgtccttttgtaccacagcaattgctttcctggagatcagaaccgtggctgggtttaacatcatctttggaaatcctaaaaggcaatgaagcaatttttctcttttcatttatatatttttttgatacagctgtgtcagtttgaaattttactttcgtatcagttctaatagtgtgtctgcttgacatagtttctattaaatgggcttgatatgaagttacttaaaaattcaagtatttagagtttcagggcccatcgtcttgatttttggggcaatacctcaatttcatactgtgttattcttttccagagagatgggtcactgaataacttacattttatgattgttttatgagaaactatttctggttacaaatggtaaacatctaggttttgcagtaagaaataatggattatgttagaaaaaaagaaccataagaagatgtgtttttaattttgacttcctgtaagtaccttctggagcagaaggttttctctttgtggattctgcatcttggatttggggactctgttgcactgagctgtgctctgtggggaggagcctgtggcagaacagtttgggttctgctggccgcctttccctctattcacggagtctgggtcccagagaaagatgacagcagttaggtcttgttgggaaaaaaacgcggctaccaaccctggaccattttgcttcccctgaacaaataagatagtcatttgcctacttttggggacggtgcctgtgctttgcacaggacgaggtggcagctggcttgcctgctggcctgcttcctggagataggatgctcagacccaccgctgctcttcaggggtcgtggaaggaattaatgcacttccttctgtcccccaatctctgtccctttacgtgtctctggagctgagcaggtattctttttctttcttcatctcagtagagctgttaaattaaatagatgttgcttaagccattcagaaaggtttcacattttaaaaaacaaaaggtagctgctgccatgattcctttgcccaccgctacaccgtgtcgttgtaggacagtccccacttggctgtgctgagcctgtctggaagtgtttctgattctaatcagaagtggaacagtttcagtgcagactataggttcatgttagtgatgaacttgggtggagatggggacacagcttgttctttcctcctggactctcatccagggtcctgagctgccaggggcctggccactctcaccctgagccctgccctggctgagctgatcaccgctgcatgtcccagctgccggtctgcctgtcacctgcagtgcacatgtgtgcatgtgtgtgcatacgtacatgcaccacacacataccatgcccacctcatacacaccacacacataccccatacacaccacacaccaaccacacacattacacacactgcatacatatcacacaccacaaacactacaccacgcacacaaaacatacatacacgctcaagccttccacactacattacactccacacacaccacacatcacactccacacacaccacacgcacatatcacattcacatcacaccacaccacataccacacaccatacacagtacactccacacaccacaccctccaggacgtcccaccaccatacacacacaaacaccacacacccacaccatactacacatttaccacatacacaccacacacactgtatctcatgaacacaccacacacccccgccacacacatttgcatgcaaactactcattgaatgaaaccgaatgatttagttttccccaaattaatactgcctgcctgtgcacccctggctgtcctggccggcacatcccccggtcctgccctcccttgggtcagcaccgcctcctgtgtctcaggtgtctctggctgtgccctgtggcgtgctcatgtcctgatcttgtgggaggctggctcctctgctccagtggctgccttcctagaggagaccagcttgtttgtcacctctcctgatgcccagagcagcagcccacgggggaagtcctgcttcctcccttcgctgtctgcccttccccacaggttgttttgtctcagtgctgatatctccccagctagaagaggagaccctcaaaggtgcacaggtggatttgattataatgcaggtgaatattaaatgcgttttggtgaaacactcaaccactacatacatctttaataaagtaaaatgtccaggccccctctgctcccacctctctctcccctcccacctctctcccccctcccacctctctcccccctcccctccccagaggacgtggctgacaagcctttgaggggtttcccctttctgtgtgcctttgcgtgtatgtatgggctgggcggtgtgtgtattctctagacatcttgacggacctgtaactgggatctacacacgtgcgcttgctgtagctcacttgccattttccctcaaaaataggcctgtaaaatccctcactgtagtacgtgttgccctgcctctttaaaaatgccaccaactcttccagcacgtgaactctgccgtcatttttttaaacattctcttatttatgggtacttaggttgtttccagttttttaagagattgcggcaatgaaaatcttcagctatcatttttcacagtgctgtgggagaacgtggttggaggtgctgtggcggtggagtggccccacacgtggccaggctttgtggggttctgactctgtccttgccaatgttcctccacacagtggctgcctctggggaatgatggctgtgtgagcgcccgccatgccccaccagaagagtctaccatggcccaccggaagcgtctaccatggcccaccagaagcgtcagagcgcggggagcagcatgttggaccacagggcaaggccgggtcctgtcccccaccaccaggagcccgagagcgaggacgtggagctgcccttggaggactatgtgcccgagggcctggagctggtcaccctgcggccagagagccccacgcccaagaagcaggagtgccacaaccacagccccgatggggactccagttccgactacgtgaacgacacctctgaggaggacgactatgatgagggcctccctgaggaggaggagggcatcccctactacatccgctactgccctgaggaccaaagctacctggagggcatggactgcaatgggcaggtgtacctggcccacggcgcgcatcctatggacactgacgggtgccaggatgcagtggactggacggcctgggcgggcctgcacccccatggtcacggggctaaaggtagccaggactaccctgatggccaactgcccatcacggaggatgtgtcctccgtcctggaggcccacgaccaggaagaagacggtcactactgtcccagcaaagagggctaccaggactactaccctgtggaggctaacgggaacaccagcgcttctgcctaccccctgaggtgcggggacggggacctggaggaccaggaggaggacatcgaccagatcgtggcagagatcaagataagcttgagtatgaccagcatcaccagcaccagtgaggccatccccgagcatggacctgagccagggcctgcggactctgcagagggctgcccacccatcaaggccagctgcagccccagcaggcaagaggcgaggcccaagtcgctgaacctccttcccgaggccaagcaccccggagacccccagagaggcttcaagtccaagaccagaccccagaagagaggctgaagtggcctcacgagcaggtaggactctagctgtcccggggaagggagcagaggggccctagagcaagggacctcagggtacaggcctcgcagatgctgaagcgaggcggtggggggtgctgggtgccttacagttctaatggtggctgagctcttcattggtccagttgggagacatgttgcgtggatgctccggccactcttaagctcaccgctcagactcaggactaaagccggttgagggctgaggggcaactcgtgtctcgcagaagacacccctcctcccaccctagaagacaggttcaatttcttgcccactgccctgggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtgtctgaaagctggggggccttggcctgacgggcaatcagctgtgaatacctatttggaaaaggattttttgacggtgtgacaaaacctcggggaagaaacgcatgctaatgagggcagtggatgtcagcataactgtattttaattatagcaaagtcagcgtgcattctaataaacacatttgaaaagccgccttccaaaaaaaagcctcactgtgagtatatattatagaagatgtgattattggactcgggtgaaggaacttctatttggccaattatgtggactgctttcatattttttaaagctttaactactatttttttctgagaagaattcatgaatgtgtgtgtgtgtgtgtgtgtgtgtgtgtgtgtgtctgtgtactgagagcttgggtttggaatggaaatcatattgactcctggattttcagcacttgtatcttaatgtcttgtcttctctctagaacacattgtgtcagttgacttcactttggggctgttcctgtcattcacagcaattctgtgtttacagggggctgtgggatgcataggaagtcctatggtgatggcaggcatgggaattttaccccaagggactatggtaatagggggctgaccaagaataactcctaatcctatgtcacataataccatgagcagctcaggaaaactacgcacaactcagacatgtgcagaaaggagatgtggaatgaaatggagccccctggccttatagaggcctccaagacctgccacacccacgtctgcccccaactccccagtcaaccttcagagaagagaaggtgatctctctccagctgagaccaagccaaggcccaaactgttgtagctgaaggatgtttgggctaggctcatagaagctgttccactcctgcagtgtcaacagctgcctgtggtccaggcttctgtctggtcctgggtttttttttttttttttttgagatggagtcttgctgtgttgcccaggctggagtgcaatggcgtgatctcagctcactgcaatctctgcctcccgggctcaagcagttcttctgtctcaacctcccgagtagctgggattacaggcacccgcaatcatgctcggctaattttcatatttttgtagagacagggtctcaccatgttggccaggctggtctagaactcctgacctcaggtgatccacccacctcagcctcccaaaatgctggggttacaggtgttagccaccgcactcagccttgaagagacactgggccttttaagagacactgggtgctgactcacttctgggtctgccccatgggtggcccaccgggtctgctctgggtgcagccaggctgtgcacgtcagggagcctgagctggacttaaggtggggagacatcgctccccaagagctgctcgggtgcgacatcagggtggaggctgttgctgtgtgtggcggcatcactcatttaccctcgtctcatcagcctctgtccttcggctcatctgcttgcaggtggcctctgattctgcctctggagcctgtctgccccctcttgattcattcattgggtcccaaatatgtgaacaatagcatgctagccacttttagaaatatttgtgttcatcttcaagagaggggggtcatccagccattccccagccctcaaaacccactccacagacaaagcagtggcgggtcagggctcctcttgctcttctgagccgctggcatagcgaacacggtacaaaagaaaaggatttcacatgcaatagaatttcattcaccctgaaaagggaaggaaattctgacacaggctacaatatggataaaccttgaggacatcctgctagagccagtcacaaaaggacaagtactgtgtgattccacttctctgaggcacccacagtagagtcacagagacaggaagtagaatgcgggtggccaggggctggagagagcagggagtggggagctggtgtttaatgggtgcagaggttccgttgtgaagatggaaaagttctggagatgcatggtggtgaagacggcacaacagtgtgaatgtacttaatgccactgaactctacacctaaaaatggttaagatgataaattttacattatgtatatttaccacaataaaagaaataagaaataaaaggtttttggatgatgaacgggctcgagccaatttggaccctctaaagctaagttgagccaggctgaacccatgtagccagaatcatactggattaggctgttctagcacttcacgtggtgagaatgggggagagagagagagattgattgatcagggggctgtgcagggggcgtgctacacacttgtaaacagccagatctcttgtgaactcagagcaagagttcacctatcaccaagaggatggcccaagtcattcatgagagatttgccccatgatccagacacttacctcccaccaggccccaccaccagcattggggattgcatttcaatatgagattgaggtggggacaaatatccaaactgtatcacccacaaagaagcaaaaacattttgggccaaatcaaaactattttgatgtagccacagtagggatgagctgtgattacacccattcaggcctgtggacctgcggacctggcgtgtgtggtcgtggggcggtgggtgggcacatccctgggaggtttcaggaggacattcaagaccaaaatgagccatgagtaaataatacaaccacatcctgagtgggagtgggggagcctccccttctctcctaggtcttgtatgggtcatgatcccaccttggcaggagtggaaggaacacagatcctacaggttgtggcttatagtaaagtgactgtggtcatgccttgtgagtgtcattaaaataaacagatatcgttaaatccactatcaaataacagcgatttctgctatcctttcaccttttccacaagtttaaatatcccagatattctactgtgtatattcctaaaagtagacaggtagatttagtgaagttaactggatcattggtatcttctttatagatcatctggtgaaacttgttttgcaaattatgagttgtaggcctttgttttaatgtctgtagccttaggcagttccattgagactaactcagtttttttcttattaggactaatcttattgaccggaactgtggactccccgtattaggagaacagagatctggcctgtgtaaatgagtggaagttaaatactgtagaaaatgccctctggaaactgaaatctaatgctgacttactattggtcatttaatttccttctggcttgggcaccatcgttacattcatttttcagatgtcaagctagttttctcagaatgtgtgcagggctcgaggccgagtgtggaggccactgggtgaatacaggagaggtcacaggtcaagcctcctgcgagaactgcaggcttgagccttcgatagagccacgtgaatgatttttagccccactaggttgctgtcattaaactatgcacacagggcttcttgcttttaagttagcaggatggaaaaattgcaggtgtttgcagcaaacatgaagaaccagccatgctggcccctaagcaatggtattacaaagggttggtgaagattttctcatttgagaactgaacaaaaccaaatggaattctccctagttctgcagctctgggggctgtaagcggcggagcttccaccttccctacaaacggacccagagtggcacctggtatgtgaggcaggtgaccaggagaagggggtgtcagtggttgatgggcagctgcctctgctgcctggttgacccagccccttcctgggtcatctcccactttgcctgggtgtcagtcactggagggttagcgcagtacaagctggcgggtgacctccgtagagcttaggtgaaggggctctcacagggcagtatgtttgagacccttagagggctctccttactcttgcttctcccattatttttaaattgtagtaatacacttgtaacataaagtttaccactttaaagtgtacaattcagtggcatttagtacaatgttgtgcaaccacctctgatatttagttccagaacattttcactgcccccagaggagaccctgtacttattaagcagtcactcctcattcttccctctccccgcagcccccacaatgaaaaatctgttttctcactttggatttgcctattccggatattccataaagacgggatcagacaatatgtgccctttagtgtctggcttatttcaccaacataatgttttcagggttcatccctgttgtagcacgtgtcagtacttcgttcatttctgtggctgaatgatattccactgaatggctatgtttttattttcatttttactttttgagatggagtttcactcgtcgcccaggctggagtgcagtggtgtgatctcggctcactgcagctgaagggctatattaagtttcatttatccattcatccactgagggacatttgagttgtttctaccttttgattaatgtgaattctgctgctgtgaccatgtgtatacaagcttttgggaaattttatttggctagtcgtaactttaagttttgttttggctatttattgttgcttaaccaattatcccaaaacttaatggcataaaacggcaaatttgtctctctctcactattgtatgggttaatgggctagctggacagtttttctgctggtctcatttggcagctctcactgtgcagttagacagtgtcagggactggtcgtctggatgctcagctgcagtggaacgtctgagacggcttcttcacccacaggtctgctgccttggtgtttcttcatgtggcctttctacatagcatctcatactcttggccctcttcatgtagcttctctttctccaagaggatagtcagttcttctttttggcttccagaagcacaaaagtgcaagctgtcagatgttcttaaggcttagacctagaacaggtccagtttcatttctaccacattctataggttaaaggaagtctcggagccaaccttgattcactgtggaatgggcccttccgaggacctgaatgacaggagttgtggctcattggggaccaactccaaagatgaagcctgagttctgagaactttttcttctctgattactccttattcatattttatgttttgttttatagatgtaatatattcacaagtgtctttaaggagctattttgatactcttttgtcctctccctagcaggtcttttttctttaataatttttttcttagtttattttggtcttagttttctttcaaaagcctttcccaaaatatctattctatgttgctcatcatttgtcatcttttttaaaatgcccccttttgttcattcatatttgagagaaggactaaaagactgactgggaggctgggtgtggtagctcacatctataatctcagtgctttgggaggctgaggtgggaggatcacttgagcccaggagctcaagactagcctgggcaacacagtgagacccccatctctagaaaaaataaaaattagccggatgtggtggtgcccgcctgtagtcccagctactcaggaggctgaggtgggaggactgcttaagcccaggagattgaggctgcagtgagctatgatcatgccactgcattccagcctgggcgaaagagtgagacattgtctcaaaaaataaataaataaataaataaataaaaaagaagtttgggagttctttctggccaagacttgtcaactgatagcttttaggggaaagggtttttagggggaatttatgctgattcccaattgttatccccacccctctatcttatctctttgcgcaatcataaatgatggcaggaactactccattcctctggaggtgaaatctacgttctcttgcctgaggtagatacatgtttgctggggttctgcttaaggaaatgtgggagaacaatgtgtttcagggcctggaaaatgtgttctgtatgtaggcttttggttaatctgttttcagtcttgcctatcagtcccactctccggggtacctggtgtcggagtctagtgcctctgcagggtactgtgggacaaattagcctccttgttatcggtatccccctaacctccacctttgtttgctttgcttcattaattaaccatttcccatttactgtcattgtctattggaggtgaattctcttctcttggtaaccccatccctttttttttgtaattgtgtgtgtttatacaatctttattcttcactgtaattcccatggagcctcaggaaaaagagcagatgggagaaatacgtgttcagtgttcagttttccttctgtaagacacctgcaacctgtgtttttcacagaatagaccatggacttaaagcataaagagctactttgtttttcatgattgtgccttcaattctatgtagaaatataatctgtgaattacctgatgaaattttcctaattttgaatcatccttgtatttctataataaacactgttagaatgcatacggtagtgttttatttttgcatttttacttttatattaaataagattatagttttgtttccttccttctaggctcttatttcatttccgtaccaatggtatgcagggctgacttgggaagcttacatgtttttctaagatctaggatgtagctctagtttacacagtaattttcaactgaaggagatttttgccccccatgggatgtttggaaataatctggagacattttcggttgtcacaactggtcatgatgggaggtgctattggcatctcttgggtagagggggtgttactaaacgtcctacaacacacaggagaaccctccacaaattgtctggcccagtatatacacatcgctgaggctgagaaaccctggtttaaataaatgtccaatttggagagtgagtctttgactgccatttttcttcttctatgtgttggtctccagatttcccactttttcagttagttgtagtaactgtagattctttaaaaaaaaaaaaaaaaaggattgcttcatctttacttctaggctgctgtaaagatgtataaggttttcactttttgcatcatattcacattagaaacagctgagttttggagggaacacattcaaacggtagcaaatttagtagagcaaattccaaagacattgagtctaggccagttgtcagtcctgggtataattttagatgttttcaggctctgaagctttccatttaaatgcaaatttcggaacaaagatctgtgtctctgcactgaccaaatagaaggtatgtgaatgttatggtcttgattgttttacaagattttttctgcaggtacttttgcaagtgtgtagggagagatgagaagttccaaggaaaagggtgtgaggtctttggggccagctttgagctggcaaggctaaattataggaagaaggcagagaggtgggcagagaccagatgtgggaggacttcctgtgtcatgccacggagtctggactccaccctgtaggtgacgggagccaagacagggcttggcacaaacacatggcacatttgtggttaagaaacgtcttccttgcttccttgtggccttgagggatgaattaaggggctggaaaaccgggagcaggacggcctgtgcccatggttcaggtgagagccgggtgggtggcaggggctacggagaaggcggttgagtttagccccagttcccaacaggtgctgtggggaggaagaatttccagctgccaggtcagcctcttagatccatttctctttttttttttttttttgagacggagtctcactcttgtcgcccaggctggagtgcaatggtgtgatcttggctcactgcaacctccgcctcccaggttcaagcaattctgtggcctcagcctccctagtagcagggattacaggcgtccgccaccacgcctggctaatttttgtatttttgtagagacagggtttccccatgttggccaggctggtctcgaactcctgacctcaggtgatccacccgcctcggcctcccaaagtgctgggaatacaggcttgagccaccgcgcccggcccttggattaatttcttcatgcttaaaatgaaggaaacgtgaatcattgataaggtgtcccctctttaacaaagcaacagatggtttatcagggcctctcttcgcaggcagtggggcctcatccacaaccctggaaaagaactggaaagcgttgctcagccaggtacggagggcagggccatgtgggactcccgtctccaggccccctctccccagctcccgtttctttctttctttctttctttcttttttttctgagacggagtttctctcttgttgcccaggctggagtgcatgttgctgtgcactttgagggcaggaactggctcctgctccagtttgcatcctctgcgcccggcaccaggcccgtctgctcaatgcaggataagcaggtagcttcgggctgtccacccagcccttgcagagggtggagctacagagagcatgagtggccaagatgaagccctcattggattctttgactctttctactatgtgagatattcttgatgtctgagggatgaacggcaaacaaagtgtggcctacccatacaatggggacagtagttagccctaagaaggaaggaagttctgacgcacgctacaacacaggtgggccttgagaacgtcacgctaagtcaaagaagccagttggaaaaagacaaatgattgtatgatttcactcacatgtggcacctggagtcgtcaaattcagagacagaaagtagaatggtggctgccaggggctgggggaggcggaaaggggagttagcggacacagagtttcagattgcaagatgaagaaagttctggagatggatggtggtgatggctgcacaacactgtgagtgtatttaatgccacagaatcatacacgtagaagtatttcagatggtaaatttcatcttttgtgtatttaccataatttttaaaaactaagaaaattaagatatccttgatgtcagatgccaggagagcggtgtcaggcatctcaccagccgattctcccagaagttttcctccatcgggtaaccacgagcctggggtatcacaaagagaagcctcagtgtaaaatcaacaatctcagtggagtggcttcatcagggagtgacaggggcgtgatttactactggaggacaaggcagcaggcagggaagatggcccaagcctgctttgaactgtaaggagcacgcagaacctcttatccagacccggagggctgccctgttgacagcacaagcagctcagggccagcggcgcaggaaaaccccagggtccagccaggtcacgggcacaggcctgcactcacgggtcactgcagtgaggatggaggtgtcactgcaaatgcgtaagaggatattttcagcaatagtaaaatttttaacagattttagaaatgaaagggttccccctgcatatgtcaagaacctgagtttctttctgaaacttgggtgggaccctttagagttgcttcaaatagaaaacacaccatcggcggccactcccctgaggaaaggcagacttcatggctgaaagcgtcacccgagtgctcccggttttcagcatcacacggagtggctcaggtgcccattcattttatgagtcagcctggggagagtacccacagattcggagtcacatctctgatgggacacaagctctaccctttccaagcattgatgatcctgaggttgatcaatactgagcattgatgtctgtgaaaacaaatcacttaggtgcagagacaccgcaatgaccatcccgccgggggcaaccgcctgattccttccacatcctggtcaacatccctggccaacagggcagcccacggacagctgctctgcctggctcctgctgaaaagccaacagcacaacaactctgccctccatacaaaaccacatgggccctcgagatcacactggggcgccccctttgcccccacttccttgggctgtggctggcctgtctgacatttgctctgggagatgagccagggtctgcccaggccaccacgggggcagagacgtgaaacaggcttcagctactaattttccattaaacgacaagaaaatcggctattgtgagaagagtcacatgaaggtacccaaaagttgtcacagtccactcactcgaaataaaacccatcccattaggaacactgtcattgcagcccatctccagcactctgctctgtataaaagactgactgtggcaagataagggtttaaaattgaaaatcaaagagccattcctcagtgatacccaggaaatgacgcacacgggctgatattaaacccacccacaccaagaatcctaaaagttaacgtacagattactcgttttcaagcaacacacaatgatacaagtaagtcctcaagaagactgcatgggttgaggcactggacttctaatcatgccatctctcagctcaggggtccacgacaaagctaaccccactgagatgaaaagccacttacccctttttcatcactcgcaatacaaatttcagaacccatcccaaactggaaggaaggatacgactgaaactcaactcatgcccagctaacctgggaagtacaccctcctcagataatggagacccaccaattcccgggtgtcagacgtcacacaacctcttctcccaccagggctggggaccctcaggaaagtcaggtgtccctgagaaacacccggcaacatgcagaaccacagagacaggaggcaaggttccagacaaatacacccagtagacagttaaagatttcagagctggagagagcttaggacaccccgattctcagactgcagacagcaggtggacaccactgagctggcgacagccccaaaagaggtcagcttgactgcgacgaggggacgtcttcattatctgtccagtgctctctgacatcaccccaccccgcctcctgtagcagtgttctatctacatgaaattaacctcacgtataaaacatattcctggttcattggcaaacaggcagctctgagcagcacattcagaagttgccaactttgggaggcagaggagttcgagatcagcctgggcaacatggtgaaaccccatctctaggaaacatttataagtcagctggatatggaggcacgtgcctgtgatcccagctactctggaggctgaggtgagaggatcacttgagctcaagtggtcaaggctgcagtgagccaagatcacaccactgcactccagtctgagcaacatagtgagatcccgtctcaaaaagaaaagaggttgccagattaatccagtacacacttctttaatcccgtagtaaattttctctttatagccaattcccaaagtcaagtatattgactcataaaaataccttctgggaagcatgtgactgatttccagctgagaggccctgccactggatggttaagttcataggccccagagtcagaagggggttggaatctcccctctgccatgcctgctacttggccttgtgtacgctcgcgctcgtgcgcttgtgcgctctctctcgctctcgctctctctctctcatgctgattctgcaggcattctacaggcctcccatgtcccaggagccagctctgtccacagtgctcttcctgctcctgctcctggccaaccctccaaccaaggtgtctaggagccacagggaagagcgggttctcttgctagttgctcttccactaggctgtgacacgctggccgagctccgcctccaccggctctgaagacagcacagacaactgttccacctcttccacttccactgagcagaggaactgcgtctgaatgaagccagaaatggggcatttggggaccgcaacagagaacggatgcctagcagatgggaagacgacaaactaacaaacacccaggccttggacccacgcctcccggtaggctccctctcctctccctctcccctccatcacacttcgaaccttcctgggcctggatcaccttcctggaaagctgaccacccccatgcctctgggcgccactcccctgccctaccaccacagggcaacatggggccacatcacgccaccctgcagctcctgttggaagaggctgaattcctggcaacacccacccatcagtcccaagccccgagcatcagtaccttcatgcaaaaggcactaggttggctgctttatctcataagatgagaaaatgatgcccatcaccataaacacattgttagctggtattgatagctgttaacaccctgaacaaagactaaatgaaaatgatggaaactagtgtaaaaagtctatgatgtgcaaaataacaaaatctaacctagcagtagccactccctaccacttgtcacaaggaagcacgaggaactcacagcaactggcagctcctgcagggcggacactgcaaggtcaacgctagaacataaatgacagggaacaactgaggatgaccctgagcttcacagactccagggcctcccctggggccatgggtcccagtggaaatttggtggcacgggcagcacctcctggcacagtcagggtgggggctcccctcaaccagtttggtccacctccatggaccctttggccactgagtcacacatgctggccccaccacctgctttgagaaccagggctgtgccctaccctcttctccctaccccctcatctgcctgtgcacccagggggccaccaccactgcctgggggtcctcacgtttggaggaagcagctgaggctaccagcggctgccagcttgctggcatgggtcccagacattgccaccaccacagccactgatagcacctgaggagaccctctgagccccctgcctgaggccaagcagcagagaaagccacatcctctaaggcccccatgggtgagtacccatgtgacagcccccgccagaccactgcccttgcctggagaaaccactccctaagacccctctcctccagcttgcccagccacacagggaaaaaaactcacttaaactgtccaccggcctgcttccactctgtgacacagcggctgccctggggactgctgagctacagggacccccagtcaaagagccaacccactgaccatgaagcagaaaggccctcctgaggagggccccagggatcgcagagtggactagtatcaaacacccctccacgatggaccccataacaaaaggcataaataacaaaaaagaaaggtcgacgatggcaaatgattctccaataaaaaaatacgagaggaagaatgacaaaccatttacatcaccagagagactgaagcaaggtgggcaggcagtccacaaatttaaaaggcaacaacttttctacagaccagccatgatcagctagaaaacaaggcaagaggaggggatgatcccagtgacaacagcagcagaagtgagagacgcacaaacatgcatgaataaagcaatgaagctccagtgatggaggcaaaggactttttacataaatcaaaatctggatgagaagaaaatacaaaagctctctcctctccccacccccaacccccaccataaaacccacagagcaaccttaatcaaaatcccaatcagaatatgggatgaatttagtttattctaaagtttatctagcggccgggtagggtggctcatgcctgtaatcccagaactttgggaggccaaggcaagaggatcacttaagctcagcagttcaagaccagcctgggaaacttggaaaaaccccacctctacaaaaaacacaaaaattagccaggcgtggtggaccccgctacttgggaggctgaggtgggaggatcacttgagaccaggaagtcaaggctgcaatgagccgtgttcgcaccgctgcaatccagcctgggtgacaaagtaagacagtctcaaaaaataaataaaataaataaaataaggcttatctattcaaaggaatataggagaaaggttggcggagaatgaaaaaagaagaggaatgaagaggtaatggccctttaagataactaagtcttaccaaaagccaccgtaacttacacggtagatagtggcacaacaataaagcagtaaattagaatggagaatccagaaacacaggagaaacactcagaacacagcagctacttaacccatgacaaacctgccaaaacagagaggtcaaagtggctgactaggaaattaggttggaatcctataaaaaaaaaaaaactacatccacaaatcacaccgtatctaaaatacattttagatcaaagaagagatgtaaatgtaaaaaaatcgagactatcaagtattagcagaatatgcaggagggtggttatatacattagggtacagaaacccattctctaagtaagatacaaaattcaggagtaattaaagcaagcttgatagttttaacaatgtaaaatttccaaatttttacattgccagagatgtctttaaacaaattcaaaggacaagtggcatctgagagaaaatatccgcaatatatatagaaaatgaggaataaccctgtgtaccaagaacacctagaaatcaacaaggaaaagcttcacaaatcaagagaaaaacaggcaaggatgaaaaagagaattagaaagagaaattcaaattagtagtaagcacagaagaaacagcttcttataattcacaatttttacaaacacaaaatgaaataagctatcactttacacccacttgactgaatgaaacacaaagactgatcatgtccagagagcgtcgatgtccagagagtgtcgatgtccagagagtgtcagtggggacaccgctgccccacacactagcatcatttagaatggtcaccacctgtcaagagagcaatctggcaatatctgttgacactctgaatgcccaaaccattcagccccgcaagtccacttctaggaatctatgctacgaaaacaaccccatgcagatgcaagggtttaatgtacgagactccacctgtcagcattctccgtgagtgtgaaaaacggaacaacccaaaagttcaataaataaacagtcacatattatgcaagcgtcagaataacgctgcttgcgcaaaggacaagggaccatctctaagacacacagctggtgagcggatcgaactgcaaatcttatttacagtaggatcccactttgttgaaaaatacttttaaaatatgtatgtatttaaaagacaagtaaaatacgtccacagacagaaaaagaaaacgggaggaatcgccaccaaactgtgaacaatgattatctttgtgggcactgaatggggcagtggtgaagttagggggaagctttcattttctattctacatgatgcatttctgtaaagttctaatctttataattagtacatttgaatttcataatcagaaacagatatttaaaggatctcaagatctatgttatatagctctatcatatgttaggcgccacccccgttgatggagccagggtccttctcaactccaaattccactgccagaaaaatggcacctttcttctccagagatacaagataattgcgagaaggcaaaatttttttaaaacagagacatcaagccaggtacagtggcatgtacctgtagtcccagctactcaggagaccgaggcaggaggattgcctgagcccaggagttcaagtccagcctagagacaacatagcaacacctccatctcaaaacgcaaaacaaaaactacagatggcagatctatttaatgattagctctggtggggagcactgcccctcagaccttgacctacccaagcagcctctagttgttaaagacttctcagtattggagaataaaacaaaatagacaagcactttaaaattcaccagaagttaggccgggcacggtggctcacgcctgtaattgcagcactttgggaggctgaagcaggcagatcacgagatcaggagatcaagaccatcctggctaacacggtgaaacctcgtctgtactaaaaatacaaaagttagccgggagtggtggcgggcgcctgtagtcccagctactcgggaagctgaggaaggagaatggcgtgaacccaggaggtggagcttacagtaagccgagattgtgccactgcactccagcctgggtgacagagtgagactccgtcacaaaaaaaaaaaaaaaaaaaaaattcaccagaagttcccaaggaatttgcttccacacatagaaaataatcgagtccgttttttctgaaaacttgctttaaagtccaattgtggggatttgatgtagatggttccattttaacttcttcagccagaggaaatctaaaaattcttccttccagctcaacagagcaaatccacctactgctctgcaaaaggaggacaaagatcctcctggggccgcagaattcagcagcttttccttggattcctaggacaaccaacagctgtgggacactaggccaagcttcaaaaggcagcctgccagccatcggactcccaggcacctgtggagtcctaggcggttgaggaactgggggagggcttggtttcaacctatttgccaaatcaccagcaaaacaagacatgttcaaaagaaacaagtgcacataaataagccagggctctactccccagcccatcaggtcaccggcccagcccctcagtgtgctggtgagcaggacaatcagaaaaggcctctcttcctggaataactaacagtctctcaccatccccactcccactgcccgatgtgtcatgggaagtctctgaaattcaggtttgggaaatcagttgacatgaactacagcataatattagatgtctgattaaaatcatcaagatgatacaaaggtctaatcgcagaggtgctctccactcccaacccccacatcaaatggagctttctctccttcaaatcagacttctttttttttttttgagagagagaagttctcactctgtcacccaggggagggcagtgacaccctcacaactcactgcagcctcaacctcctgggcttaagcgatcctcccacctcagcctcccaagtagctaggaccacacccgtgagccaccacatctggctaatttttctatttttttgtagaggtgaggtctccctgtgttgcccaggctgatctcaaactcctgggcttaagcgatcctccctcctcagcctcacaaagtgctgggattacagcatgaaccaccgtgcccagccttcaaatcacatttctaaggagcctaacaagcagcaggcctttccagttacagcgcatggaagtaacaaaggcagcctcagccagcatccagcgcagtcccagcagacagggataatgaagcggacgtgggcctcacgggagggaatactgtcccccacctccacaccatgctagtgagaaaaacagactgcctgcagctccaaaacatacagcaacttacctatcaaacagggacctctgacgcttcacattatcacgtaagaaatgtttcttgcccagcagcccccagaggatgaacagctccctccacctgaaaggggaagagggcccaagctgcaggcgccctggcctatcgaggccgtggacaggaggcacccgaatgtctccccagaccccaccctgctgcagaggcctctgcagcccatcaccctgcagcgctgctgttcccgctgcttcttggagaacaggggcaatttaatctacaaatcctgtaaatccttgttaaaaaaaaaaaaaaaaaaaaagaagggtaaaataaaacgtctgcactagcaaggctgggacttggcatcagctgccacctcctacagaacccagtggggagtgggctccagagcctccccgtgatgctggcagtgcctcggccagacacctgcccccgccaccctcctgcgtcctcactgcacccctccccaccccatgtcacatcttctgctcatacctccccacaccctcctctcgcctctggatgcacctctcaacacgcccctgaccgcgtcttcctcccatgctctgaactgtccactagggaagccagctgcagaaatcactctcctagaattcacttggtaaaatatgtgttgttattggcccacctactttgctcccaacccacagcaagggctctccagggctaccaagcccctaatggtcaggaactgccccccaacccccatctccagctctgacctacacaaactacataatcctgctgccaaaaacttggccctccctatgcccagggtgccacactccaggctggcccttctgccgagagggctcttctggcctgggctctgaacgggcaaacccacccactcttctaggatggggtccatgatccaccccaacctaccgtggggctctcacatcttccagactgtgcctctctaggagggccttggacccagagccagaatggggctctgatgccactgcacattctccagcaaccccttccatgcccttcctcctgatcccacccagctctaaactgggaacaagaaagctggaatatagtagcttctcagaaaatacctactgagtacacggctggatagatggacagtgctccaggcaaagggactcgggggtaagaaaagtgaagggtacctgctcccggttgtaccactgcagagtccttgagtgtcaaaggactgagaggtgaatgacgggcaaggtgagacctaccaggttagtgtcccgcacccctttgtttccactattagattaagccaccctatgtgacagataaaaggagcaacacatacaaggagttaggccggggttgccaaagtgaggagtgggaatgctgccagtccaggggtcccccacggcagctccccaaatgaaaccaagacaagttggagatgaggctgcctctaggtgtatcaaatcaactgaagtagcaccagtcctcagtgctgattaagcacaggcacgcctgtgatcaagaagaaaaccattacttaataaaatgcagttaatttagaagctgaaatctgtgaaagctcaagggaaagacacaatcaggagttcttggtctggaggggcttctgctctcaaagcttccaacccaacacagcacaaagacgtcttccccaacaaccgcacatcccacctgcaaaacgatgacacgctcctctccaggtacctgaaccttaggactcaaagggtagagaaagttcacaggcagaatcttcacaatacatgcacaaaacaaaggcacttctagtaggagctgtgggtcaggaaaatctcgacttcacccaatgccattcccgagacaatcagccatcaatctgacccactcagtcctgcctcaggggctcagaatctagcagtcaggccaggtgggaagtgcagggacctgtggccaaaatcggcccactcatcactcagctgacagctttcacgcgtactagccagaatcagttagaggctggaggtagtgccaggtgtctgaaacccagcaggcaggttggtaaaacactcacacatcctaaccctggtgactgcactgactgcgtgctttactgtagcagaacagttgcacacatctcatctcctccatccatagtaactcagtggctggtgaggaatgggacacagacctccacgtgcccttctcgggatgagtcaagacaaactctgagcagtgacgctctacagctggctcacacgtggaggcagagcctggcttcccagagcttccagttcctaacacacgcctggccccactgcaccacacccgtgacagctgccaccagctccggataattcagacagatgctagagcacatggctcacttattacaccaaaagactgagaaacagaaactgtgttttaattgtacaatgcacacacttgcttccagagagacctgagaaatccatcatccctaaatgcatgcggttactcaactagtggctttactatttttgaaacaatggatttttccaagacagttgataatcaaaccaactgcgggaaaccataaacgatacttgtttattaaattaagaacagatacaacagttcagaggaattcatatttagagctgccttgctggagaatcaattccaggaatgccaaaccaaccaaatgaaaaaaaattatatatatatatatatatacatatatatatatatatatatatatatatatatatctcacacacacacactcgtgtcacttaacgacaggcatatatatgtatatatatatcacacacacactcatgcgtcacttaacgacagggatgtattctgagaaatttatcattaggcaatttcatcattgtgagaacatcatagaacatacgttatacaaacctactacaacacactaggttatagggtacagtctactgctcctaggctgcaaagctaggcagcatgttactgtgctgaatgtgtgtatctaaacatagaaaaggcacaacgttaaaatatgctataaaagataaaacatggtgcccctgtctagggcactttccatgaatggaccttccatgaatggaagttgctcgggtgagtcagtccgtacactagtgcagactttatagacattgtatacctaggctacattttaaaaaaatatatttttattttttaaatattttatatatttttttaaaataaagtaactgcactacaactttaccacaatgtcactaggcaataggaatttttgagccccatgatattcttatgggacctctgtcatatatgctatcattcaccaaaacaatgtcatgtgatgcatgacagtacatatgtatctcaactgaaaatcctaaatgtcaatagtgttctccgactcactatttactaataagagtttcctcagaactgtctttgcctgagagtttcacgaccaaacgtctctctgcacagttgattctagggacaagaagtgctaagaatccatgttggcttcaagtgcaaaatggaaaacaccttagtgtcccaccaaccacgtcagccaccttcctggagggctagctcccagacccttttcccatcgctgtatagggcccacgtcatctgtggcatttccacgactctccgatgccagccatcagtctctcggcttgtgttgaaaattagcacctttacgtgcccaccagtggtcatgagtcctagtcatgcccaccctgttaaaaacaaatctgatacaaaatgggccccagcaggagacagggacagaacacggacctcacactctctccagctcagactcaaaggccagcactgccccatcacagccgagtgctcttaggcaacccacagctcagctacctgtccccagcctcctcgttgcaaagttaagacaagacctgccttctagatttgtcgggaaattatttaaaatgataaacaaagagggatggaactcaacacacagaattgcccgatgatgtgtgtttcattccagtggtttcgccatcaaaaccatctttaaatgttggagtgtttccgtttccagacaactagagatgaaaatattttcacagtcactcaacgcaggtacctcaaccacgtattttttctcttaattttgatccttgaaacacaaaacaacagatgcaccaccttacattaaaacagccctttagagtttagagtttatgacaggccgcctctgcattctctcactaggccgtagctgtaactcacaaacctgacccttaaaactcccaggacaataagagaagccacaccatggagctcttgctgtcataaaatatctcgcatcagttcaatattgcatctcgtctgtgcctcaaaacaaccacaggcaagaggcctcacgcgggtattgcagatgctgagaaagactctcaagccagaagactggtcctgggccccagggattagtggcagggccaggctggaactgagctcctgttactccaaatcccatcctcttttctgacctcccagtccctttctcataaaaccaaagcatcttctccaaccaggccaggacacacgcaggagagagtcaggcaggaggaggcttctggaagggaaagcagagtggctgagagccctgggacagagtctgacattaggtacaggacaagtttggaaagatccagatggagcgggaagggaatctgggcgtgggggtgcctccttccaaagtgcatccacatccgaggtgactgcagggagacgcagcgctgactttggcagcagggaccacccgggtgcagagaacccaaacaactgaaaatccaaaaaggaatctcagtgcacagtaagaaagctcattctttgggctggttaccttcccaaacacgttctcctctggcctatgtgaaaccgacgttgcactgtacaactctgaagctctttcttgactgcccactgaatgagggtctgtgctacattccaggaggatccaaatgtgaacacagctaggttccagctctgggactcgggaaaaggaggcacaggcagcaggacatgtgctgcaaggagactactgctcccgtgtttcattcactcactcatccaacaacagcactaaggctctgctgtgtgccaggcacttttctagctactggggatccagaggtgaacaaagtcttttacaattgagtggtaagagactgacaataaacaaacaagtatataaataacacactgaatgttgagtactaaggagaaacacaaagcaaggttaacaagagaaggggaagtaacgctaatttatgtagggctgtcagggagccggcaataagtgaggggccggccaggtgggcatctgggggtggctgatgccaagggggtgggaacagcaggtgcaaaggcctggaggcaagagtggcctggcaaatccgaggaccaagggataagatgaaagagcctacattcagttaggatctccgggatggacatgggccaagatgacaggtggggatggggtggggacaacccagggcagatctgggcaatgagcctgtctgcctggagccaggagagcctggaggggccattcttgggagcgagcgggggaacttgagaaaaatcaggccgagacacatggatgtggagggagcactggaaagccactgaaggcctgggcaatggtgacacacctggcctgggccaacttgcagactcaggggtaccccacagcccaacctgggaaacctcacagccggcacagaaatcataaagcacacagcaatggcaccccaccagtacgcagggttccacatagagagcctggctgcatgatcttgaggtcacctaactcccgggcctcccttgtgtgtctggacagggagagaggggaggattggcttcaggagaggcgagaaacgacagtgcccatgacagctgactcagcctgtgccagcaggctgctctgagacatgagctggacccaacccaggcggtgggcagcaggggggtggggaggaactctgggaaaggaaggagccagagaagtctccctgtgggcgctcgggccaaccaccacccaagggaacaatgagcacccccagcccccgatgggcacacaggctgcctcctggtgagcaagcgtctcaaacctgacctacatctgggaggcctgcctggtcaccagggactaccttacaccctacctgtgcctccacgtccccagtgctcacggccacctggcaagggtgaggaactgagactgcgttgaggacacacagcctgtgagtggtacagccagggccgctgcccaggcccagagctctctccgtttctctaaggaccaggctgcaaggcagggcatgtgatctctgccgaagacattcaagccacccagtgatgtgtgctgggcctcgatccccaccgaccgccagtcctctcctcccctggacagtaaaggtttctccaagacttcagacgacggtgtcacctgaggccctcacctattaagtcaccggggcaggtatgcatggcagaggacacggaggagtgccggagaggagctgaggcctggagggggcctctgcagccaggctcaacccccactctccccactccaacagccctcactgcagccaccgcggcccaatccaaacaaagcccagcctgatgccaatctcaccatcaactgtttttcctctgacttcctcagttttgtctaggaaaaatcaaagtgtcttatcccatctctaagcttccaggggtgtgatcagtgtcttttacaattaccttttacttttatccagcatttcttagctcggttggcaaactggatatttatgcacctccatttcacaatccatctccaccgattattcctgtaaaacatttttttttttaaagtttagagttacttaagaaggttatgtaaacaagttaaccagcaagccacaacttgggtctgcggtgtcagagaaaacatgcaaggtgcaagagaatgaggagctgatggtcaccagctttacctccttccagcacccactcctgctcacacacactcacaccccgtgggactcagcctgcagcttctcccagcccaagagccagacagtggggaggagcacagaccacacttcctaacaaatgagagggaagacttcgtgccccattgctactgccatcacccagtcccagcccagagagggagcccactccaagggcccccctgccagtactgctagagcccaccgagggctgccagcacacagctacgagctccagctttatctactcacgccctggacactgcccggagccccagcaggttccacgtgtccttgtcaccccagccctcctgccccgcggatcctaagctcaggagaccctctccagcccaggctgtgggggaaggcagcccccacggtcacccaggaatcagcgcagagtgcagggcatcctggactccccggactgggaaacccagttcctgtccccctgcgtagtggccacacctctgggaggggagaaacccctgcctcacctcactggagggaccctgacccagaggcctgagaaaaagccaccggcaggctcctggcacctgccaacctgcaccttaggaaaacttgtcccacttcaacctgcaaagctctcaggtcattacttctaaaaccactgtcctttctgaaacaggaaggaaaatagaaaaacaaacaaaaacaaagaggcacagaaggctgaagacgccagaggcagtttagcccaaaaacaaagtgccagacacaagatgccaagtttggggcgcttcctccaccgcatgcctgtttaggagctgactgcactcaaccacagatttacgtctggtgcctgccaggtcgttatctgaagagatctgaaaaagtaagcctttcttctgccagtaaatactaagttaagactagcaggcccctctaaggctctgctctccactggggtgctgcaggacaggcccctccgcgggcgttccccgcaccctccctccgcgtcggcccggagaaaaggaagttcgcccctagcctgggcttaccaaggcccgccgcccgacccatggagccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgctcgggagctcttggcccgcagcttacgcgccgccccccacgcgtccgggtccccgcggcgccgcgggcggcccaaggctgccgccgccagcgagtcaggcagccgaggttccccagcttacctggccagggcgcggggctgccccggtccgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgctgccgggtctctcccgggggctgagctcccgcagagctcgcgcctagccgcacacctcgactgctgattagcccgacagctgaatagcggcgggagcctaccgcgagcggagtacggaaagcccgcagggccgcgccacatggcgcacgcgcactgagctgcatacctaggtgacaaacgtgcacgttttgcacgtgtatcccagaacttaaagcatgacaaaatttttttttaaaaaaccctgatgccattattaggaacaatttgaatagatcagtcacaacctatatgctggcttctggtgtctcaatttgtcctgggaaaactgttgtaaagcaatagtatgtcagtccttatatacttatccatctccaatctggaaagacaaggcttatatgtttcctttttagtcccctaatttctctttatgacacaaatccagttggcagtattaaagatggggctgattctcctttacttatctggaatatgctaccattccagataagtaatagtaaaatggccatttcctcttgctaatcaaatgtcgtttttgaacacaaaagccactgggtttggagtatgaaacataaacataaaacatatcatacactatctgtgacgttttcataaactcacatgatccttttatatttttctcttatataaaacgaaatactttccattaaaaattgagatatttaaatgagaaaatgcttgccaatgttattaaaatataaaattttattatttattcaaagaaaatggtcacttttggtttgtgctaaaaaataacagtaacagtagaagcctgctttaaaatattttaagtgtgcgatatcatattacttctcatttactctttgcgtttctagagagccaagtttatttttttctcaattcagtttaaaatcagagggaacaaaatttgaaacgtgacataatatcaaggttaacatgctagctatgtaataactgtaaaatttggccacaaatgcatttgctttgagaaaaatgatcatgtgaaattcctaaatatttgggccatatggaagatgatatcagaagaataatatattctctgtatgtcaaaggaggaggataataaaaaccgtagttattaggttagtacaaaaacaattacagtattcgccattgccaaaaattgcaattgcttttgcaccaaggtagtaataaaagtatggttgagtttctgtagaattccggcaaaggatgagcatccttaatctgaaatccaaaactctcccaaattcgaaattttttgggtgcccatatgatgcctcaagtacaaaattctacacctgacctcatgcaatgtatcatagccaaagcacaggtacacaacacatagtttattcagtgctttcaagagaaaattaaaattaacatgaggctacatgtaaataaattttgtgtttagacttgggtcccatcccaagatctctcattatgtatatgcaaatactccaaaattcaaaaaaattcacaattttggatttttcaggtcccaagcattttgattaagagatactcaacctgtccctgtttggaagcagttccctctagatagattaaactggcctaacaaaaggtagtatctgttgctggagttgagaaagaataaatatttacatacaaaagtgagggcaaaagaagactacaaaaacattcttattgaaattaaataaaattatgcccttttctctgtgtagctctttggccagtttgaacaatgaataccaagagccaatgactgaattctaattatatatttggtgattatgctcagacagacttgaagagagaaatttcataagcatcattttggcatttgattttctaataacagagcatctcaaaatatttttattcttcataattcccagaattttttttttttggtaaatcttgcatatgactccaacgtgcaagttatttgtaacactaccaataacttttctattcttttggaggagaaaatattccatatatatatatgtatatatgtacacacacactacatatatagtttatatattccgattctgccctattaatctataaatgtatgcacgaagaaaatatgtaattactgggactgtaaactatatttatatcagataaaatagataaataattctattagttttatttttcaaatatatctgtgtattaggccgtttccttacagctgataaagacatacctgagactggacaatttacaaaagaaagaggtttagttggactcacagttccacgtggctgggaaggcctcacaatcatggcgaaaggcaaggaggagcaagtcacattttacgtggatggcagcagacaaagagcttatgcagagaaacctccagttgtaaaaaccatcagatctcgttgatgagatgagagcatgtgggaatgtgggagttacaattcaaggtgagatttgggtggagacacagctaaatcatatcaatccatttcctgaaatttgctctgtgataaaaagttaagagtcagattatctgagtcaaaaaaagatataaactggcattttagcttaactagttataaaagtataggttaatttaagaaaagctgagggttttaaaagaatatttagttttatgcatagaaaaaaggtataaaagtaaaaacctgctgctcatttgggtattaaaggtataagtgttaagtataaatgttatattttctaattggctagtaatttatgtacttttatttacatctttttgtgtattaatttttcccaaaacatactgaaagtttttgttttaatacttttctattgatcttcacaattttcaacttcttcaatccaaatttatcgattagtaatgatgttgcttttttctttttaaagtttttacctattatgttttctgccatattaatcagtattttaaaaaattactaatggctgtaataggagacacacacaatttgttaatgagaatgcatcaagtttctcaccattaagcataatgtttatctgtcttcatacagccatatatgttttatatatgtgtgcacgtgttcccttgtgtacgtgggttgcatatgtgtgtgtagttattatgttaagacataccatatcctttattaaactcattgaaattaagaaatgttaatatattcagatgcattttggtatctttggagataatactgtgatatttatttagtaatatgatatgatgaaaaatactaacaaagctattctcacattgttgccacgaatctctcgtggtcatcgactatctttttttttttgagacggagtctcgctctgtcacccaggctggagtgcagtggtgcaatctcggctcactgcaagctccgcttcctgggttcatgccattctcctgcctcagcctcccgagtagctgggactacaggcgcccgccaccacgcccagctaattctttgtatttttagtagagacggggtttcaccgtgttagccaggatggtcttgatctcctgacctcgtgatccactgcctcagcctcccaaagtgctgggattacaggcgtgagccaccgcacctggctggactatcatttttaatagaacgctcaattcagtttgctaatattttatttggtgcttttgggcatacattttcaggtttttaattggaattgcaatgtcatgctgacttcataaacataattccaagattgcctttctcttcaaatgttctgaaacattttaattatcaagggaattatctgttcctgaagtttggatagatattactcaaaatactggtgaaccctggtatctattactggaataggggaagtgatgagaataaaaagctgaggccttttgtatcttggtgatattctctttttatttattttgtctttattcagtaatctgctttgatatcctgaatcagtatttccttaggtggagagagttttcttatattgaatattagattctttctccaattttacttttagaactatagttaccattctgtacttagatctccacaacttattcatcctgcctaactgaaattttgtacactttgacaaatatctcttcattttttcttagctcctcatttattctctttttctattttctagaaacactgatttttacttggggtatatatttttatccccccatatatatccttttcttatctcttattgtctctttgtccctttcccttggatcctaaggaagactcctatgttttcattgacatcatttagtgttctatagctttaattcttttcttcattcgttctaatgcagcctctagtgttcctttaatattttaagtttccttacaatgctaccttcactcggttctctttttcttgccctgtaattggccagaaaaaatatttgctgtattttatattttatatcatgttttttcattttaaaatactttacagttacatattttaaaatatcttactcaaatattttaatatattttaacacaatgttttatctgaaatatacatttatatttcttgtaattattttattcacaaaccttttatctgatgttttgttttatcacattgttaaacatttctgaaattatcatgtactgtgtgtgtatatatatatatatatatatatatatatatatatatgtatgtacttatcattaaataaggcaggatctacacattgttttgatatcccataaacagagtatacaagtgtatcttggttccctctctatccatctgtctcagctcattttatgctgctataacagaataccacagactgggtaattaatttacaaaacagaaatgtatcggctcatatttctgacaaattcagaagactaagagcatggcaccagcatgtagagagggctttcttacttcttcatcttatttcttcatgttatggaaggcaaaatatgaaaagatgaaaagtgacaatgtacaaaccgtgtatgtatgtgtgtatgtacctaaaggtcccacttctcaccactgtagcattggtgactgattaagttcctaatacatgaactttgggggacacattcaaactataaccccatctgattattcgtagagttctcaacagatctcaggcagaaggctttttgataggtccagccctttatcaattgtagataattagaagtgatacacatctttaccaggcttcacgccttccttctgccaagcttacattcctaaacataaagcacatccacattcacttgaatttttcacctatattgaacttcttggaattcgaggcctcaaatcaatgcagaataaaaggagataacggtaaatttgaagaattaaatgatcatgaccatttttaagtcaggtctttcgcaatgaccgtggtcaataatggccaagacaaatggagatgaattatacatagaatgaatacattaaaatgtcatctacttttctttctccagaaggattcactgttctatgtgcgcctctcatctgcctttttattaattaacctttctactgaagtctggacgatctccaaccagtattcctagtttgtggtattgtagaaatatatttttgtgttttaacgagtcaacaaagcatttgtaagaaatcatcataaaaatctattaagcattcattttgcatcaaacatttattgcgtaaaataagcagatacaatgaaaattcttcttgatggtggaaaggtatcactgtaaaaaatcattatcatcttgggttgcaatacagcagtaaacacagagattttgatatatgtaggacctatattgctgagcttagctatgctctctgtattttgtttctttgcctttcttgtcaagttgtcagcaatcacttcacactactgaaaatataattaattgcctttagcagttccctccctgcttctaaccttatactttgaagcagaagcagaaaattactttggctgagagtcagagctaacctgaacgttgtattaagtggaggccaaaagtttctgaaaatgtactgggggctttattcatggatgaaagggtataaaacctttgttttattgatctgcacttcctaatttttatacttacaaccattgtccaaaattttatatattgcttcagatgtcttgtattccacaccaatggaaggtaccgcgtcttattcatccttcacctccaagttcctaccaaaatgcctgacatatgataggtacttactgaaaattgaatggaaccaacttactgattatctattctcccttggatatctcacatgcatctgaaacttagtatgtgggaaactgagctcattttccttcttccatgctcaacattgtcttttccctcctgtgtttcctattttgatgaatagcccatattctcaaccaattacctaggccaagagccttggagccaacctttctcttttcccctcactactcacaactaattgataaccaactgttgtctaccccctgccccccacaaaaaacagcagattaatccatgacctcctctccactctcactgcactgtcttggtcacagccgtcacaattcttcgtctggaatgtaatatctcctaatagtcctatccattccaattcactttccagattcctgacaaaaataatttttctgaagagaaatctgatcattaaatttagctgattgattgcaaaattaagttctccatgttagagatgagagtttgggaaaaagaaggcagcaagaattcacaaagaagaataacagagatcagaaaactatccacagagacagcttcagagattttcaggggatgtgcagatttattgaatcttccaattaatactgatcaacacaagtatgtgaggaaatggtcaaggccagggtacaaaccactagaaagggaaggcaaaaaagtctccagaattcacataaggtcataagtagtttgtgtttccattagccagggtagaaaatcctcgaatcagttagagtactcagaaggatattgtctcactaatgtggaaacaattctatctagactgaaaggtgctctggttctaccaagcaaagcttaaaagcaaacttcaacacaagcaaattattcctaagtaatttaactgcatcccagaataaagcttaactattcagcacaaaataaggtagaattcactatgtccagcattcgataagaatatatcaggcatagaaataggcagaaaaatgatacatattgaagagaaaaaaatcaatcaagagaaacagacccacaatgacacagttgctaaaattagtagataatgacattaaaacaggtatctatgtttgaaaaggtagaggaaagcatcaaatgagagacatgaaagagagagcaaaatgtgaaatcatcttctcgggattaatcaaacaaacatggaaacaatgtcttagatgaaaactatactggatgaaatcaaaagcagattatcaattgcagtaaaaaaacagtgaatgtaattgtttaacaatagaaagtatctgaaatgaaaaataaaaatgggaagagaacatcagtgggataacttcagtggcctattataagggtaactggattccccaaaggataggagggaaaaaagttttcaggaaataatgtatgaaagaatagttactgaaaacaattacatttaataaattgagctctcctcagcctaatgagtgtcaaaagtctcttcttttcttggactttctgctgacctgaacactgctttgagacaagtctacatgaaaaaaaaaatgaggcaaaggtaaagaaaaggaaaccttctcttggtcaatcagatgagatggctgaaaagaatgccaaatcctcaccacaagtgatggagtgaatggtcaccttggtccagagtgagaagactgtgagcctcaggatggttctaacacaggattacccactcacctggctgcagtccctgtaattcagacccatctttagggcttttcctcggatccacgagtcagcttcctgttttctcttatactcctcctgtctcggatcttcttagtctctctctaagctctacagaagtgtcttctttgttgtttccttatatactttatacctacctatgaattaccatcccctgaatgttatggcttctacgaaagataatgcaataattttatttttcttttgagacggagtctcgctctttcgccaggccggagtgcagcggcactatctcggctcactgcaagctccgcctcctgggttcacgccattctcccgcctcagcctcccaagtagctgggactacaggcgcccgccaccgcgccgggctaatttgttgtattttttagtagagacggggtttcaccgtgttagccaggatggtctcgatctcctgacctcgtgatccgcccgcctcgacctcccaaagtgctgggattacaggcgtgagccaccgcgcccggccaatgtttgtaatctagttatttcttagggaccaccagcactcactcttgtctgtgtttagcacaaagagcaaggggcagagtactcatcaactcaggaggaggaggagtcagtagagaaagcattcatgaaaaaaggcttacatctcagcaatttctaggcacaaaagacttatgaaattctaatattttattttgacagagttcttctttagcattatgttagatacaaaaatagattttgaaaaatcattttataataattatagtatttgcctatctgtttatgccacgtaaattctatgtataaataggtggagaggtagtcacaatattggggggcatgttgcatagtatcttgcaccatagctcactatcttttacataatacgctttagtatgttcagtaaaacacttttagtaaagggctcagaaattatgacagggtaataccagtcatagaatcaagaaaggcatctagttttatctacaaaagattttagaaataatcttataacatatccactaaattgaatgatgaacattagaccactttttattccattataatcttattttctctcataacgctatccattaaagtatagattctattgtaaaagcttctaaaaaagtatcaaatcttcctttgttccattccagctaagctgtgtttcccacctgttctgtgcttgctaaaaatataatgagaaaataaatgactatctaaagttgttttacaaaagactgtatcatagatcctgtgaaatccttcctgctttaaatcctttgagtggctggatatcttgaaatggcaaatgaattggccacagaacagtgcacactattcaaggtttgttcatggagtcttatttatcacagtgatctgtgggcatgataacataatctatacagtgttcatttttctcttaggtggtctgggcattcttcaaccatttattcaaacattatcttctcaattccaccttataatttttatttctaaagcgaagtgagcacagaccagatacctgtacctgggtagtggttttctaggatacagtaaaatgcaggatacattgaagagcaaatgggtgcagatgaattgaaaactcttccctctccacgtcaaagcccagttgaaggttggcatttgaacagaaaacattcatagacatgaatggggaaagttaatgctcagagttcacaagtgaaatgaaaccattcctactcactgcttctacaaatcactttataagtgatcctgaggaattctttctcatctctctctctctctcactctccctcctccctcatctcttccctctcctattctggctgaaactggcacctaagtcaaatgtagctaagcaaacagtgtctcagtacgagacagatatatatgtatgcacaatacacatatatatttacatgtatatatatatatacacacacacacatatatgtattattttttcctaattctacccacaaaagaggcactaataccttaagagccataagcgaattttgtgcccagatggtttttaatacctgtccctactgaaaggaacaagagcctcttggagaaatgtctggttccagggctgggacaaagaaggtacatgatgaaactggaacacctttttgtgccagaaagaaagggagtgctcaagaaaacaatgggaacatgtcaaaaagaaataggcaatagcttgaaggggctcctgctgaccaaatctagggacaatttgtctatcaaaataaatgaggattgcaacgattaaataaaataggatgattaaataaagtaggaaattattcatctattataataagcaaacaaagagatacgcgcatacataaatggataaataagcagaggagaaaagagaacatttctttattttattttatttttttgagacggagtctcgctgtcgcccaggttggatgcagtggcgcgatctcggctcactgcaggctccgccccccggggttcacgccattctcctgcctcagcctcctgagtagctgggactacaggcgcccgccacctcccccggctaatttttttgtatttttagtagagacggggtttcaccgtgttagccaggatggtctcgatctcctgacctcgtgatccgcccgcctcagcctccccaagtgctgggattacaggcgtgagccaccgcgcccagccaagagaacatttctttaaattagtgtgccacctgatacatgtgaaaggaagagtcatggagtggccgggtggagggaggcagggcggggaataccatttgcaactatggtggtaaaaaataatttaggcaagaagtatcaggagaatacttatctttgggaagagctggatgagaagcaggctgcttgcgtgttctcaaagtgtctcttcacagactgctattcattacaaggagaaaagtactaactaaacagtgaagaatgcaaatgacactttgaccttttgctgcaaagtaacctcaccaataagaggtatgtagatgtcttgtatttgggggatatatggtaccccgagaaggacaccacatcactgctgcattattccacttgcagctgtataaccaagtctaatcatgagaacacatcaatcaagctcaaatgaagaaacattctgtaaaattactagcctgaatttttcaaaactcccaatgccatgataaagaaaggcagagaaatgctgatagaataaagaaggtgaaagagatagaaaaactaaatgcagtatgtgattctagacatggaatatggactacatagattagatgaaaatattacttcagtgttaaatttcttgaattgtaccatcttcagatgcttatttgaggatatttaattcagtctggagagttttattgcagtttatctttcttcctagttggtttgggggaagaatttcttcagctgaaatgttttgactcatattttctgttttctacagcagcttttatattgcagtttttgtagttatgttttttattctgttcccaggtatcatagaaatggagttcctagttctagagtatccttttctataaatagagtaaaatgcagtttatttaataagagatgttggcactttgggcagaaagggagtggtaggcacgtggtacttctctttcatctggacatattccttaattttaccttctttttttcctttctgtgccatgactcctgatcaatcaaatagacaactgaaattattcacagatctgaaatgttttattatttctgttaccagatttgtagctcttcaatgcatgtttaacctgtgcacatagtctaattttcactgctggtgttgacagaaaaaaatatttcaaaaatggaagctgagggaggccgaggcgggcgaatcacgaggtcaggagatcgagaccatcctggctaacacggtgaaaccccgtctctactaaaaatacaaaaaaaattagccgggcgtgatggtgggcgcctgtagtcccagctactcgggaggctgaggcaggagaatggcgtgaacccgggaggcggagtttgcagtgagccgagattgcgccactgcactcccgcctgggccacagagcgagactccgtctcaaaaaaaaaaaaaaaaaaaaaaaaaaatggaagctgaggattgtaacataatgtaggtatataatggcaatggcactatttctgcttttcctgtgctttgggtctacctgaagagtagtgtgcacttgctgtgaatggtagagcccacctacattaggctgatgatttattgttgaagtcaaaaaaactagtgaaattttactgagtagactcttgatcagcagggtagcagatgtctcccagaatattttgcttctcaaatttacagggcttctacctttcatagaaaaccatcctcacctctgactcatgtgacttatcttcgggtactgccttctcttggcagtctttgggactacctcaaagcagaattcatcctaccctgctcagtgttccctcgactcttcttccattatatggtagtccactggtgtctcaacaggtctgtacattatcagactgtgagctccctgctccctcagccagacagagattgaagaggacaccatctctttcaactaaattgtgtgaggccattacaaatggccgacatttgtaggccactacatatgggctactactcacttatgttttagcccagcccttgagtttgtaaagtgtgttgggttaaatttgtagttagacaatttagccgagggaagcttaaatgttctgtgtagagcagtgggagaaatatgttcttgttatttttgctcttcttgaaacaaaagaaacggaaaagggagagaagaggtgaataataaatacgaaagagtagaaatgcagtctgcaacagatgacagcagactgaagctagaatccagaccaggccaaggaactttatgattttaaggaggatgggtaacacacaactggaggtgttagcagtgctacagtggtcagttgtacacattttttctggcccttgaaaacttgagtaagttcagttaaaacacacatagcatgagtaagaattttgattttatgaacactaaggaaaatgctgtgtttgttacatgatagggcaaaataattagaaaaagaaccctacacatagaacagttgcataattttgaaacgaagttaaatcagaggaaatgtggggggcaggaggagaatgaccacaaaattataagcctacagataatttggaaaaatcctgaggaggattttcaagaaaatgttcagtgaaagcttggagcaatttcatctagtgtttaagaagaaggatttccttgctgatttctatgatgtgtttttattcatacacaggtacagcacctacgtagcacgtaataggctatttacttagatagcaggtgagcccaagatataatacctgtactttagctgttatctttagaaataaacatctaataggatctattttggcactgcaatggaaactatcaacattggaaaactcctaagtaagtgttcaacaatagagaaatgactaaacaaattacagtatatttgctctatttcgtacatgtcacaatcacaagattgaaatccatctatataagctgacatgttaagttcccttacacataatgccatgtgacaaaaaatatgttgccctactatacaactgccctacttatgcaaatgttcagaaaactatgtattaacagcaattgcccccagttgaaggatttgattggagggaaaaaaacagatcttcactttcctcttccaatccttttatgttacacaaaattttgtcatgagaatttatatatatgcacacaatatcaatatatttatattaatatttatcttattaatatatttatattaatacttgcataattaatatattattgttatatttatatttatattattgatatattagtaatataattattaatattacattaatattttaacatattaatatataaattaatacatgtatactataaaacagaacatctgtttttggaacatggttagttgagctaatgcaaaatgctttctgttacagttaacatggtggagaattataaaacttgtgcatagtgttgggagttcacagaaaataaatggagatggcaacccatagatagtgtgaaaaaacagaaagaggtgagattgcatgacaaatgagtaccatgtaaggtaaactttgttggacttatgactcagaaataggctctcaaaaatacaggtttggaagtctccttttattcaactttactgtagaatttcagaaggtgacattcactaattctacttgtacaattcaacaagttttgatagaagcatagttacataggccctaccacattcaacccttaaaacaatcccagccagaaactcctctggtgcccctattctatatatatataaatatatatatagagagaaatatatacatagaaatatatataaatatatatagaaatatatataaatatatatagaaatatatacaaatatatatagaaatatatacagaaatatatagatatatatatagaaatatatacagatatatatatagaaatatatctatatatttctaccatgcccagcttctgtgcccaggctggagtgcagtggcacgatctcagctcactgcaatctccacctccaaggttccagcgattctcctgcctcagcctcccaagtagctgggactacaggtgcccaccaccacgcctggctaatttttgtatttttagtagagacagggtttcaccacgttggccaggctggtctcgaactcctgactgggaatctttaaatgaatttttgtccttgtagttttgtgttttctagaatttcatataaaggaaatcatacatgaagaagtaagtaaaaagctaagatttttacttagcatcatgcattttaaagtaagtcttgtctttatatatattagtacttcattacttttttttttttggttaaatagtatttcattttatggatatgccccagtgagtttatttatttaccaattaatggacactacagttgttttcagtttggggttgttccatataaaattgctataaacattcatgtacagatactgtacagacatacatttttattttccttggtaaaaacctggaaatggaattcctcagtcatacaataagtgcacgtatgaatttataacgtaagtgctaatttataacataaagtgctaatctgttttccaaagtggctcatcaaaaacatatgagcgttgggttgttcatccttaccagaacatggtttggttttcttatctttatttttattttaaatgttccaataaatagtgatatttccttaagattttaatttgcattcccctagtgattaataatgttgatcatctttttgtttgtcatcactgtcattgttttttggtgaagtgtcttttcaaatattttacctaatttttttaaccaaattgtttggcttcttgagttgtaagaattctttgtatattctggatacaaattccttatctgatatatgatttgcaaatattttctcccattctgtggattatcttttaattttcttaatggtgatatttaagagcaggagttcttaatttttaggaagtccaatttttctacttttaatttttattatttatctcattttcttgccttatctaagaaatcttttcctaaccatgttcataaagattttctcaaatattttcttctagaagttctagagttttacatgttacattcaggcttctgatctatttcaacttaatatttcttataacaagaaaggtgaagatcaagactcatcttttttcatacggtcaccaagttaatcaagcatcatttgtaaaaaactctcttctttcaccattgagaatcaatcattgtagaatactagctgactatatatgtgtagatctatgtttagacactatattctgttccaaattattctgtacatttctatactttatctcaatgcaactttatcttactatagctttatagtgtgactttaagtcaaaccatatgaatcctccacatttgttcttttaaaatattgttttagttattctcaaggcttgcattttcatataagtttttgaatcagcttgtcagttcaacaaaaatacctgatgggattttgatagggattgaactgaatttataaatgaattttgggtagaattgagatttaaataatatttagtcttttattccataaacatagtgtatctctctattgctttattttatattgattttttatcaatgatttttaatttccagcacacaaagcttgcttatattttactagatctattctgaataatttcatgtttttgatatattgcaaatggtattatgttttttaatttcaattttcagttatttttagctcatatacaagggtgtgattatatatatataaacatatattatatatataatataaacatatataaacatatatatatatgttgacctggcattctatgaccgtggaaatttcacgtttaaatcagtttagcatttttgtagcctttctgagattttctaaatagctaattataacatctgttaataaagacagttttgtttttcccagtttgcatgcctctatcgctttttcttcccttattcttttcactaagacctcagcctaatgttgaatagaaatggtgagaaaagacatccttaccttgttctcaaccttaggggtactcatcagtctttcacaatttagtattgtatttactgtaggttttgtcaacttgaaagtgttccttatctttctgatttgctaagatctttataaccataactaacaaatgttgaattttatcaagtgcatttctgcatgtattgagatcctccaggtgctgggatgtcagtgctcctgttgcagggccaggcaacaagatttgtatgtgttttcacacaaaaagctgaatctaagctgcctacataggcccaggaataaatgcagcaccctcagttgacggggactaaaaaattcctcctggccgggcgcggtggctcacgcctgtaatcccagcactttgggaggccgaggcgggtggatcatgagctcaggagatcgagaccatcctggctaacaaagtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattccgccactgcagtccgcagtccggcctgggcgacagagcaagactccgtctcaaaaaaaaaaaaaaaaaaaaaaaaagaaaattcctcctctccagttggagacgtgacaaggaatctcggttctgctctgattctgcacaccgagcacataatccagcctcaagcagattttgaactctaatctgaaatacaatcataataatagagttcctgatttcagacattaacatcgaagttgtttttgagttcattatagaatcaaaggctaaaatattctgaagagacatttctgccatacaggccacatgctatctttaattgagaataatggaagctaactctcctaaactcttcttactgtattgaaatttaagtagactatatgatagagcatatattttttcattcattcaacaaatatttattgaatgtgtctgttaggggtccaggcatttttcaggctctgatatgatgaaaggaaaacatgaaaagccgtctcttgttccaaggggagattattattattatttacatggtactgcagccaaatgtgttcatcttattagagtacatattgattgagtataacatgatagcctctcttaggttataaagtacttttatatcctaaaacgtttgtgagaccttttctaaataatcactaataatctaaaatacatacatatatgattttatatatatatcttcacttcattattattttcactaagaatatacaaaactggctttgttctaggaagttactttgctttgtgatatttctgcgtttatttatcctctgtacacctcttattacatagaattatgctgagttgctacaaatgaaataagccaatttctatacattatttgttttgtcaaataacaccatgttcagtctttgcaatgtgtctattcttctggggttattttaagatacatgcttcagtttatattgatagcaccatactaatcattttataaaaatatatgaaatttaattgctgatgttcaatattagacatattttatgctattttatccaccaaagcaaagccttctcctagtgcagatctgagtaaccaccattcccctctgctatcaaatatttccaaattaattagttatttccatgtttttgccctattttgatttgtccaactatttaatttcgaattaaactcatttcacttaagttacaaaccaagcggatgtctagatttgttgtttccagatttatttcagacattaagaaagttatattctgtctttaatatatttaacagaacaaaactcaagttgtcgttttgctaattattcgctatatagattaaaacattaatccctgttaaaatcatgctatttagtactaagtttttttttgttttgttttgtttttaggcggagttttcgctcttttcgcccaggctggagtgcaatggcacgatcttggctcaccgcaacctccgcctcctgggttcaagcgattctcctgcctcagcctcccgagtaactgggattacaggcacgcgcctccacgcccggctaattttgtatttttagtagagacggggtttctccgtgttggtcaggctggtctcgaactcctgagctcaggggatccgcccgccttggcctcccaaagtgctaggattacaggcgtgagccaccgcgcccggctagtactaagttttgttggatgaagggaggatcaaactggggcatgtcattttttgacaacagagttaactgagtgagtggctctcaatggttcattacgtgtaactttcctctaacactgttacatgcgagcttccggtaggagtgccttctcatggagagggtggttattcatcagtcaagaggatttaagtgtgtataatcaccagctagaacgttcagtatgcaacaggcttccttctgccttcatgtgcaatagtggtctttaaagctggagcttttgctgaatgttgttgatatactacaacaatatccagaaaatgcactctatttcctcgctaatccaaagcagacaatggcatacttctaaattaataagaacactgaaaaccacaaacatttaattccaaaatcttgttgctgacattaggatacatgtaaaaatttaatccaagttcaacttaaattcttccatcagtttttgtttagttgctgtggagttttataggaaattcagatagctataggtttcccctataagttctcttcaataatttgattcctgccaataataaatctgtccatcatggtaagtgatgcttttgttattcacattgccttatgtttatttaacacaaaactccatttgtatatctccactggaatccttggtaatttgtgattgtctattaaattgtgttttaaaattggcattgagtttcaaatcatactgtataaactgccaatggtatgacactcattgtttattttaaagccatgataaggataattcccttttctgctaaatggactcagttccaagtagaattacaaggaacaacaaaatgtctttttttatttaatttaatttaattttattattattatactttaagttttagggtacatgtgcacaatgtgcaggtttgttacatatgtatacatgtgccatgttggtgtgctgcacccattaactcgtcatttagcattaggaatatctcctaatgctatccctccccccttccctctacaaaacgtctttgaaataaactttgtagtagagaacaaagtaaacaatccttgataagaatcaagaaatttagattatcctcctggccaagcaaccacctgcctgtaattttgtaaaacaaacttggcttcattgatgtctctctccttgtcagtaaaggaagagagaaataattgaattcattattctccctatcagtaaacagtttattacttttaaaacctaatttccttaaactttgaaacgataactttatgattattgtctttaattattggtaatactttgaataatttaagaatgctaggctaggcatgtccattgtactcattttatgccttaaaaatattcacaattgatggcttagttgtatttagaaaaacatgcatagctctaagtataaaaatgcaatgtcaatttgaggggttttgttgctgtttctcatcataagttcacctgtaagattttactttcaatgtagcatggtatcattgagtttacttatgtctgttatttttcatttttcactgagtatacaatatgtctaattcttcagtgttgttattgtttattatgtcaggtagcaatgctgatcatttagggtttggaatttttgaagtcaatgccgtaggctttcaggataacaaatgaaacagcaaaaggactcattttccatttggtatcttctaaatataattatataaggaaattccctttacccactataggattctgctctcagaaatgtctctgtttctagagattttcgaagcaaatggcctgcaaatgaaaaatctcacttaatacaaacatgcttccaaatgttttagacatattaccaattttagttcaagtttaatattttaataattgtgttatgaatactagcactaaagcatcaattataaatcagtattaggttctatgctggaaatacagtgcatatacaggccagatattcttgaaaaaccacataatactagagcttatgattgaatagtttaagaccttctaggaaaaataaacctgataagttaaaatttgcatacatttatgaaagtccctaaggagattttgcccattaatggacttaaaaaaaagacagcatacctcttttatgaataataattggtggtgtacagtgacatttttcttttagggttttcttttttaaatttttttaaaattttactttaagttctggggtacatgtgcagaacgtggaggtttgctacataggtatacgtgtgccatggtggtgtgctgcatctattaacccatcctctaagtttcctccccttgccctgacgtgtgttgttcccctccccgtgtccatgtgttcttcttgttcacctcccacttatgagtgagaacatgcagtgtctggttttctgttcctgtgttagtttgctgaggatgatggcttccagcttcatccatgtccccgcaaaggacatgatctcatttctttttatggcttcatagtattccatggtgtaaatgtaccacatttcctttatccattctatcattgatgggcatttgggttgttggttccatgactttgctattgtaaatagtgccgcagtaaacatacatgtgcatgtgtctttatagcagaatgatttatattcctttgggtatatacccagtaatgggattgctgggtcaaatggtatttctggttctagatccttgaggaatcgccatactgtcttccacaatggttgaactgatttatattccccaccaacagtgtaaaagcgtacctatttctccacaaccttgccagcatctattgttttttgactttttaataattgcaattctgactggcgtgagatagtatctcactgtggttttgctttgcatttctctaatgattagtgatgttgagctttttttcatgtgtttgttggccatgtaaataccttcttttgagaattgtctttcggtgaatttttatttaccttcctctaatttccagaaacttttcaagattacttccctgattgttttgttgatatgttgctttactgagagtaatatatatgtttagagttacttttgtatgcatgtaatatttctttcgatacttagaccatttctaattttatgatttactgatattgactccctctagctcaactgtggttatagcaaattagagtagttccaatctcttcctatcaacattcatcaactacctaagggttatctcatctcagcctccttcacttttcctgatgcttcttttccaaagttgataccactagtttattgccagttttacttctatttttttcaacctccagttccctggttgttttgtttgtttttgctaatatttccacaaataagtaaatcaaggtctatttttactaaaaccataacttctaaattgaggtaaaggataacaggaatgatttcagaataattaactggaattaatatctgcaaataatatccatcatctgaattcatagcttcttaggcattatatcatcttaaaaagtaactgatttgataaacatctaccaaaaaatcctgcattatacttaatggtgaggaactggaagtgtttttgctaggtttagaagcaagtccaggatgccctctcttacaactcctattcaacattttactggaagaaatagctgatgtaatatgtgaaaaagaaggaaaatgtttatagattggaaaggaatgaaataaaatgtcttcatttgtagatgacatggtttgccatggagaaaattccaaagaaatgttaaaaaataaaaataccaccaataaggtcaatctatctatatatctatactatcaataaggtcaataggatacaaagttaatatataaaataaattgctttcctatattccgcaaacaaacatttcagaaatttaaaaaagaatgatgcaatcacaatagcaccaaaaacctttttcattagcaccaaaaaatgaattacttatgtataaatatatagagagtctataggtagaaatctacaaaacatgataaaagactaaaagaagatctaaataaatggagaaatattccatattcatggattggaagactcaatattgtttgatgtcaactgaatatatagattcaaaataaaagcaataaaaataaaaattgtatttaatagctcttagcaaattgattccaaagtctacgttgaaaagaaaaagacctaaaataggcaagataatactgaagagaaacaaagtttgaagactcatgctacctggttttagtatttagtataaagctaccataatcaagacaacatggtattggttaaaataagatacacagatcagcggaagagaagagacggtctagaaggagcacacacaaatatagtcagctatctttgaaaaaggtgaaaagacaactcaatggagaaagaattatattttcaacaaatgatgccgaagcaaatatacatctgtaggcaaaagaagaacctagcaacaaaccttatacatgttgcaataatcaattcagaacagatcacagatctaactatacaatataaagctataaaaattctagaataaaatacatgagaaaaatctatgtgaacatgggtttggttatgcttttagctttaataccaaaagcacaatttgtggaagaaaagtttcatgttggactttattcagactaaaagtgcctgttctgtgaaagacaagtgaagaaaatggaaacacaagccacaaactggggaaaaatgtttgcatagcaaaaatctgataaaggactggtattcagcatatacaaacactcttaaaagtcaacactaaaataacaaacatcctaattttaaagtgggcaaaagatctgaacagacatcttacccacgatgatatacagatgacaaataagcacatgaaaatacactctaataatctgtcattaaggaattgcaaattaaaacaacaaccagatatgcacgtattagaatggctaatatccaaaaaaccaaaaataccaattgctgatgatatggaacaacaggaaatctcattccttgctgatagtaatgtaaaatgatagtcactttggaagacagagcttggcagtttctaacaaaggtaaacatagtattatcatttgacccagcagtcatgcttctgggtatttactgaatgttttttaaacacgtgaccacacaaaaacctgcaggtaaatgtttatagtggctatattcataatagtcaatttggaatcaaccaaaatgttcttcattaggcaaataaacacactattatactttgatgcaatggaatgttattcaacaataaaaaataaggagttatcaaaccatgtaagcacatggctaagtcttaaagtatatattgtcaagtgaaataaaccaggctgggccgggtgctcatgcctgtaatcccagcactttgggaggccaagtcgggtggatcatgaggtcaggagttcgagatcagcctggccaacatggtgaaaccccatctctactaaagatacaaaaaattagctgggtgtggtggcatgtgcctgtaatcccagctactctggaggctgaggcagaagaatcgcttgaacctgggaagtggaggttgcagtgagccaagatagcaccattgcactccaacttgggcaacagggcgagactccatctcaaaaaaaaaaattaaattaataaataaataaacataaataaaccaggctgaaaaggctatggcttcatactgcatcacttagtttatatgacagtttgaaaaaggcaaaattatagaggtagttaacagatcagtggtgtccagagtttcaacatggggtgagagtggtaaagcacagggcattgctaagcgtgcagaaaatgttctatatgatattgtaatttttgatacataatactatgttaaaaccaattgaactataaaacataaaaagtgttccttagtatatgcaaattaaaaaaaaaacaattattggccaggactggtggctcatgcctgtaatcccagcactttgggaggctgaggcgggcggatcacgaggtcaggagatcgagaccatcctggccaacatggtgaaaccctgtcactactaaaaatacaaaaaattagccaggcgtggtggtgggtgcctgtaatcccagctatttgggaggctgaggcaggagaatcgttttaacctgggagccacaggttgcagtgagcgagatcgcgccattgcactccagcctgggcaaaaagagcaaaactccgtcacacacatacacacacaaataaaatttaaaaaattatttagaggtcaagggcatccccagatagaatgcagaatgtaacaaaaggatctaactacattacaagctctctgagggtgaggaggatgggaatgctgaagtaaggaagtgctaaagcaaagcaaagcaaaacaaaacaaacaaaaataccccaaaacgctcagtgatgaggatatgtcagggacaaagaaaccaaatgaaggagttctcaacaaaagctatagcaatttgagcaacagaaaaaaatacagtagtattggattataactcaaagtataaataactacgaattcatacaaacaataaatgatgtgtaaatcaataaatgggaaaaatggataaatattctggtcagaagaagtccaaatggcttatgtggatactctgccctcagtgagatagggcataactccttgttttttaagtatgggctgtgcatagggacctctttccaaagactgccatatgtgagttgactgagtgtcaacttgattgaattgaaggatacggggtgttgattcctatgtgtgtctgtggggtgttaccaaaggagattagcatttgagtcagtgggccggggaaaggcggacccacccttaatctggtgggcacaatctaatcaactgccagcgaatataaagcaggcggggaaacatgaaaggagagacgggccgagcatcccagcctgcatctttctcccgggctggatgcttcctggcctcgaacactggactccaagttcttcagtttggggactcggactggctctccttgctcctcagcttgcagacagcctgttgtgggaccttgtgatcctgtaagctaatacttaataaactcccctttatatatatgtatatctatcctattagttgtgtccctctaagagaaccctgaccaatacaccatatgaaaattgaaaaaaaaatcgagtaactttgcagtggagaaatttgacaaacactaccccagccaagcaatcaaagtgaaaatgaacagcgatatgccttgttgataatatgtcattgaaatggtgtgacgaaaatggcacttttccactgtggtcttctccagaacacataacctcagtctaatcatgagagaaacatcaatcaaatcccagttgagggtcattctacaaaatacctaacaaggacttctcagaactatcacggtcatcaataacacgaagaccagaaaaactgtcacagacaagaggagtctatggagacaggacaaccaaatggaatatattattgtggttgggatcctggaacagaaagaggatactagagaaaaactaaggaaatctgaataaactgtgggctttagttaatactatatcaatattgattcgttaattgtaaaaaatgtaccataggaatgagaaatgttaataataggagaaatttgatgtgggctgtatagaagtctctttactatcttagtaattttttggtaaatctaaaactattttaaaattgaaagcttattaaaaataaatttaaaatgtgattgataattaaagtcgtataattatgcagctgatgctataattaaactaataagaagaatataattagattcacatgtactgatatggaagaaagccaaagatacattatgttaaaaaaaagcaaattgcaaaaacatcgattgctgtgacccactttatgcaaaaatgtgaacacatatgcatacacctaaatagttgaagaggtacacactaaagtatggttacttcaaagatagcagtaacattgaggtggttgtaaaaaatggagtgaatgtgggcataggcctttttttctatacatttctcttatttgaatattttataataaacatgtatttgtagatacgtataagttctttatgatttaaaatgcttttcttagatatatcttaacttcttttgctaccaagtctgccttaatccattattccctttcattaatgtaacatcaagtgtcttctccaatgcttctttttgctaggcacgtaaacaagactaagtttctcccaggttaaagaggaaaataacaaaacaaaataaaacaaaaagctaccttatgcctttcagttaccccgtattttttttctgccaaatttcctgaaggtgttgtctatggtcattatttctacttccctatgtagctttctctgtcagttcactgcaggctgtcttctgcctttacctctctactcaatccagtgtatggcaaccttcctgacagtgtggtggagagggtaaagctctgggcacatttgggctctgtgtctgagaatttgcatattttgctttactttcctaatctcaatttccttacgtctaaaatgaggacagtatccttcttgccaacttctagtatagaaactgatacataacatatttttaaaaatattgatcagatgatctaaaaagcaatctcgtcatagcatcatggcaaagatgtaatccctcaccatctttcctctagattcttgcggtggtctactagtgttatagatgaactaacctccctaaagagtctcagtgtgtctgccctcacaacccttcaaatctctgtcaacacaatatccagagtgggcccattgaagcctaaaaaatgtgcatgtctcctctcctcagaaccttccagagcctactattgcacaagaatgtgtttgtgtagtgtttgtatggcatgtgtatatgtgtgtgtgagagagaatgtgtatttgtggaggtaatcctaggaatcaacaacactggagtggaaaactatggcagggaagaaaggaagccattaaagttttgttatcaagcagcatactgctgtgggcaccaggtgcctaggctcagtaggaaactcagaagggtagggtgaatatgacccagaggagttccaaccaaggttctaagaagctgagaatttggtccacactatctggcagttattggttgatggctgctttggggaaggatgtggaaggaatgcattactttctaacatgtccaatctactttatctttaagcctggcaaactgtagcagccaaagagagcgctcagttgaagacctgtcaatagggagcatacccaagaatggtgaaagccaaggagatatggatgggttgctgacagcatctactaaaatgtcttcttttcaaatatctaatgtatttgtatttcctttttaaccctatgcatcatgtaaggttctttaggaaatagaaggcatattcacaggggataattaaagagaatttaacaaaatggctatttataaatatgtaagcagttttcaagaatttcacaagttagaagaaagctagatggactaaagctatttccattgtctaaaggagcaagggtagggaacagacacttgaacctattagatgtggctttaagtaacagaaatcaggcaccgccaagctacgcctcagcagggaaggatcctgagaaatcacactcagattgatctctcctccaacctctgatctgctctttgtgttttgttggtcaaagcaataacaagtcagagtatagaaagtgaagcagtactgaagagtcagtggccagagctcaaagctcactgaagtatgagaagtggagccagaggagcaggtggagaatattcagcatgactagggcaatgtaagttgtaagagagcctgatttttgtccccctgtttcctgcactatcccctacaaatagaacagtgcctcatacatagtcagtactaaatagatatttgttgaatgtttcagtccattcacaatacttttgctattcattgtaaattattccaagattgcacttcgtttaacttttgccttccaaaaagtgcaaattgatatctcgatattgtgaatgaatacccttaaaatgtttaagtgcttcatcataggggagtgtcacagcttcgaataatcgtgatgtaaagactggttttttaaaaaagtcgtcttctcttgtaactcaatatttccatttcctcttctcgatgaagcaataaaaatggttttcctgagttgccagataaagtccttattcaaaaactgtttgacttccatgaacccaaaataattccacttgataaagtatattttattagtatttaccatcaccttaaggaaaggcatatgtaggagattgcctagtgctgatattggaggaccatatatcagaaaaacatatattaaattacacttgatcatttctatatttctaacttgagagaatatttctgtcagtcagtgattcaggatcctgtatttaattagctgttaaacatttattacaatttttgattttgtcattttttattaaaatagttttaacaaacatgattcattgaaaataatattctcatcccacgttaaagatagttttctacttttattttttctactcaactctttttaccttatattcatcaaagaaaagtagaagtaaacgtatccccccaaaattcatttctacttgggctctgtgaatttgactttatttgaaaataagatattttcaaagataatgaagttaagatgaatttacactggattgctaaagatctgaaatccagtatgactgatgttcttataagaagaggggaatttagagacagacacaggcacatagaagagatgcgtgtgtagatggagacagaggttggagttaggttgccactggcaagagtaccaaaggttgatggcaaccaccaaaaactagggaagaagcatgagctcgattttccctcagagcccacagaaggagccaatcctattcacaccttcatttcaaatgttcagactccagaaccacaagagaatgaatatctgttgtttgaagtcaccaggtttgtggtgatttgttacagcagtccaaggaaatatatacagaataaaatacagtaccagatctgttctcatccactggcaaacattttttggaatattaaatctggaaatgaagagtggattgccactttcttttttttttttttgagatgaagtctcgctcttgttgcctaggctggagtgcagtggcacaatcttggctcaccgcaacctctgcctcctgggttcaagtgattctcctgcctcagcctcccaagtagctgggattacaggcatgctccaccatgcctggctaatttttgtatttttagtatagacggggtttcaccatgttggccaggctggtctcgaacacctgacctccagtgatccaccctgcttcggcctcctaaagtgctgggattacaggcgtgagccaccgtgcccagccaattgccactttgggagtatcaagagtcggcccttattagcaagtatttctatctgcccgtttgggttgagcaaaattagaactgacaacggactagatgcttctattaccagtatttcaacctccagaggatccagataacagttttcaagtaactctcatagtagcctaagcttacttaaactctgaaatgaaagaatagaaatagactcaggatgccaaaaagtcatacatttatgatttaaactcatcaaactgaaatttaaaataaaaattatcttgaaaacctgctacatagcaaacactgtgttaggttctgggaatacaacatcgaataagacaatttccctgacttcaaggaatttgaagtatgactgtaagatacaatgaaatgtacaatgaaaagggaaacaggaggctacagaaataaaatgaggcctatcatatttagctatatgctgaaggcatttgcaagtcgttgaggagtttgaagttgggaagcaacaggataaaatttgttgtttagaaaacagcacggggtagagtggagggtagtttgggcagatgcaagcctggaatgactgggagatcagctaggccagtatagctgacattctgagaaaaaggtgaggtggcttcacatagagttagcaatgaaaaaatgaaagtgaaaaaatggacggattacaaggatgtttaaatggttaatcagcaaagtttagggatttaattgggggtagagatgggaaggaaagacagtggggagggaaaggcagattccagttagtggaagttagtggcatcatggtgcagttttctctaggcaggaggcccaagatgaagggcagggtccaggtacacaacggagaggcaggtacaatgggctacattcaaggaaacagattttctgttatttacattcaagttatttatatacccacccactcacagacactctttttttattctttcaaatgaattagcctactcctctctatttatgaacagcatttggttgatttggctcattatttaactaaactaagttcagtcaactttcaaaaatagcaaaaacaggccaaagtgggaggatcacttgagaccaggagtttgagaccagcctaggcaatatagtgagacccctgtttctacaaaaacaaaacaacaacaacaaaaagtatccatgcctggtgttacgcatttgtaatcccaaattacaaaggctgaggacagatgatggcttgagctcaagtgttcaaggctgcagtgagctatgctctcaccactgcagtctagcctgggtgacagagagagaccatgtctcaaaatttaaaaaaagtatttcttgatattacacagctagatattttcaaaacataattaacaaataaaagaaataatttgaggtaattgtaaaagacataattttaagtaaaatttaaaaatcttcacgaatattccttgctctcattagatggtgaatatttaaccgaactttgcaggtgatggcagagacacaggctaataataaacatgatgacttgaagtagtaactcaatttattattttaatatatattaaagttaagtatgataaatttatttaaattaaaagaaaaagtcatatttaattttgtggaaatactaagtaaataaaaagtgtaaacattgttccagaaataaaactgcaaccctttaatgatctgatcctaggcctcaacctggctctcagttctaaagtcttttcgttctaagtgtttgctctaacactggatccctgtgtgttttactccaaatgcagatcccagggtacaaggatgagacaaattgcatataatcaaaaggggaaaaccaataactatgactaaattagagaaacaactggcacggaagagcgtgagtcagaactactagttttctagttttttcttttaattcaaaaattgaagtatggacaggtgtattctgtgtcctgtgaagctgtggggcaattttaaaggccatcctttcagtagtgtcaacactggtaacctcaatgttaaccacacgctctgcacaatgaatacttcaaattttccaagacaagtctgcagaaaacaggaaatggattcttcattctgcacttttttatttctaaggttacattcttttaacttttcagactgttactacagtttatatcacatactgaatgtttcctagaaaactaacaaagttgagatcacctgaattgcttttctattttcctgcacactggtatgaatcatacttctctaagcaaatatgttccttaatgtattacttttcttactttgaaaactctaaaactacctactctaatttataatatcacagaactttaccctgtgtttactatacatttacctcaattttatcatttttattctacatacaaccctcatgagattgtcactgtctttcttatcatctgtgtgagcattagtcatgaggctggaaacttcttggggtaaaaaatattccaatattcataattatatcggctagcttccagcatcatacatgacatagggattttatctgttgtttgaaattgacagagccttctaaaaccatataatcactcattggcttggcactctacatggcaatatttatcaatgactatgaagtgcaagacacaatacaaagtgtatatccaatcttatagagagcatttggggacatctatgttgcaaaatttagagttctctttatttggatttgagaatgataatgtgacatgtatgctgttttaaagccacacctgttccagcactggacagcaccacgttttgcctcccatgtttccagatcatgttttgccaccaaatgagttcaaattgtgtcaagtgttgttgaataatacaatatgtaaaaatctagttttaagagctggtattttggttttattgttgttgttgctgttgtttcaggattttaaactgtggaacacattgtcagtgatccaaagaaggaagagataggcatttcaggaaaatgacataaagtgtaagaaaatagagatgagggaaaaaaaaaaaagaaatactttagaaaagacatgtaatccagagagctgggagcgtagatcttgggaaggggtcaagtgcattacagctggagcaaggcatcagggttgaattataggagatgtatgttttgctcctattttttttcctgctttattgagatataattgacaaataaagttgtatatgtttaaggtatacaacatagtgagttaatatgtttatgtgctgtgaagtgattaccacaatcaagctaattaaaacacccatcacctcacatagttactcattttctgtatgtgctgagaacacttgagatctactctcggcaaatttcaactctacaacacagtgtcattaactatagtcaccatgcgtacattacatcactcgaacctattaatcttataactggaagtttatatcctttggtcaatttctcctcattctcccaacttcctagcccctggcaaacaccattctaccctctgcctctgtgaattcgacttctttaggttccacatataagtgagaccatatagtatttgtctttctttgtctaccttatttcacctagcataatattctccaggttcatccgtgttgtcacaagtggcaagatttcctctgtttcatagctaatattgtactgtgtatataccacattttcttcatccattcatctgttggcagatgctttaatctgtttccataacttggctattatgaataatactgaggtgaacatgggagtgcagatatctcttcaagatactgatctattttcctttgcatatataccaagaagtgagatagctggatcatttggtagttcactttttatttacttatttatttttaaggaacctccgtatggttttccataatgaccatacccaattaaactctcaccaatagtgtacaaagattcctctttctccacacccttgccaatgcttgttatttcttgtcctttttaaataataggcatcctaacatgtgtgaaatgacatctcattatgattttgatttgaatttccatgaaggtttgtgatgttaaccattttttcacgtacctattggccatttttatgttttttttagaaaaatgtcattcttgtgtacatgtaccctagaacttaaagtataatggtaatcaaaataaataaaataaaaaaaggaaaaatgtcattccagtcctttgcccatttttaaccaggtttttcttttgctattgagttgtagtttcatatataatttggatattaacctcttaacagacatctggtttgcaaatattttctttcactccctgggttgccttttcatttgcttgactttttttttttttgcctcttccagagcaattaaatacactattagctatgctagtccttatttattcatgactccctatctctagacagaaaactctggggaacaactggcccctatatcctcccacttactagatgtgcatgttctacagacactttaaattcaatttgtctaaccatattcatccattaatttaataagccattattagccaatgtataagacattggaggttcaatggtgaaagtcataccaattgcatttttggtgcaattacttcaataatgtaattattacattacaaaattacaaaccgaagcatactctgatggaaggaatgaatgtccttctcagagagtatctaagaaggtagcttttccacatctggtggggctgatgttctctgaggaagtgaaagctgatctgggatatgagagtgaaaaggaaaggaaggaaggctaccagaatggaaacaagcatgtgcaaaacccctgtggcaaggcagagtggaaggaatcagagaaagtgaaagaaacccgtgtggaaagaaagccaaggaaccacagcttgtatatgaaaccatcactgttagccctctagaagccttctgtctgctcagccccctttcttccactgaaggaatagtaactacactgttcaaatatttatggcaataattccttattatatttagttaccactcttaagaatttccttttaagtttatataaatggaaccataaagcatatagtctttgtgtatgattttacctacagtacattttgttttccaatttgtttgtgttcttgagtcgcacatttcattcattttggatgctcgagaggattctttgtttgaatatacaataatccatgaacctaatgctttgatgatgaacatttttgatgtttctgtgtttctagtgatcacaaatcatatatgattaaacatctaggcacacatatgcacgtcatttctctagaataaacagcaatatgtatatatatttgtatatatatatgaacatgaacatatgcaaacacaagttcatgcataatactaatataaaattatgtactattctatctcctttcacatattttctgtttttgtctctcttttcatcattattgatgttttcttcttccctttcttccatttaatgatctctctgcatcttatccattgaattcttagtttaggctatttcacatattacattgttttagttctagaatttctattactttcttttctgaaaaatctgcctgacagatctcttagtctacacaatctaacacgattttctattatgatggaaatattctataaatcagtattgcacaatgcagtattaaccaaccacacatagctattcagctcttgactaaagaattgaatttttacttttatttatttataattatttcaaagttaacattggtagcaacttttatattagatagaaggtcttctatgattctattttcaccatccacttaaacttaaaagaaaaaaaaaaacctaactcactcaggggaggcatggtggctcatgcctgtagtcacagcactttgggaggccaaggcaggagggttgtttgactcaggagtttgagaccagcctgggcaacaaagtaaaatccgatctctaatcataataatataaataattagctgggagtattggcatgcgcctatgctcccagctattagggagggtgagatgggaggatcacttgagcctgagagatgaaggctgcagtgagacctatcatgcctctgcactctgacctgggcaacagaacgagaccctctctcaaaaaacacaaaaaacataaaaactaaaatgctcaattggaaaaatttgaaaaaaaaatagacaatcataatcaattaagactcaattgtcaacactcatagtgtataaattatatacactaaatgagattgtgtgcatactatccatatctacacacatacacataaacaaaataaattttagtaatgttagtttatgtattttatagcctattttttcaaacaatatttataaaataattttatggcattaaatagtgtctaaaatcatagactgtaatgactgtgtaagattttactcttggttctataataatattgtcttattactcgacatttagacgactattttgatactgttgctaacatgattatctctagctgatttcttaggattattgagataaaagtaggattgctggaataaaatatccaaatattaaaacatttttggtatttattgtcaaattgtttttcggaaaagttataccagcttgaattgccattagagtaagataagaatgcagtgtgaatttaagtcctgtttctcctctaccttttcctatctcctctctttctgtatcaccatatgacatttgtcatagtcctgttcttcttcaatatctttgttccataacctctgttttaaaggttccctctccccattccatgttcagctctcctgtcttttttttttttttctgagacagagtctcgctctgtcacccaggctggagtgcagtggcgcaatctcggctcactgcaagctccgcctcccgggttcacgccattctcctgcctcagcctcccgagtagctgggactacacacgcccgccaccacgcccggctaatttttttttttttttttttttttttttcagtagagacggggtttcaccgtgttagccaggatggtctcgatctcctgacctcgtgatccggcacctcggcctcccagctctcctgtcttaaatgctaaatctcacatccatatttccaatctgtcatgtcttccaagatcaagttccacttttccaacatgtctgctatatatatatatgcgtgcttgtccctactgactctcatcgcatctagagctcaatttttaacattatctcttcccccagcctatcctaataactcaactccccatgtgttcagatttcccttttctgtaagcaatcctattgtcacttgagcacaaaactcccactctttgtcgcttttcctttatctcacaaatgccgacagtcatcaagaatgattaaattttcattcgcaatatgaatccaagacatgtcttcccttgcatactgctgcttccatgctagaacaggcctttatcaccatggcaattttcttttaaatactgttcctgcatttagactttccttccattaatctattctactcaatgcttctaaactaatctactcaatttatcattttgagggtaccactgtcttcatcaaaagtcttcaatgtccccctgttgtgttgtaagcaaccccaagttgcataatttgtcatttatccatttgtcttgccagccagccattcaaaatttatggagtgcctacatgattttttttcctttggagaactgctggctactggaactactggcccttgcttaaaaagggtgtgaagtgcctgggagtttatatccccttgagatttccactaaccagtgactgaaagatactgacaaaagcctcacatccatagtctgaattataatagctctgaagcttagtttacactccagtttccctatggaatcaggcgaaaggctgttcttgggctttgcacggcgatcacactcttgcctgacttccttgtcttccttgccctacttcactggttgccttatttatctaccctggagcccttccttaataaattatttttatgtgaattcttctcttaggttctgcttctggaaaatccaaagaaaaccacttttgttaagaaccaaagacatgatcactactgcgaatgaactcacgctgagtagaaaaatagacatgcaagccagcaatttaaattttaatatgctatctaccataatagtgggatttgcaaagtcctgtgagatgaggaaagaataaatacctatctcaggtaagggaagtcggactggaaagtcttcccctaaagtaatatctgatctgaaattcagataagatattttttttaggcagaaataataggtaaactagttataacaaatagtgtgggaaaaatttaatgttataagaacatgaaattcttcaggaactacaaataactcaacgtactattatcagaggcaatatgtgatacaagaggggggagggaactgattcgaacaggtgagtaagatggccgaaatgtgaattcaaaacattctctgagtgttgtaaaaagagctcatctagtttatctgtcaaagatggcaaacaatatggagaacccaggagggcaatgcctttgattatagagttgtagctattgctctggcagtattgtggaggactgcatgtggaatttgcaagtagggctagtctggagaaagaataatcagaaatcaaataccatggtgagcacaaagggctgagaagagagataatgtgagatattagaagaagaaatggcagtagttggtgattgattgggtctgtggtaagattctaggctttggatcaccctgccagtcaccaaatctgatagaatttttttgacttactttatcaagatagcagcattttccttccttcttcagcttcctgtttgattgttttgctaacttttgtacgttttccaaattatccatattgacaacatattattcttttacttgcaaagtggagtaggtggtaaaaatgaaatcatagcatatagacaacttactagaaattattgagttaatcagaaaaagcatgctgataattaaaatacatgtgaaaaaacgtccaacctcaatcataactgtttaaaaaatgtcaattgaaacaatatcagattaacaaaaattttagttgtaaaacattcaattttagcaaagataaaggaaagaaacatgctaatgcaccacctgtgagactataataggtccaaatttttgaagagccattgcaaatatctggcaaagtaaaacactcacttcctttcatccagcaatggcaccactaacaatttacactaagaatcaatctagatgaatatatatgaagatgcttattactgtattatttataatagcaaaaaagtccattaatataaactcattagctatactataaaatgaccgttccgtggaatattatgcagatgttataaagaatatgttaatataaatgtggtcaataaatattgcattacaaaaagaagagtagaaattgagcttgtagagaataatttcatcaccacttaatgagaatatatatacactgaaaatttctgaaaggatccatccaaaactgctaacattatttaccactggggcttgaaaatgatggagatttgctcttgtcatttatttttttccccaagaacaacagtaatttggcgataaaattaatggaaaggggcattaacaagataattgagggacagtgtttagtttttacatgtttgtggaaggagatgaggaattaaaactttatataattctgttgaaataaaataaaaataaaatccttagagtcacaactctaagaaaggacaagcacttacagataggaacatagacgctaaccccacatcctgtaagtgtcaaaccaacgactaggattcagctcccctgacccttgccccagtgctctttctatgatcctaagcgatagtatatctatgcctagaaaatcaagccaactgaggtggaaaagatctctgccattatttctgtcttctccgaatatacgggactgattttgagttcataaataaataagaaatgttgaagggttgtccatgggacactaaagttccactgtattctcaaccagaatttcttaattcagtaccattgctctaaaaggatgctttctcaagcactgaaaaatatggttccatttatgtccctaacttaagggaagagacattttgaattggaggcaaataatctatgttgtaacacttcaaagctaggtcaggaagcttatgctaaatgccttatgtgtacttgtgacttttgtattctgaccctgaatgtattacacagataagctgacatgtctccaataattttcctcctaagtacggtataaatgaaatattagctcatattatctcggcaccccaccaactgatcagtttgttgctataaagtgcaaatgcccaatcatataaaattccaagcattgctctgttgaaaatgagaaggcatcactagaatgtgagtgaaaagaatattatgtgcttcccttttctatatgttagattgcttcacattgaaaaaataagttcaatctgggaggctgaggcaggcggatcacaaggtcaagagatcgagactatcctggctaacatggtgaaaccctgtctctactaaaaatacaaaaattagctgggcgtggtgacgtacgcctgtagtcccagctacttgggaagctgaggcaagagaatcgcttgaacccgggaggcagaggttgcagtgagccaagatcataaatagtcttcactccagcctggcaacggagagagcctccatctcaaaaaaattaaaaaaatagaataaataaaatataaaaaataagttaaataacatactacccaaaaacttgtaaattactttatccatctacttctaggaaattacaaagaacaaatttcattattttagcataacagggatggattttcttttgtaatgttcaatatattaacgatagattttttttcctagtgttctttaggatacttcctgcaatacttcattcaagttatcagtgatttttactatgtattgtaaatgatacatagccaccatatataaatatttgctgaattcaagattactacgttaagaaactggggtaaataaaatggaaacaagacatccgtgaatatttaaggatataatatcgcaattgcatgtttctgctggcttttcatgatataataaaccttgttttttcttctaatttaaaaaatgctatcaataataaaaatgctaattatacataatcaatatttttatacatatatcaattcttacaaatgttctaattgcagtttagtaaactgatgtgtaaatatactttgtaagacagataattttttttctatttgtaggtattttatttttatgatattgtaaataatatatttttaatttttttattatactttaagttctagggtacatgtgcacaacgtgcaggtttgtgacatatgtatacatgtgccatgttggtgtgctgcactcattaactcgccatctacattaggtatatctcctaatgctatccctctcccctccccaccaaccccacgacaggccctggtgtgtgatagtccccatccaagacagacaattttataagaagattaacttgaagttataagtagactagtgaattaaaatttccatttcctatgctgcagagcacttttaatgcaatttggagggagaacattagtgttcagcatttataatttatcatttgacatttggactaaaaactctatttccaatactgcacatgctaccataatgcagggttttacaaagagattagcgtaattcaatggttaatcatatttcaaaaaggagctatattgtggactttatattcccctcatagttgcttctggaagggatctcatttgttactccttctcagcattgggttctattcagttcttaagtgaaaacgggaaaaaatgctaccctatactgaagcatttcaacacaattggaaacattatgcatgattttcaatagatgaggatatacatttacaaagtattcacaaaaagatatttttggccaaatttgaatttgttgaaagaaagtacatctctgatctacttttttagaattttctgggtttcaaggtctttaacagaggtgtgtacgtatgtgtgtgtgtgtgtgtgtgtgcacgaaaatgtactgtgttcataaaaatgccactgttggtgtttccaaaatgaagctactacaaaatacagaattggtgtaatctagagagggagaggaattgataatgcagagagcactttgaaaataaaactgtggaaaagaggccacagtatggaccagaggtaattacccgatcactaaaaaagagagaagagaaagaaaaatacacaggaaaacagggtcagagaggcagaaagtgaaaaatcaaacagtatatttggcactgtagagagtaaaagaatgagagattttccccctttctgttcatgggttatgaaattgaggttttccatataattaagaaaggatggatcttggcgaagggcatattgtcatctatgagagagctgcgagaagtgtagggaagattggagaagatggctgacattgctgctttggggtagttgctctaaaacttctgccattcagccatgcggatgaggtgagcaggtatttggggacatgtgtgacacttgatcacatgtaacaataatatatattacatttagaacaatttatatcataatttatgtgtggaacaggatgtagctcaacaatgaatattcagaaactttacctaaaagccaattcataagttattctaaaattgttgttaacctggtgggtgtattttctagggatttcaagtgagcaaaaattgccaagaaataaaatccgtcaggaataatgtctgctttgcctgtgaatcatagacacacttaagaggcatttaacagtttagttagagcaataaatgatctttgctttaaaattgaaaaatgtgttttctttaaactttggtttcattttcttaggcgtttattcaaataatacatatgtgtgaatgtatgtgatttttagactataaaatactttgaaactgttagataaatctttgctaataagacatttcgttatggaagaattttgggattccttttgctctcagtattgactactgtcattgtagaagttctgacaatatgatgattgtatgaagactctgtgttcaaatgcatcatcccaaggcactgaaaacatattttcatgttcttgttttatcatatttatgtataacggaaatgggaagactgaaagatttcattatcacaattttggagggcagagaaaataccgacaatctgcatttccaggctaagtttaagctattcagaagccaaaccttctcactattcagctggcatatcacattcagcgagaaaatgtttcagttttttcatagctatgtttaactttaaataagagattacataattaatgctaaaactgcctgtcactattatattccttaaggttttccattctttcttagcttaagtcctgatttttattttcattgttatcattgttatttttcttttcatagaaaagtactacttagctctataatcttttgtttgagattaagggatgaatatttttgacaaaggaaaaatatgcttgaataagtttgtggtcttccgtgaaggtttaaccttatagagttggattttttacatttttgataatagcaatgattacataaaccttatccaaaaattgttataattattgagattaattttgaatcaattaaaaagtttaaaaataaatattatttgaagtgtttataagatcagaaaacaactgaaaagattcatggttatacatcaataattgcttatagtgtaaatgaaaacatttgttaatttctagaaatttattgcatatttgattctactttccaggcaatattcccacattttaagtttgtcttcatttcaataaaactgtatccagaaaattaataaaactataatttgaatgtacaaaaatttcaaataatgactccatatatgctcaggaagtttaatgtcttgactttaatcataccaaagacttcttatattaatacaattttgtatatatgcaagggtttcacttctgtatgtaatcaagaactcaactaagctgtttatcctctccatgttcttccagaacattctcccttaaggatctaattcatggttacttcttactctatttttaaatttcaccatgattatgcatctcatttacattttatttcctgggtctttcctcacctctcaaaaactacccagagagcatgatagcagccttttcttgacttccacaccttacacacacacacacacacacacacactcttactttcacaaatatgtgataaggggaacagtgttgctacatttatattattcttgacagatgaaactgggcacctgtttgctgcatatcataggcttggccaacatcaggcagatgctgcccagatggcctttcttcatctagaaacatggagccatgctggccatctcactttcctcgcaccctcaacctaattgtccccaggtcccaatcagcagttgaatgcatttcctttccttcattttcctttctgctatccaggcatttgtcctcttggaaagcaagacgaagccttcctacctcatgcttaatctgctccagtggcattagcctaccctcattcctcagagagaacagatccttcctaactcagaatttcacacaaggcacgtacccaggagtcctcgccactctattccaccccatgtcccctcatattcaatagccataggctttagtctagaggtgacacctctgggacaatgtacctgaagccctagacaaggagctttgttatttgccatcacatattctacgtttttctacatgacatttatatcaataatttttgtttaaataatttttaatattttagtccctctcctcaacatacacgcttctaaaaatcagtgtgttgctcactaccaatttccagcacctagcacagtccttagcatatggttggaactcactgaatttcagcattataacgaaatgaattaaatggatgttgtacacatgtgtgaggagccatgtggaatgtaaatggcagcatacctatgtgtaaagttgtcagaatcaaggaaatggagctacattgggagccagaaagctaatccatatggatgtcaaggagatgaggcttgagacacagagcagtgagcaatgtgagggatccaaagggtagggaagtcccacaggaacacaggagatgattcaaagaacccgtggttgtcctgaaacattgcttttcttcatgggctagaggacttccttggcagagggctgaagacaaatgcgtgcaaaagtgctttctctaaatgtctcaccagcttatgttttcaatgtataattccagaactatatatcacccatctctccgtgctgttcagttcttttcatcctgctaaatcttttctgcatctctatttagatgatttctcattctttccatctgagactgatggttatttccatgtggggatgttacgaagaagagtatttagggtctagttagcaaaaacagaccatagaatttttttttaaggtctgcccagcatttaagaagatatcagcctgttctccaagtgtccagtcctatctcgtgtctaccagcttttagcctttttctaaggataagctctcgcttttcaaattctgtgtgacatttttaaggccacatacatgaacacattttcatttattccatcttgcagtcctgaagcagtaacgtgactacctgttgcagcaaaaaggctgctccttggcctgatctgcatcttccggggaacttgcctggcgatctacgatccatcaaattttccccttagtaaatctcagaaaaagatcacccataagcatagcacaggggtattctgaggtttgactagtatttcagagtgctgtagatcctaagatgaaagtagtaagaaagttgaaaaaatagtattatttattcaacagacatgctagaaatctcagagcttccctagtccctattttctgtcctaagcatgtaacataaaaccctgcaaaatcagaactgagttctctgtaaagacattcagaaataaacaagaccaaccttgaagggggaggccttgtaatccatggtttattcttcttgttatggctgatggcagcacctagattagagtaggtgctcagccatggattcactgaaataatgctttaaaagtatactaatagagaagaaaagagagaagaatcaaatagacacaataaaaaatgataaaggggatatcaccaccaatcccacagaaatacaaactaccatcagagaatattataaacacctctacgcaaataaagtagaaaatctagaagaaatcgataaattcctggacacatacaccctcccaagactaaaccaagaagaagttgaatccctcaacagatcaataacaggctctaaaattgaggcaatagttaacagcctaccaaccaaaaaaagtccaggaccagaaggattcacagtcgaattctaccagaggtacaaggaggagctggtactattccttctgaaactattccaatcaatagaaaaagagggaatcctcccgaaatcattttataaggccagcatcatcctgataccaaagcctggcagagacacaacaaaaaaagagaattttagaccaatatccttgatgaacattgatgcaaaaatcctcaataaaatactggcaaaccaaatccagcagcacatcaaaaagcttatccaccatgatcgagtgggcttcatccctgggatgcaaggctggttcaacacacgcaaatcaataaatgtaatccagcatagaaacagaaccaaagacaaaaaccacatgattatctcaatagatgcagaaaaggcctttgacaaaattcaacagcccttcatgctaaaaaccctccataaattaggtattgatgggacgtatctcaaaataataagagctatttatgacaaacccacagccaacattatgctgaatgagcaaaaactggaagcattccctttgaaaactggcacaagacagggatgccctctctcaccactcctattcaacatagtgttggaagttctggccagggcaatcaggcaggagaaggaaataaagggtattcaactaggaaaagaggaagtcaaattgtccctgtttgcagatgacatgattgtatatctagaaaaccccatcatctcagtccaaaatctccttaagttgataagcaacttcagcaaagtctcaggatacaaaatcgatgtgcagaaatcacaagcattcttatccaccaataacagacaaacagagagccaaatcatgagtggactcccattcacaattgcttcaaagagaataaaatacctaggaatccaacttacaagggatgtgaaggacctcttcaaggagaactacaaaccactgctcaatgaaataaaagaggacacaaacaaatggaagagcactccatgctcatggataggaagaatcaatattgtgaaaatggccatattgcccaaggtaatttatagattcaatgccatccccatcaagctaccaatgactttcttcacagaattggaaaaaactactttaaagttcatacggaaccaaaaaagagcccacattgccaagacaatcctaagcaaaaagaacaaagctggaggcatcacgctacctgactttaaactatactacaaggctacagtaaccaaaacagcatgctactggtaccgaaacagagatatagaccaatggaacagaacagagccctcagaaataataccacacatctacaaccatctgatctttgacaaacctgacaaaaacaagaaatggagaaaggattccctatttaataaatggtgctgggaaaactggctagccatatgtacaaagctgaaactggatcccttccttacaccttatacaaaaattaattcaagatcgattaaagacttaaatgttagacctaaaaccataaaaaccctagaagaaaacctaggcaataccattcaggacataggcatgggcaaggacttcatgactaaaacaccaaaagcaatggcaacaaaagccaaaattgacaaatggggtctaattaaactaaagagcttctgcacagcaaaagaaactaccatcagagtgaacaggcaacctacagagtgaacaggcaacctacagaatggaagaaaatttttgcaatctactcatctgacaagggctaatatccagaatttagaaagaactcaaacaaacttacaagaaaaaaacaaacaaccccatcaaaaagtgggtggaggatatgaacagacacttctcaaaagaaaacatttatgcagccaacagacacatgaaaaaatgctcatcatcactggccatcagagaaatgcaaatcagaaccacaatgagataccatctcacaccagttagaatggtgatcattaaaaagtcaggaaacaacaggcgctggagaggatgtggagaaatagggacacttttacactgttggtgggagtgtaaactagttcaaccattgtggaagacagtgtggctattcctcaaggatctagaactagaaataccattcgacccagccatcccattactgggtatatatgcaaaggattataaatcatgctgctataaagacacatgcacacatatgtttattgtggcactattcacaatagtaaagacttgaaaccacgcaaatatccatcaatgatagactggattaagaaaatgtggcacatatacatcatggaatactatgcagccataaaaaatgatgagttcatgtcctttgtagggacatggatgaagctggaaaccatcattcttcgcaaactttctcaaggacaaaaaccaaacaccacatgttctcactcataggtgggaatggaacaatgagaacacttggacacaggaaggggaacatcacacaccggcacctgttgtggggtggggggaggggggagggatagcattaggagatatacctaatgtaaatgatgagttaatgggtgcagcacaccaacatggcacatgtatacatatgtaacaaacctgcatgttgtgcacaggtaccctggaacttaaagtataataaaaaatatatatatataaaaaaagatatagataaatgcaggtatagaacatattgctggattgtaaggtatcatttctcctgaaattgatatatacacaatacaaatcaaaatcccatcaggcttttatggtcgttttataataaattgtgaaattaggtaaaaaaaaaaaagaagaaaatgtggcacatatacaccatggaatactatgcagccataaaaaaggatgagttcatgtcctttatagggacatggatgaagctggaaaccatcattctcagcaaactatcgcaaggacaaaaaaccaaacactgcatgttctcactcataggtgggaattgaacaatgagaacacatggacacaggaaggggaacatcacacaccggggcctgttgtggggtcgggggaggggggagggatagcattaggagacatacctaatgcaaatgacaagttaacgggtgcagcacaccaacatggcacatgtatacatatgtaacaaacctgcacgttgtgcacatgtaccctagaacttaaagtataaaaaaaaagtataccaattcacagaaatcctccacacttccaattacaataaaactatccatctattactctaaaatttgtgaatattaatcattctatctttccagcttttcttctgcatttgtgacccctttgtactatttttttctgttaggatacagtcaagaaaactgaaatcatggtagtaggtactttaaagacggaattggttaccagatgttagaaggctctagaagttcttgagcaggagtaattatagacatcagtttaccttaaatgggcagaattcagatagataacaacaacaacaaaaagagactgtggaggttattcatagtggactaatttgtttggaaaaaataagtagctataaatcagtatattctagtatctttgagacaacaaatattggaaattgtttttcttttcttttctttttttcccagcaagtgctgtgtttattttccaaacaattttattgaaatgtcccaggagtagatgggcagcacaaatgtatgaacaggaaaaaaaaatcacatgtacaataatttttttaaagtgaaggttaatcttgggagatatcagttcccctctccctccccctgcagacttccagcgtttccgttaaggttaagcctctacgaacctagcattaaaaaaaaaaaaaaaaaaaaaaggaatacaagatcttttgcaaataacaaaaacaaaaaccaaaaaatggcataaaggaaagagaaataccttcctgctcagatgggactcttcctaggcacctaattagaaggcgtgctgagcggtggagaaacacaacttcagagtgtaagggtatggaccattgggtttttcatcaggtaatggttcaggaagcccggagtctccagggcatcgctcttggattcccattccagcagtccagaggagctgcgctcgctttcgcctgagaatactttcacagaagatggccgcttcactcccagctcatcatagatctcaaagaagttctcctcggtcgcctccagcggggcgttgaagaagtgcagcacgttgctggggtgctggatgcggttcttggctgcctgctctggggtggagaaccgattgttccgggattcactgaagtctttgtaactgcaagacccatcttccaacccgtatgactgaccgggcatgatggctggctgcttggagacacagacattcagcttctgcccaaacatgaagttgttgttgaggtgggtaatgacccggtccacagcgtagccatcagccatctccaccatggcgcccccggcttgcttttcaggaatttcaccttctccacattgccatacaagcagaagacattgaagactaggtcacagttcatcttagattgatgcaagccttagaccacgagcacagggctgtcggcgtgagggccatactcgggtggtgggggagggggtggggggtgcccatactggggggccgtagcgacttgggccccgacagtgacccccgactggtggacccatccttctcccttcgtagtgaggtcgggggggcccgtggccctcatcatggtaatggctgtggtacccaccgtggggccctccatattctgcggggtgatctcccaggagagggggctgcctctggcgtttgttggggttgctgccagggtcaccttgtccactgagattggggtttgtgtagtcccaagtatcctgatcattcttgaacacattcaagcgtgtaggctttgcgtattccatcttcagagtgcaacagccagaatagataccagccccattgagagaggccttggcccgctgggcactttgaacagagtcaaattccaccatcgcctgaactccattcttcctgaaaatgataattctctggacagggccacaaggattacagatagtgtaaagaacatccgtggtgatcgaataaatggggttcaggatggtaaagagaagcacactgttcacgctccgggagtcatccgagtccccggggagggagatcttctggctggtagagtagttgacaaaagctgggtgaccggcaatgtatatttggttgtcggctgcgtagctcacggcgttgcaagcccccaacacatcttcaaactccaccagtgcttgtctctttttaggcattaccaccgcatagctgatgggtccaaactcctgcaaggcctccacaaggtcagcttccaccacatcgtcaatcaggcccctgctgtggacaactggggaggcaggggttttgtgcaggtcatggtagttctccccgccgccgcccccgccgccccgcctcctccaccgccaccgccgccgccgccgcctccgtgctggtcgccggcgttgccagtcttgagccgcttaggggcaccgccgccctcactgccgccgccttagtagccgccaccgccgcctctgccgccccccgccgccatcttcatcgctcccgaccgcctctgctgctcctcccgctgctgcctctgctccagccgccgacgccgcttctcccaggaaattacttttccaagttagtttggtaaagtttaaaaggttggtgctttatcctgtagacaattgagagtagtttctgtatttaagaaggataaataaaatgttctgtgtgcagggcggattagaaatggaagacattggaagcagagagaagttaaggaagaatgttgacattatcttaaagtgttaagaacctgaacgaaactccttgcaaaatcattgccagggaatacagtgtagggccattgactgactctagtagtggatgaggacaactcacagagagaaatctgacaatccatgtttagcagagggaaggaagccagaaatagttactaataagtgcaagacttcagttttgttggttttttgttttttactcccagcaagctaaatttgacaataatgtagctcaatttctccccatctcattttgttaatctctataatcttgccccagaaaagccatttgtaccccagctcagaaaattctgtattcatttgtcttcataagattgtaaaaatttcaaaactgtctgttcatgataattagagaaatacaaatcaagactacaatgagataccatcttacaccaaccagaatggctattactaaaaagtcaaaaaataacagatgctggtgaagttgtgaagaaaaaggaatgcttatacactgttagtgggagtgtaagttagttcatccattgtggaagacagtgtggcaattcctcaaaagcctaaagacagaaatagcattggaccctgcaatcccattactgggtatatacttaaaggaatataaatcattctgttataaagacacatgcatgcatatgtacactgcagcacaattcacaatagcaaagacatggaaccaaccaaaatggcaatcagtgacacactggatcaagaaaatgtggtacatatatgccatggaatactatgcagccataaaaaagaacagagaccatgtcttttgcagggacatggatggagctggaggctattatccttagcaaactaatataggaagagaaaaacaccacatgttctcacttgtaagtgggagctaaatgatgagaactcacatggacacacagaggggaacgacacacactggggactttcagagagaggaggcagagagatgggagatcatcagggaaaataactaatgggtgctaggctcaatacgtggatgatgaaataatctgtaccacaaacccccatgacaaaagtttacctatgtaacaaacctgcacttgtacccccgaacctaaaataaaagtttaaaaaggaagtgaaaaaaactttaaagtagctcaataagttttatattaatgtcaactttaaataatttttatgcataatacgttattaaaattcatttacctttttaaaaaaagaatgtgaaattttagcagagttttcaacaacaatgttgtagttaacaagagaaaagcatccctgatgctttacaaactggtgtttcaatgaattagtcttttttttctgagagggaatctcgctctgtcgcccaggctggagtgcagtggcatgatctcggctcactgcaacctccacctcccaggttcaagtgattctcctgcctcagccttccagtaccagaaggcgtgcaccatgacgcctggctacattttgtatttttagtagagacggggtttcaccaggttggccaggctggtctctaactcctgagctcccaaactgctggtagtacaggcatgagccaccggacctggccaaaatgaattactcttaattgtgttctattcatttgtttttcctgcattttcatttcatttcactttgatgaaccaaccgaaatacccgatggaatacagtgacagcttgaaaagcttcatgttaacaaagttatcattccacagtagataaaataatatgtgaaagtagtgagaacttaggaattcctctaaaatcagaatttaaagacataccacttaccctttgttaaaatagcttacagcacagaagtcttagaaaatgggcattagagtgtcagaaagctagtcatgttagaaaaaacctttcaaatcaaggctagccacctcattaaataataaaatgaagaaactagttataaaaccggtgttccattttcaattttaaaaaaatgctgatggtaaaataaccattaatttaaaatatttttctgctcacttctagaaggtggagcataaaccacttaagtgacctattttagccccactaaagcaaatggcaaatattgggattggattaccaaatgtatgccttccatttcattggccatatatcttattgtttcatgcatggataatggcttttctccttcttcagtaacccaaaggaaaagctgacattctaacctggagctgcacattcaagctttgacacatgcctctcactggtttcgtctaatgcttataataaacctgtagagtcagcaactttagaaagatgggttgaagaagtgtctttatcatagtttgaatttttctctggggcacttggcagagtcacctctggtgtttcaaatgtgcttgaaagttatctggctgccctctgagaagtctgcataaaaactgctttacttaaaagcaggcaaaattaaggtttctgtaacaaaaccataggcatcgcattgagataggacaaagaccaaatatcctgcttccatgtggcagagaaataatgaataacttggttcaagagctcatggagtggcatatcatcacaccattattaatagagaacattgctaatttctaaaagggcttcatgtcatgattattttatcctcttctttctgttaaatttttaacatgtatgtccactgcaaagtacgcaaaggaaataaattagcactaaaaaaagggcttcttcacaaccgcaaattatatatatatttctttcagaacatcactttagagagaaaatagcaaaaattcagcatcatcactttttgacagttcactagccaatcaaaatatagaaaaagaaggagaaattaagtacatttgtattcactgtacatttttagctatttgtgtagaagaaaaacaattagcttatttaaaaaccctaaggtgagtatgcagtttttaattattatctttgctgttgtgatttatatttgtattttatttatgtaaaaaccagtaaataaacctatgtcaaatacttctttatttttgatactagttcaaaatattggtgacttttttagatatgaatatctcatatgtatcttttagaaattatcagagagttataaaataatattggggaggtaaggaaggcactagacataagaaacttgtatagacaaatactttgtcaccaaagttgtatatttaaaagtccctattctttgtctcttatcgattcaaaattaattcattagaaaagaattttcctcaacatttaatccctagttgttcatctttttcactagtttgtattccattactcattgcttcatagctaaactctgtttaaatctgttaactgaaatgattttaaaacgttttggtggagcgctgcgggaggtgcgtgcgcgccccggccgccgaacaaaggagcaggggcgccgccgcggggacccgccacccacctcccggggccgcgccgcggcctcccgtccaccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcaccggcgctccttcggcggcacggaggaccgcctgtcgtgcttcgcgcagacggtgtcccccgccgagaagtggagcgtgcacatcgccatgcaccctcaggtcaacatctaccgcgtcacccctaagcgctaggcgcacctgagcgcgccgccggccgacgagatcgcagtggaccgcgacgtgccctggggcgtcgactcgctcgtcaccctcgccttccaggagcagcgctacagcgtgcagaccgcggaccaccgcttcctgcgccatgacaggcgcctggtggcgcgccccgagccggccactggctacacgctgcagttccgctccggcaatgtggccttccgcgactgcgagggccgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatccggacgaggagaccgaccaggagaccttccagctggagatcgaccgcgacaacaacaagtgtgccttctgtacccacaggggcaagtactggacgctgacggccactgggggcgtgcagtccaccgcctccaccaagaatgccagctgctacttcgacattgagcggcgtgaccggcgcatcacactgcgggcgtccaatggcaagtttgtgacatctaagaagaatgggcagctggccgcctcggtggagacagcaggggactcagagctcttcctcatgaagttcatcaaccgcgccatcaccgtgttgcgcggggagcacggctttatcggctgccgcaaggtcggggcaccctggacgccaaccgctgcagctatgacgtcttccagctggagttcaacaatggtacctacaacatcaaagactccacaggcaaatactggacggtgggcagtgactccgcggtcaccagcagcggcgacactcctgtggacttcttcttcgagttctgcgactacaacaaggaggccatcaagatggacgggcgctacctgaagggcgaccacgcaggggtcctaagggcctccgcggagaccgtgcaccccgcctcgctctgggagtactagggcccgcccgcccttcccggttcctgcccacgtggcggctccttccaaccctccctgctaaccccttctcctccaggtgggctcccccgggcgggaggcaagcccccttgcctttcaaactggaaaccccagagaaaacggtgcccccacctgtcgcccctatggacttcccagtctcccctccgccctggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatctcttgcccctcccagccacctcctcccagccccccaggagctgggcacgtgtcccaagcctgtcagtggccctccctggtgcactgtcccgaaacccctgcttgggaagggaagccgtcaggtgggcgaggactgagcctcggtgtttttttgggtggtggctggaaacagcccctctcccacgtggcagaggctcagcctggctcccttccctggagcggcagggtgtgacggccacagggtctgcccgctgcatgttctgccagggtggtggtggcgggggggtaggggtgtgggggccgtcttcctcctctttcctttcaccctagcctgaccggaagcagaaaatgaccaaatcggtatttttttttaatgaaatattattgctggaggcgtcccaggcaagcctggctgtagtagtgagtgatgtgggtggggcgtctcagcaccctccccagggggtgcatctcagccccctctttccgtccttccggtccagccccagccctgggcctgggctgcggatgcctgggccagagcccccgctgtgattggtgcttcctgggcctcctgggtggatgaagccaggcgtcgccccctcggggagccctggggtgagccgccagggcccccctgctgccagtctcccccgtcccgtccccgacatgcatctcactctgggtgtcctggtcttttattttttgtaagtgtcatttgtataactccaaacgcccatgatagtagcttcaaactggaaatagtgaaataaaataactcagtctgcagctcccccccccaaaaaaactttttgtccattttttacctattccatttgacattggtctcatatgatatcatgatataaaggaaaatgaccccgcaatgatatgattcataattccactataaatttccttgatgctttgagagtgtgattgatttattttgcccccttccttttttttttttttttaactataaagcaggtacctgtacaataatgccatttttttaaactccaaataaatagaaacagctataggactaaagtttctaatatgaatcttatagtttacttagcacatgctttaataaagttacctcttcaggaaactagaatattgtgtctggtgtaagactagatgttttgtcaaaagcatatgtaatattcatatagcggagctttggctttatgccatgaacaagcaggaggtgtttttggaactgacctgttgattttcacacgttatttattagaaatgactgctgccattcccacatagtcctaagtgtaaacatttaccatatgtatgtggcttcaagattattttgttgttcacaaaatcacctatgtcctcccatcaaaacactatcctcatcttaaaagtaaatggcactattttattcaatgatttacattttggaatcctaaccagatatttttttccttaaatttcaagcactgcattacttccaaagacatgctatgggtatgtggaaattatatcaaacatgagtaaattttgttgaccaagactgcagaaataacaataccatcacataaatatatgaatacagatgttgatggttggtgaaaattacccccaaatagccaatgccacgagtatattttgaatagctagtttgatttttattaacattatactaaggttatttctaagcctgcagacaaaatttatagaatatactactcagatacttgagaatgtactacttaaatatttggatatttttattccaaatatatctccactgtgattttttaggagatacaattgccatcacagtaagatattgctgattccaatgaaatttttaattaactagaaaaatcaaagaatgcaattctttttcaagatttcttcaaataaagaaacaagcaaaattaggctgtggtgctgtgaataacaccaagaagtatggagtcaggcaagcctcaggttcagtcacagttctactgttaagtagataattctaagggtgcgtctctgtgtcttaggtttgtggagacctacagcagcgttccacagaccaacactgagcctaccccacgactattcaacctgaccattattgggtagctttcatctaaccagttagaaagaaaacatctatgaaaactatttactaaagaattatatattttaattaagggtactgagcacggtcaagttagagaacaatagagtagaaaacttctattcaaatataattgagaccagttttttgatagttaatctaaaaagtgagttaaggaggaggatcatggggttaaaaaaaaccagaaatgtaaattatttggccaatattttgatataagtccaggaccctttgattattactctactaactggagtttctatacattgtcttctttgtataaattaggatcataagaagtcaattataattctaaatttttacttgtttaaagtagaacaaaaaaagtaattgaagtgcaaaaaccttttagcttattaaatttttgctattctgattattctaattttataattttttcttaaaaatttacattgcttagccctcctagtaatcagcttagctttttctaatcttttcaagacccagatatttttacataaatagcaccactctattataatcacatccctgattttatttatgtcacaaaagaccaacttgaatacaacctaaataaactgtctggtagataagttaacaacataacgtcaatttgaggcaacagacttacataggcataatagaaaacacactgttattttacagggagaatgtacagtgtccgttcattcaacaagttagttaaacacaactcaactaaaacaatgtcattgaaaagtagcaaattctgtttttgctccatggacttacagccaatgagtcctgagaaagaagagagaatttaaagagcttcattggcaggtgaatctgtacttggccttttagcttagagactgaagctccatattcaaagcagaagaatagtgagacatcccatatgaagaaagaaatcagaacagacatgcaggggcaaaagtagccatggtctgcgtcctggctcaggaggacagtatgtgttgaagagcaaagcctagaatgggctgatgcctgtaacctcaccccatctcattgctttatctactcacactgcttgcccagaaaatctggtgccccacagtgagaacaggaactgggcatcccagctaatcttcagctgggtgggtctcatagggttgtcagatttgaaaaaaataacaataggctttgaagaaaaagacttggagatgaagcagaatgctcttgccaaagcttccctcaattgacataagaggaacaaatttatttcccaaattagttatagtataatttaccaggtatccaaataaatttgtttagacactaagagttttcccctcgaataatgcctgaccataattttacatataattcctttattcaacaaatgctcaaagtatgtttgttttataccaaacacttttaaggaattaggaataccattgtgaataaaatagacaatctctactaaatgcttagttatgatggaaggcaaacaaatacataaaataagtaagaaatacagttttatgcctcatgatgtcagatgatagtaagtgctgtgtccccaaaacacttactcattttctcaaactattataaaacagggacggtgcataaagagtgctggacatgggactgaagattctgttttaaatatggttgccagggaagtcctcactgtgtaagaacattccatcgaggacttgaaggagatgagggaagtcatcaagaggatgggaaaaagaacactcccagtaataggaccagcaaatgcaaagaccagaggagaaagacatctgctttgtttaagggacagcaaataggtctccctgctacagcagagtaaatagagtggaaatggtagaagagtttttagttgtaaggcaagaaggggaccaaccatggagagtcttagatgtcattgtggagatttctattttactggaggtgaaatggaagccactgaagacacttgaaatggaggctgatatggttcacagctttaatagtctgctgtctgctgagataagaattgactataggacaaagggtagatttaggtagtgagatgttattgcagtcacctaggaaagagataggatgatttgaactagagtggtactggtaagaggtggtcgtattttgaaaatatctttgaagtagagttgacaggatttggtgatgaatttgacatggaatgtgagtcaaatttcatagcctgagccaaacatccctatttaattaggttgaatataatggaaaaggtggggggaaatggattaagaaaagaaagaagtttgttgtgggaaacagtaaggtgaagaaaccagcagagatgttagatatctaaatctgagttcaggagttttgaatgcatagaaaatttgatcattagcatggggctggtatttgaagccatgagactggacaaggtcattttagtttagtgtatttccacagattatatttcaagcatcgtgctaggtactttaacgtttggccattttaaaagccccttggtaaatttcacaggaatcaggatttgactgacctgtttttctcagatgtctgacctcagtcggatgcatgattttattatatttaattccctataaaattccaaaatatcaaaataagacctatatttattagcaggatttttcaggtacaatattcctactcagatagaactatatcacttaatttcacagaaatatccttccctggggtgatgatactattatatcaccaatcatgaagtcatgctgacttgcaggcaacaatggagctcacatttagatctaagctaatttgcatgacttacttaaattatgaaaagacacacttttagagagcaggcagattttgttaattctgaattatgtcaaagtatcacttaataattctcaagggcccaactctggcgaaaccggatgctgcagcgtatgtgtttcctattcccttccaacttttttcatcatgattcatcagcgaatgctatgaagtctagaaatttaattaatggatatcagggccattggaccatgcatttacacaaattgctctgtgaagaaggaacattcactctctctctctctctctctctccccaatgttttgtccccctctttctctttcaagagcagaacattttagtgacctccagttaactgtctgaactaagcagccatctcttaggtaataatgcattgctaacaaacctcagcatagacagtaacgctaccactaaagcttctgttcatgttgttctagggctaataaaatggtacattgtattctagctctgaggaaatttgagattgtctcatattttctcagttaaaccagataataattaattatggggaagggagaggaattgctgtggcagagccagcgtgagacataatttctatttattctcaatgtattatctgttttctccctagaggcttccttttgttactcttatatcaaaatcccacttaattttcctgccatctcaactcaaaaatcatacctacaaaagagctaaagtgttcatctttttgcttttgcacaaactctgtgccagctatgagagtgtaagctttatagttatatatagatgtttttatttataatctttctcctgcaagaaaggattaaagtgaagcaaaaagaacatgtaataagatgaataatgaatagaaaaataatttgctcttaagacaaagtaaaggaaactataaaagggagatgactagaactatttagcaagaagagacctcgttctttccatcaaatagtgtggtgtaatttgcacaatgcacccaatggttaatgaatacatatttgttgaggatagcattaataaatagatgaccaaagaaaaactaatacaaaagatttttacccttcaggaagtaactattaggtaggtattgtaaattctaactttaaaagatagaggaaaagatatattgagctgacccataaatacaacaggaagacacagagtaacaattactgcaggtgaatttcagctctcagtctatctaccaaccagtgtcaccaggaaccttcttcagactcatgtatccaactgcttatttatcttttgcacctggatatccctcagctacctccatttaattcatcttcttcctccaaactggtcagcatccaagcagatccagagaactgtgaggagctattctagtctctgccctctcccccgttgctgatccagttaagagggccaaagaatatagttgagaggacaccagctctgtatctagtagcatttagttttaatctcatcccttaacttgaaattggcatggccttcagtaagtgatttaactcctctggatatcaattgataaaatgtgaaaaaatttccaaaattaattgcagtgagtattaaaatagcatgttttgtacatcatgatctctcaataaacaattgcagtattattcaaattggcacacaggcctatcactgctccttccttttagattttttttccttctgtttttgcctctgaatgccccaagccaatctcccttcctctatcacctttttaggaaatccatccccaccccactcaccccaccactcctcacactcctttctctcctaccctggcctccaccatagctcctccattcccacctgtaatccagcctctgcaccactatcagcgctgcgcttctgaaatgcaaatctcatcatgttgcaccttataacatctttgaatgactcctacttgtctcatgatgaattctaagctccttagttttaggttgaccatgaccttttttgatctgaccctgtccatctctccctcctaattctcatttctctccaccaaatactccacccttcgtactgaacaatgtggctctactgtcatctcttcatacttatattttttccttgatccttaactttgttcacaatgttcctgccatctggaatagcattttccctgttggcctggaaaatttgactattcctttgcgatggaattcagtcttcacttccccatgagtgaccttcttaggacaaattgacagtatcttatattgtagtcccacagtccattaggcagtcttcaagtgtccaataggagagtgcatgatattagttgtttatatgcctatttctcccactggctttgagaaacttcagggattgttgtaaccatttgtatccccagtgtctagcatagcgtgcatctatttgtgttttgaatgagtgagtgaattaacgagtgatgagaaagccatgacctatgtttgtctctaccaatcttaaatgagattataaacagactgattcaactgaagattgcaggtcctattccttttgcagttgttattgtacatgttagcaaaaagcttcagcctttccaaaaatttcttcagtggtagcaataaattcattgtcttctgggagcaacactgtgctccctctctctctgtctctctctccctgatttgcctattgctactttgaagagtatgtgtttatgactttataatttgctacagcgcatgtaataggagcccttctatttcttcagaagtggttataagaaatattcacacttgcttatgttttgtgaacatctatatctggtggagcacatgttattataatcttattttaagcggaaatatagattaaaggattttctcttactgttcttaatgtaatgcttctaaattagatacacgaaagtgctcatctaggagataatggaagcataagcaaaacacagaaaaagccttaccaagaatgaattataaccaacaaacaaatgttagttttattgcaatagaattactgaattagtacatgatggaacaaaaaatctataacaagtttagatgtcagtaatgtattcgacatggattgtatacactgtacccacaaaattctatcaaattgtttctatttcaagaaattttcagtttattcatgttcaacacaaaagttaattatacatgaaatataaactcaatgcagaacattggcattgtatttcctggctttctgggaagaatgtgggagcagggttaataatgaaatggaagagaaagctcttcactcctctccttgttcccaggataggacaaaatacacatggccaagaatgaggaaagtaggacaaaacccaatatagtcaagaaagttatgaacctgaggtatgaggtaagatctggccctgggaatgttgactgacactgcaatatttagtatctagactggaatgattagatatgaagtgggttaacctggagtccttagagatggcgctattcccagaaagataaatgagatccagtcctaggacaaaaggacaaacatcattggtcggaaaaagaaaaaatgatttagaaaaaaagagaaagagaaacaaaatgtagaggagaagaagaaatcccaaggatggagaccaaagggtttgccaacagtctgttccttgggaatgcgagttacaccgcagcctggaagatgatgctacttccaagcccatgattctgtctccatgacttaggacactagtcacaaagaaatagaacacatctttctccttctagatctcattgtccattgaagaactgctactcatggcctgcaagagtgaaactcattggttctaggaatgaatgaaattggacctgctggaggcctttaattattatgtgggcctcagaactgatgaggattgatgtgggtgttatttcaataaagagttataaacaattcatatatgaaaaatttattttcttaatttatagttaaatacactaatattgtatttcaatgttgttattcaaattcaagaccatgtcagttcttagacacaatctctcactgtgtattaatttcaaaaagacattgtagtaaccacagatatattttatatatagatataaattaatagacattactttttgagctgttttatgtttagaggcaaaaattagtgaaagttaaagtgcctgtctgtagactctctcactccacccccatttctcctatttttaacatcttgtggtatttttaacattagtgtgttacatttgttacaagtgatgagaaaacgttgataaattatttttatctaaagttcataattatattagggttcactctttgtggtgtccattttatggattttaacagagatgtacccaccatgacaatgttacacaggattatagtttcactgccctaaaaatcccctgtgctctacctagttattcctcctttctttcctccccaggaacccctggaaatgactgatctttttactgtctccacagttttgcctttttcaaaatgtcatatacttgcaaccacatagtgtgtaggctttcatattggcttctttcactcagtaatatgcatttaaagttcttccatgactttttgtggcttgatagctctttttttatatagaactggttaatattccattgtatggctacaccgtacagtgttagtccatttgcctattgaaaggtcctttggttgtttctgttttggtaattatgaataacactggtataaacatttgtgtgcacgttttgtgtgggcataagttttcaactcatttggcaaataccaatgagcacaattatggaatcataggctaagagtgtgcttagtgtcataagaaactgctaagctgtcttccaaagtggatgtaccattttgcatcccaactagcaatgaataagttatttctgctcattgttcttaccagcactcagttgtgttgctattttggattctggccattataagagctatgtagtagcatctcattgttttggtttgcaattttctaatgacatatgatattgagtatcttttcatgtgcttatttatcattagtaatatgttgccatcagtaacgttcctttccctttccattgccagtgagatccagcatttttttttttttttttgagacatagtcttgctctgtcgcccatgctggagggcagtggtgcaatctcactgcaacctccacctcccaggttcaagggattctccctgcctcagcctcctgagtagctaggattacaggcacctgccaccacacctggctaatttttttttttttttttactagagagggggtttcaccatgttggtagggctggtcttgaactcctgacctcagatgatctgccctcctcagcctaccaaagtgctggattacaggcatgagccaccgcacaaggccagatccagtatttcttaatggaaatgaaaaattcaccagttactgcatttttccccatatatttgtaataagttccgacgtctgataaggcaagtccaaccctccgcattttaaaaaattaatcaagttatttattaaaaattaatagtctacgcacattttaaaatcaatgaccatattagatttactggaaaaataatgtaatttaatattaatttatcacatccattaacatgataattctccacttatttggatttcctttaagatcaattcctaaaattttctatatagatggttttaggatttttttttgtagcttaactacaagatactttgtagtgtctcaatttttattacacttttacaccttcaattcaattattgctgatatggaaaaacttttttttcaacatctattttagatttagtgggtacatatgcagatttgttatatgggatactacttgatgctcaggtttggagtacaaatgtatccattaatcagatggtgagcatagtatgcaatagttactttttcaacccttgtccttcttccatcccccatctaatagtctgtgactttgtactgttttctattatgaattggggaaaagccattattatattagcttcagaacaactaggttcaagtcatggaaaacaatttcgcacaaacaactttaggaaacactgctttgaaaactgtaatctgaattatagctgaggccacagaaaccaaatatttactgaaggttcttttaagaaaaacaagttagccaggaatggtggctcacgcctgtaatctcagcactttgggaggccgaggtgggtggatcatgaggtcaggagattgagaccatcctggccaacatggtgaaaccctgtctctactaaaataagaaaaaattagccgggcatggtggcacatgcctgtagtctcagctactcaggaggctgatgcaggggaattgcttgaaccagggaggtggaggttgcagtgagctgagattgtgccactgcactccagcctggtgacagagcaagactctgtctcaaaaaaaaaaaaaagaagatgaagaagaaaagaaacaagttgtattgaaagaggacatcattaacagtatatctcttcaataatggtttattttactatattctcattcctctcttactgtgtcccaaatctctttacaggctaaaagaaactgttcagaattaatcctattcataaagaacagcacttactgagtattgcattttcctcttcaaattcttcagcatacattgggactacaccatatggaccatttttacatttttacttttgggtttttgttttttttttcctagagaaactgcaactagatttaggtcctcattctattaggtcagtatttgtctagtaaacttcagcttaagcaaaataaaatatgtgttgctttgaactgaaactcctcaaaaccgtattttaaaaattacagaaaaaattaaatgaaattattattttaaaaatcttgtagatgaaaagatatgatatatagtaagtttaagtacctatttcaatggttcccacagtggggccctcagacacccaggtccaaactattttaacaggaatactaacatggcgacatttggtgtaagggtgctaatacaataccgggtaaaaatgcgggcagtttagcacaaataaaggcagtaacaccaaactactagtaatcatagtattcttcactatgcacaggaaaggtttgaaaaagaagggcaggttgggcagtgtctcacgcctgtaatcccagcactttgggaggctgaggtgggaggatcaccagaggtcaggaatttgagaccagcctggccaacatggttaaaccccatctctacaaaaaatacaaaatttagctggacatggtggttgcatgcctgtagtccctgctacttggaaggctgagacaggaggattgagcccagaaggttgaggctacagtgagctgtgatcatcctactgcactctggcctgggtgacagaacaaggtcctgtctcaaaaataaaaagaatgtctatgatgaagcagtgaaaattttactacatcttaatccttgaatatgtctttttaatatttcaagtgatgaaattggaagcacacatgagcattcctacagactgcctgaggaaaaaccctcatgtgactaagtcttgaagtgaattaaccactttaatggagtatcatttttacttgaaaggagtactgacaaacaatgttatttcaactggggtttttgggagacattttctcaaaaaatgaggttctgtcatttcaagaaaaacaacagacaggccataataaaattcaataataaaactgctaataataaaattaaagcttctgaataaaaaattagaattttagaaaatatatccaccattgctttccaaaagtattctgctgagattgatggtgatattgatgaatgtattttgatactgtataatcaaatgtatcaacatgtagaagatctcggtgaaccattattttctaaatgaccaatgcatgatgttataatatcatgcaagggtaaaagatccaaagttcaagaaaaaccaagttttgatggagtatcaaaaaagaagcctaggcaacatggcaaaatcctgtccctacgaaaaaaaaaaatacaaaaaattagccaggtgtggtgatacacacctgtagtcccaactactctggaggctgaggtgggaggatcacctaagtccccagagactgaggctgcagtgagctgtgatcacaccactgcattccagtctgggcgacagagcaagaccccatctcaaaaaacaaaatttatatatatatataaatatataaatatatatatatccacaatgatctaaaatggctatctgtatgagattggacattgttcacatttcttcaaggaaatatcacacaataaattgaatgcagatgaaaatgacataccagacatcaaggaaatttgcaaaaaatataagattgtgctactttgggtttagaaattttttcataaaaacatttataacaatacgtggtgagcttttaaagaatagtttaaatatttctgatttaatttctaatgataaataccagtagatataacctacataaaccaaagctccttgggccctcaatatatttttaagaatgtaaaggagtcctgattccaaaactttgagaactgctgccttcccctccactttcctgccttccctagaatttcttccttggaaggaacatccctttgccattttaacttacagagttccattcaggccagttttgctacctccctcccatctttccacctccctgtcttgacacaaaatctgaccaaaggactctaccagcccaccccatttccagtgcttagctgtcaaggtgggctaagccaagaaaatctgggttttctctgagactagacctctttttctgggagatctggaatcacagggacaaggttggccaccttgggatagtcagaattcatcttgcctcaaaggggagaggttaggcaagtttctacaaagccaaactgcttcctagaaagtcaaagataattatactttgtgccacaactgtgagaatgcccattttattgcacactttctaacatttttaccaaactgataaataaaagctggtacctagaagaaaaaaaggccaggcatggtggctcatgcctgtaatcccagcactttgggaggccgaggcgggtggatcacctgacgtcaggagtttgagaccagcctggccaacatggtgaaaccccgtctctactaaaaatacaaaaattagccaggcgtggtggcaggcacgtgtaatcccagctacttgggaggctgaggcaggagaattgcttgaacccaggagggagaggttgcagtgagccaagatcatgccattgcactccagcctgagtgacaagagcaagacttcatctcaaaaacaaaaaaaggttccatacaatataatttgttccatctctagaaaccaattcagcaatgagaactgaaagccaccacttggaaggtttcaaggatttagctctacctaatgacgtctaaagcattagttaaggtagaaaaaaatacacacacacacacacccctatgtatttagtaccaggaaacatgatggactagatggtatagtcatccaacagaaaacacacaataactgaagccactgtagaggagtaagttatgatgtggatctacaatattgttgagtgaaaaagcagattacaaaaaaatctgatttttcaagggagagggaacacatacaagcacaggagaaaagagatgagcagatgactggaaaaatacaaaattctgatagtggtaccttctgagtgggagaattatcggtaacattttctagttttgcctaaacattttctaaatttcttaaaataaggctttgttatccatattataaaatatccacctcctcaggaaacttaaccttcagcacaaatgctacaacatgttcaaagtttgttcagtttaagagacaatctattttgaaagacatctaaaatgacgaccaatatttaaacctatgcattaatatttttcaatcatatgctttaaattttgtaattttgttaaggttaagctttatatccatctggaaaaaagttttctatttgtctttaaaatatgacctacaatataccagtttttaaacaatgaatggtgctcaaaaattgcaatataaattcaggcagtgttccttacatagaatgtttaaaggcttctaacactgctcttcttcaccggttatgaaaacacattaccattatctaagcatctaattattcaggtcctttgtttctcctctattctattaattttatagtaattttaaggcctgtgaggatgaagttgtctgtgacagctaccacaaaggttactataagtggacaaatttcaaacaagtttatcaccactaccatccccaccataaaactgtcttaatcaagggcaacacatttcaaggttaaccaagacaacctctttacctgtcactgcttaagaaaaggactttttggtcttatttagaaataactttctctatctatttttctccataaatccactgagatcaatgtatggctctatctcaagcaccagcaagcaaaactacctgccagaatgtgcagtttttgtatctttccaagtgtaggacacagctatcttttgacatcacaatttttaaaaaattgatgcacaaacttcttcttgaacgttcagccaggcatggtggctcatgcctgtaatcccagcattttaggaggctgaggcaggtggatcacgaggtcaggagttcgagatcagcctagccaagatggtgaaacctgtttctactaaaactgcaaaaattagccgggtggtgtggcaggtgtctataatcccagctactcaggaggctgaggcaggagaatcacttgaaccggagtggcggaggttgcagtgtgacgagatcacaccactgcactccagcctgggtgacagagtgagactccaactcaaaaaaaaaaaaaaaaaaaaaaaaaaggaaaagaaaataaagttcagacatacagcagttgtaattctaagttcagacatacagcagttgtaattctaagttcagacatacagcagttgtaattcctctgaaggctggttatgggacacatcactttcatactttgctgttcaataaatgtgggctggagaataaagtaaactgacagaattaccatataaaataaaattctaagtgctctgacaacaagagaaccttaaaatacacacacacacagacacacacacagttttccctgctaatcattttacaactaaacaaccaagtagctaacgcagagcccacaaaagcggagtaaaaattctaacacttcgtaaaataaaaatgcacatatacccctgtgatctaaaaaaaatgcttaagtattcaaagacagcaattacagctactgagaacatcgttgtgagcaaacagaggcagagaaaacaaaggtgctgatgaggatttgaagcacctaacctgcagaaacccactgggtgatttcctaggttccagggtggcattatctttcagaacgatcttcaagaagaggtcacatgacactgttacaaaggatctggagaaagagacccttgctttatctctccggctctccagtcatgcttcacattttcgcttcttacactctttcacatgaagtccatttacacacctccatcaagcccttagagacctttttgcactatccatgacaagttctggatgtcatctctgcacttttgacaaattcttagcagttaacttacagggcagttaagatttttgttcaagcacaatatagctagaatagggtcatatactcaataaaacaaatatttaccaagcacttattgagtggaagataaaaagcacaaagcataattacaaaatattctcccctgccaccataaaagaatttcttaaaggcttacagaatatagcataacgtgaccaaaacaaaaatagtaaggactgaagaggggaggaagggaaaatatcagcatgaactcaatatgacccagaagagccttgatggtcagacgtgtaaagacgagttgggtagggttaaagggtggaggtcaggggcacaggtcaggggcacattctacaagggaaaaacagctgatacagaagcctgaaaggaaaagcgggcagagcacctgtacaggactcttacctgcggcatctaccatacaatgcgcctttccagaacacagcagtgcgcagccagcccctggggagagggatcactcaaacagcaccagaggctgcattccaacttttcttccatcaacgactccgttttcattgttagtttctccttcaacacaaacttgaaaccaattggctgaacacgcgggagcaaggaaaacctgactgaagaatgaggcgttaaaacttaagggccttgggtcctggcgcggtggctcacacctggaatcccagcactttgggaggcagaggtgggtcatttgaggtcaggagtttgagaccagcctggccaacacggtgaaaccccgtctctactaaaaacacaagttagccaggcgtggtggcgggcgcctgtaatcacagctactcgggaggctgaggcagcagaatcgctttaaccagtggactgtcaagagagataggctgcaatgagccgagatcgcgccactgcactccagcctgggtgacagagtgagactccctcaaaagaaaaaagaatttttttttttttgagagaagtctccctcttatcccccaagtttgagtgcaacggctggatctcagctcactgcaacctccgcctcccgggttcaaacgattctcctgcctctgcctcccaagtagccgcgattaaatctcctgccaacacgcctggataagttttgtatattttagtagagacggagtttcaccatgttggccaggctggtctctaactcctgacctcaggtgatcgcccgcctctgcctcccaaagggattacaggcgtgagccactgcgcccagccaaaataccgaaaatcttaaaggtctttccccttccccgcctgggctcaaaaaacgccggagccgccctgcaccgccctgtcgcggtctccggagcaggctggccgactgagggcgaccatgggtcccaagaaggctccggcagtcgcgggctcccacctcggggcgcggcgacgggggcctagaggggccaacagcccccaagcttacgccacgcgaggagtcggagagacgcgccctcccctctcctcccacccaagcctccggcagtcccgggccggggctgggccagttgcgggagaaaggggcggggaactggggcctctctggggaaggctcccctttgtcctgggactccgggcgccccctctctgccctcgccctgccccgcgaggccgccgccgggcgcctcacagtcatgttgcagtggagcgtgagcgggggctgcggctcctg

SEQ ID NO: 346 - DNA, 3474 bp, Homo sapiens
ctgttctcctgtccgtatagttcatttcgcttaaagcaatgagagaaaccaactgaaattgccccactcgttgcatgcttccctcattaactccactcagtctcggagtctctttattaccagctcagctctggctctctctggtcattttcctgtccttgggcaattctgaatgtgtctcttcatcacggacaccatgtgcatcccatttgaagtgaatttactcctttgtttcctggcttctgcacgcacttgttggggcaggtcgcgagccacacttcacccccatgtgactctctaactaggttgtgagaaatgtaaggaagtctacagcatcagaaacctcacaattatggttgctttcaagtgtgactgttggatcctaccgtttgggtgtgtgatgcaatggaaaaccctgctggagcagagctgctcctctctgggtcctgagcagtgatctgtgcacgggggaagtggactcaaatctgctaccaaaagaactgctctgtgcccaggacatgaaggaaagccagtaagcagtcttagagcagcacgactgaggaggcatggaggagataaagagcactgaagctggggtcagagacaggagtgcccactcagctctgccatgaaccagctaagggatgccagctgagtcactgtcatcctcttggtgcccagtcatctctccagcagttcctgaacctcagtatacataagtatcacccaaagagcttggttcaacttttgattcttgaacgctacccccaccccacaaagattcagtttcagaagctctacggagggaccaggagactgagagacagatggtcatgtgggtcacactttgggaaacatgctcagaggtcattgagccctgaagtctcgattcttaagcaatttcaccatcttgttccaggatttctgtcgcatatttatttactccagctaaattttgtggcacatacagttaacagggaagaagctcactgatgcacgaaaggtatgcatatcattactgatgcagcccaatctctctgtgtggttaccttcacatcaggacgaaacagcaaggcaaaatcacatttagaagactaggttctagtccctaagataaatcaaacttggcacacctagaggctttaaggtaacctgtcagtcagtattggtagctcttcgccagccattttaggactcactcagacttgctcataaaacaagtaagagtttctgtttagggtatatattttcctgctcttttacttgacttgcagcagcatttttcagagcggagtaaagtctccagaccatcagcatcagaggagcttgcaggtggtcaggactgagagggtgggtgggagcgggtcaccggaaggcaggttgctttcaagggtgactggtggatcccagtgtttgggtgtgtgatgcaatgtaaaaccctgctggaacggaggtgcttctctgtgggtcctgggcagtgatgtatactggagtcactctggaagcttgttaaaaacgcagttcctgggtcctatcgcagatcaactaactcagaatctctgagagtgggtccctagatacgcatgcttaacaaaaccatcacccagactggaggtgacttctctgtatgcatgcgtgtacacgcacgcacacacacacataaatttgacaagctctgatttagagtatctaacaatgcttctcattttcaaagccagtgtcctgagtttttaaaatgctgaggttcacagaattctttccatctcctcagtttgtgacattttatggcttgtgctttgccacccctcatctcaggggagtttgataaggaagtaagaaaaaggacaggaaaagtgaaacaggcagaaataggtgggcaggaggacctgagaaaagctcgtctctgagcctgggaattaagagggcagccctccccacagctctctgtggggagacctcgtgggctaggtcagccctcctgggagtttccagatgtttctggaagtgccacttcacgtctctgctcctcttagggatagacagggaggtgtcagggaccaaagctgcatggagtttgcaggccatgagataaataattctgtgtagacggaggattaagtggagtttctgaggctgtatcaaatgaggtggaagagttggggaccaagacagagcagcttcttttatttgaagcattttctgtcactcagggtcatttaagaaagagaaaacatgttttgggggtaagtagagacaaacaaacaaacaaacatgcaatctagacaagatgcagtgggtctcatcaaagaacagcatttcctaattattttttaactgcactgagaaggtccaatcaccatagggcctggaagacaagtagagagaaatggttcttcggtctcttgagcactgttatatgaggttcagatagagccaaactgtctcctggaccacctttctgggcaaggagaacatttctgatgggaatagactagactcagctaatgtaacaagtgtgcccacaatgagggaccatggattagcctgggattagggtccatcaaccagcgatcatttattgaaagtatattttatgctcatgattcaccctgttaatgatctgtaacaaaacaatcaatgcaagcagcattcccagagccagtgactgaccccagcatttcagagactgggagagcacagacatagaggaaggaaatgaaataagaagcggaatgcatcttgaaaagtggaagcagaaggtgaaggtcaaaagcaaatgaagacatacctggagtgcatgaagactctgtaaaagctgaaggaatactaagaactgaacaaatatgacccagattggttataggttctggctgtcagaacagaagttggtgacaccagctggaatttggggaaacttccgccaaagttacaggttaagaaaaagaggaatcatctatataacactaatctgcttgatgaataatgatgattgcagctaacattttctgaaggcttgccagatattctgttggatgtttgcatacttaatccttacacttaatcctcacaagaaccctgaggtaggtagtataattattcccatcttggagatgaggtaactgaggcttagattaagtaatttgtccaaggttgcacaggtagtaatagtggcaggattcaaatccgagcagtgtgattctagaaactgctctaatctccaagctatacctactttatagttttgcttgggagcttgaaattaccagtgaaactatctgaagtatgtaaatcctctgctctagtcttgttggttcactgcatttctcccacaaacacacactaccgttatttttcccgcaatacctttactcactctcccccactgctaccctgttttgcccgacaaacttgaaaatatattcccccttctctatccaagcattcctcttcttgaaaggctgacacaaatccctg

SEQ ID NO: 347 - DNA, 13424 bp, Homo sapiens
ccttccctggttaataaactttttccattctatcatcatattcattccttaagttccagtaacttctccattgatttgttcccttcctctccatcccccctagcattatgccatccatagttttatggcaaacaaactctgtaatcagtctcttttcatccgctttgctccagaccagtatactccaaccactgcttccattacactccaactcaaagcccacgagtgtctctgttttctattacattactagggaacagctctggctgacctaagaccctctgtagtctgactagttgccagcatgcagtgcctgctcttgccagcccatctcttcactgtcacataaatatgccgagcttggcctctcctctctgcctttgtaggttattcatcagaaatgttttcgcatgtctatctgactccagattcctgctatctatacgtgcaacaatggcacctttctaaaagactttcaaatgattacttcatgtccaggcctttctcatttttttcctgatggctcaatggacagaacatgaggtggattgtcagggagtcccgcatcttatatttcagttccatctggtgctgcaggggctgcattctcccatgctccttctgttcctctaaaaaataagctactggcaaacagagcagtgaaccccagtccacagcaatgcttcttgtcccccaagcgagatctgctctggggctaattcattaggtttagcttttgtctcacttgatcggaacttgggtggagattccaagggctggaaggaaaggtggggagctgtgcggttctaaagggtgggaaccactcctcaaaagcgcaactctgagaacacactgagagaaaacaagctcaatcttggtagtagtacggtcaccatttacagatttctttttacagctgcaaaaatattccatcaggttatcagcctctgacttcatttcactttggtaagtaagtaaaaataaagctactgtgaaatgccatcagcaatgtgagctcacggcgggtagtccacgtttgtgaaaacagaccctatagactgctctgcattttagttttcatggaggctattctaaaggaaacttgttatttcatatatttcatatatggttatacttacatgccagctaaactacacatgcacacagattttaaatagcatcagaaaataaggtttttgtttaccttaataccatttaccagttgccttaatgaattctgtaaaaatacccttgcaggcttctgctcagttacccaagagggcaacacagctgaaaaacccagcagctgaggaaggacccaaagagactcagtatgacccaaagacttacagacacagccaaacaatcccaaggagtacacaatataaatgctttattgctagcacagaggtttctttttaagtaaattaaaagaaataaatcttcattttcacattttttgttgcagtccaaaggtaactagttggttagtggctatgtccacttggacacatgctacaggagggcagcattcacatggaagcactcagaaatacggcatctgtcagggctcacggcactgggctgctgaatgcactgtcgtttgtaaataacagcaagtggagactttaaaacatcatggatagataagagttataaatagaaaactggtacggttaagaagcagaagatcgttaaatacagaaggctatatatatgttgcccatattccacatactctgggttatgtttggtacttttaaataaatgatctgcatttaggttagagactggattggatttgacagctggaaagatggaagaagggatggaagaaggaaaggaagctaacacttcccacatcaaactggtggagtcactggaaagcagaagaggagtatgtggatgggaagaaagggaggcgggcctgctttactccctgcaagctgtaggccatggcctgcccagtgaggggcaagaatggggtgtgacagaggagctcagtggagcacggcagtcctggcacaatggaacttggcaaatggaaaaggaaacccctaggcttggccagattttccaaggtcactgccaatagatacagggcacattatgatagatgtacagtgtgacagaccaaaatcacacctgcagcagttattggtgtagaggttcagaaggtacagattccaactacagaaataattcatttaataataattgttgcccaatattagaaactgaatgatgtctgcaaggcatccagcattatcaaattcttgggcctactcggattgttttttggttggttctaagaaaaactttggaaaagatcttatctagctatgaaaaacaacccactccttgccttattccagaataactgagaaggaatctaatacacacacaccccaaaactgcagcaagctcagaagcggtgaactgcacatgatgacttccagtctctattgtcccaatcttttttcattcatgttatttatgggtaaaagaaaaccagattgggtcaggaatatcccaggttcttactacatctgtagtgtaccagctcctggcattttcattctggtctgactctagctaaaaccatttcatgttttgctttgaagaaatggataacatgaaatgataatttggctttacaaccttgaaaaattgttcccggcccaaacatctgccccagaatgagctcagctgacatctccttggaagagagggaggggtgggtgagcgaggagggcctggaaggaggaaaatgaagacaggagaaaggtcacctttccttgagaggaaagttctttgtgacaaagacatgaaataatacagctcccttatttcatcctgtgctccagaaggagatactggatgtgtctgctagctcctcctcctccctttatcccactttccccaatatttggtatgattaaggtggccccttacagagtgccaagaaactgtacccagctggtttgctttagttgtgcagtgacctgcctggcctacatgttatcttttcaatctttaagtaaggaccgtggctcaactttgtattcctgagagctgggccctacagagaaagcagagagggacagacgtgcaggctgggcttcatcctccttcttggccttcttaggagttcttctgggggatctttactgtcaccgtcttaacttctgagtactcccgcaagccaaattctcccctgaaacacagaaatgggccgggtcagataccagaagtccagggagctgcatgtgagtgcagcgggagtcctggggaggtgcagtttatcacctgcgaacagcaagtcctgggatgttcatgtaaaaattcctcacgtatgcgcagcccagccttcctctgagggtcagagaaactgtcatctcatgagtagtttttaaagaagtttttttaaaactttaaagttttttaaagtagttttaaagttaaaaggtgacttgttttcacaatactgcacagacaggcaatgactctcaattactcagagaactaccatcagccttggccagagggcacacagatgaccccaggctgtgctcagaggctgagtgctgtgggcagcggtgggaccaggcccaggtctctgaacgccttggccatgcctctctccacaaggcagcactggttcagtattagttctttgggacagtagtgtgctttcctcccccaagacggagggtgggagtgggttgcatgtctaagtgttcctgtccttctgcgtgtttactacagtgctccttctcctccacatctcttctctattctcctgttctttttgccttgtttaaatgccttttttccccttatctaatctatttcattataaaatcacgcatgttctcctctttttcttctcttcttctgaaagtcactcttcagtgatgcttttcccaacagcctcaggaggagctcctctttcgtcctctctgttcacagagccccttgttcacacctcaaccaccacacttatcacactgggaggacaaggggcttgaatatctctgtcttccctactgagttgtatcctactgatttttctttttgccttccaccaaacatagggtatagcctacaacagcaggcacaaagaaggtacctgatgaccaaggaaggaaggaaagtagagaggggaggagggaaggaggaagggcgagcttcctattccctcttcccaagttctaccctgttgtcatatcttctagatcaggaaaaaataaaaacaattaggagatatatttgaatatgaaacaattaaatgattaagaaaggctgtcttttgaaacagtcagtgtacgagttactgtggctgggctttacaagagagacctgctgtaaatgattcattcaggttccttttaggagcccccatggcctacataaggctccaggggctttgccagcacctcctctgagcaccgtgggcacctgagttgacagggacaacagagggcggccaaggagagactggggcaagcaggctgttctcctgtccgtatagttcatttcgcttaaagcaatgagagaaaccaactgaaattgccccactcgttgcatgcttccctcattaactccactcagtctcggagtctctttattaccagctcagctctggctctctctggtcattttcctgtccttgggcaattctgaatgtgtctcttcatcacggacaccatgtgcatcccatttgaagtgaatttactcctttgtttcctggcttctgcacgcacttgttggggcaggtcgcgagccacacttcacccccatgtgactctctaactaggttgtgagaaatgtaaggaagtctacagcatcagaaacctcacaattatggttgctttcaagtgtgactgttggatcctaccgtttgggtgtgtgatgcaatggaaaaccctgctggagcagagctgctcctctctgggtcctgagcagtgatctgtgcacgggggaagtggactcaaatctgctaccaaaagaactgctctgtgcccaggacatgaaggaaagccagtaagcagtcttagagcagcacgactgaggaggcatggaggagataaagagcactgaagctggggtcagagacaggagtgcccactcagctctgccatgaaccagctaagggatgccagctgagtcactgtcatcctcttggtgcccagtcatctctccagcagttcctgaacctcagtatacataagtatcacccaaagagcttggttcaacttttgattcttgaacgctacccccaccccacaaagattcagtttcagaagctctacggagggaccaggagactgagagacagatggtcatgtgggtcacactttgggaaacatgctcagaggtcattgagccctgaagtctcgattcttaagcaatttcaccatcttgttccaggatttctgtcgcatatttatttactccagctaaattttgtggcacatacagttaacagggaagaagctcactgatgcacgaaaggtatgcatatcattactgatgcagcccaatctctctgtgtggttaccttcacatcaggacgaaacagcaaggcaaaatcacatttagaagactaggttctagtccctaagataaatcaaacttggcacacctagaggctttaaggtaacctgtcagtcagtattggtagctcttcgccagccattttaggactcactcagacttgctcataaaacaagtaagagtttctgtttagggtatatattttcctgctcttttacttgacttgcagcagcatttttcagagcggagtaaagtctccagaccatcagcatcagaggagcttgcaggtggtcaggactgagagggtgggtgggagcgggtcaccggaaggcaggttgctttcaagggtgactggtggatcccagtgtttgggtgtgtgatgcaatgtaaaaccctgctggaacggaggtgcttctctgtgggtcctgggcagtgatgtatactggagtcactctggaagcttgttaaaaacgcagttcctgggtcctatcgcagatcaactaactcagaatctctgagagtgggtccctagatacgcatgcttaacaaaaccatcacccagactggaggtgacttctctgtatgcatgcgtgtacacgcacgcacacacacacataaatttgacaagctctgatttagagtatctaacaatgcttctcattttcaaagccagtgtcctgagtttttaaaatgctgaggttcacagaattctttccatctcctcagtttgtgacattttatggcttgtgctttgccacccctcatctcaggggagtttgataaggaagtaagaaaaaggacaggaaaagtgaaacaggcagaaataggtgggcaggaggacctgagaaaagctcgtctctgagcctgggaattaagagggcagccctccccacagctctctgtggggagacctcgtgggctaggtcagccctcctgggagtttccagatgtttctggaagtgccacttcacgtctctgctcctcttagggatagacagggaggtgtcagggaccaaagctgcatggagtttgcaggccatgagataaataattctgtgtagacggaggattaagtggagtttctgaggctgtatcaaatgaggtggaagagttggggaccaagacagagcagcttcttttatttgaagcattttctgtcactcagggtcatttaagaaagagaaaacatgttttgggggtaagtagagacaaacaaacaaacaaacatgcaatctagacaagatgcagtgggtctcatcaaagaacagcatttcctaattattttttaactgcactgagaaggtccaatcaccatagggcctggaagacaagtagagagaaatggttcttcggtctcttgagcactgttatatgaggttcagatagagccaaactgtctcctggaccacctttctgggcaaggagaacatttctgatgggaatagactagactcagctaatgtaacaagtgtgcccacaatgagggaccatggattagcctgggattagggtccatcaaccagcgatcatttattgaaagtatattttatgctcatgattcaccctgttaatgatctgtaacaaaacaatcaatgcaagcagcattcccagagccagtgactgaccccagcatttcagagactgggagagcacagacatagaggaaggaaatgaaataagaagcggaatgcatcttgaaaagtggaagcagaaggtgaaggtcaaaagcaaatgaagacatacctggagtgcatgaagactctgtaaaagctgaaggaatactaagaactgaacaaatatgacccagattggttataggttctggctgtcagaacagaagttggtgacaccagctggaatttggggaaacttccgccaaagttacaggttaagaaaaagaggaatcatctatataacactaatctgcttgatgaataatgatgattgcagctaacattttctgaaggcttgccagatattctgttggatgtttgcatacttaatccttacacttaatcctcacaagaaccctgaggtaggtagtataattattcccatcttggagatgaggtaactgaggcttagattaagtaatttgtccaaggttgcacaggtagtaatagtggcaggattcaaatccgagcagtgtgattctagaaactgctctaatctccaagctatacctactttatagttttgcttgggagcttgaaattaccagtgaaactatctgaagtatgtaaatcctctgctctagtcttgttggttcactgcatttctcccacaaacacacactaccgttatttttcccgcaatacctttactcactctcccccactgctaccctgttttgcccgacaaacttgaaaatatattcccccttctctatccaagcattcctcttcttgaaaggctgacacaaatccctgtagcagatcatatctaaaggtttcccagatttttccagttcacagtgatcttccctatccctgagctcctccattggtttacagtcttttctgcgattcctctgattctttcaatgttattagttttatttaccccaaaacatattaaatgccttaaggacctgcatcttcctccatagaccaagcacagtgctttgtacatatttatgctcaatatttgttagattgtgaactaggcatttgctcaaaaaaataggcattcagtaatggctgagggaacgggcatgaaacatgtttcctctgtgagtcacagcatttggcaaatacagatcagtttctttcaaaaggagggaaagtgggttcttttcctggatgttacttccaggaaaaacggttacttcctttgtgaagtcttctaggacccgagcagtcaaaattaattgatttttctctgtactgacaaaatgtttaacatacttctaatcatagcctttactacagggaattaatggtacattaattttttccattctcactttgggaaatggaattgtgttttattcatctctataacatgtaatagaacttagcttatagtagcatgtgctccacgaaatgtttgttgaatgtatggatgagtgtaagataattaaactattttttaagtactgctctgtgctgatatttgcaatctatttctctgcaggcatcagcaactttaagacttacatttctctcccatttccagacatcttgaatcccccaaaggggctctgggcatttaaggcattgtaacaattgatcctgaaagaagaaaacatagcactgtgagttcgtgtgaagtctgagcacataatctgactggcatggtatttcttttagaagttttatttttaaattcctttcctccagaggaaaaaattgtaatttaaaatctactttgatttctggatctaagcagtaaggagtgtaccccttttctggtgaactttggttgcttttggtattccccatccttccaaggagatacttgtttatttcaccctggtccctataccaccagtggaatttgttacaagactgactctgatcttaccaaacagtcccagcttgcattgcagaagacactgtgagggccttgttgatgtcattagtaaagacagctgctacgagtccaaagtctgagttattggctctttcgataacttcatccatcgtcttaaatctcaaaatttcctgaacagggccaaagatctgcaaaaagataatatgactcaacatggttgctctgtcattcctttacctgctttccacatttcaatgcaagtttactctgccttgattacttaaatgacctttaagtttagcagtacaaaactgtaaaatctcccaacctttcctaggataagattatgcaagaagagtctgacattagtgtttaacctccccaacttccccaacctctccagcatcacttgattccactgtgtatactaggggtgtcttctttaggtacagaagagcaagtggcatcctccgtgatcctgcaaacactgctccagaacggaatgctctggactgtgggctgatttgctccttgtccctctcttgcacagatgtaaagatgcttcagtggattctctctcctggttaacatcccagtgacccacatttaggagagccgaactattgccagtgtattgttgaggccaatggcaggctattctgattgttctgttggctaataataatcataagcacatagcatgtcacctggcctccacctagcttgcttgtcttttggtttatttttcttcttgaaactggaattttcatagccatgttcattactgttgcaaaatgaatatatgtaaaatataaagagctaaaactctaatatcatccactagaaatgctctagaaatgatcccaagaaagatgtggcttttgtaagaacagcatatttgatacctcctccttggcaatccgcatatcatcagtgacgttggaaaacactgtgggctcaatgaaaaacccctttcggcccagtcctttgcctccacattccagcttggcgccctcagccacaccactctggatgagttccaagatcttgttgtactgtttcttatcaatctgtgggagacaagacttaatgactccaaatataaccttctatgaaaatggaaataagtatgttcttgagaatctttcattttagggtttttttcaaagtttaactacacccagtcagatcatataaaactgctgttacttaccaatttttgacctacaaaaaactggcaattttgtatggttaatcctaatatatcgacgattccaataaatgtactgctctgatgatattgcctaatcagaagtaccagctgaacatttagaaaaatgtttcaaaatgatggagacactggctaatttactattcaatgttcatatgagggaaaattgacttttataattaaatgagtaacttagcaagttgtattgatagtaaaaagaggcaaaaattagcacacagcctttttagatagtgctacatacccaatcttattgtggtttgtttttaaaggaattcctattacacttttagaggaactttagaggaaaatattaacagtaaagagtgaaggatgagcttcctagtccaaaaaaaaacaaggtcagtcttcccccaaaaaactgacggagttatcatttgcttattatggtaaataacacaaaaacctacatttacccaagtttgaatggctcagccagaacatcaatcttctcttgaataatccctaaacccatgctttagtgacccatataagagctggtccaggttccttctgaaaattctcagaacctgtctacagattaaaaccagaattccctttagaaatatgcctcgatgattacggtgaacctgcagaggaggctgttcaggagagactttgtggccctccccaccccactaaagtacacgaggccttcagattaagaaataaccatacagcaaaagggaagtgagccagcccttcacttcctacactttcacaagctacaagggatctgtccagactggttcaggctgctggagagactccttggcagctcgtaaaaggatagatggctctaggaaagaaagatatctaccctccttgactgtggcatctgtagggatgtcctaaagttcagtgattggaaggactgggactgggttctagtgtccagacccatcttgtcatactcatggctttctttagaactgagagactccagcttagtcccaaaggtcagaatattcttttttttttttttttgagacggagtcttgctctttcgcccaggctggtggagtgcagtggcacagtctgtaagctccatctcccgggttcacgccattctcctacctcagcctcccgagtagctgggattacaggtacccgccacctcgcccggctaattttttttttgtatttttagtagagacagggtttcaccatattagccaggatggtctcgatctcctgacctcatgatccgcccgcctcggcctccctaaaagctgagattacaggcgtgagccactgcgcccggccagaatattcttaaagtaatggtaatcccatagtttttcagagataaaacttagaaagggacagagaagcataagaaataagcaatccctctctggctccatttccagccacgaagacatggtggagaataaaggagtcagccgaaaaggaagatgtcgctttgctgggacctactacagtgtacacagttctgtgccagtcaaggattaagtaaacaaagggaatggttatgatttttctacctggggaccctgctcagtggtggggtcaaagggactccccactacgcgcctcttggcccgctccacgcttcttctcacaaactcctcatagatggactcctccacgaagatgcgagagcctgcagtgcagcactgaccttgattgaagaacacaccctggtgggcctgctccacagcatagtccactacaagaggaaacagccatgttctcaccgctttgcctggggaggggcctgtctatgaagccgcctccctcccctctccaaagccctaggtatagtgtgctcactgcatgacataaccatgaatagccctggattgggaatgcaactagttctaactacaccctgacatgctatgtgaacttgaacaacttcacttctttgggtctctttcttattctgcaaacagaggtactgaacctcgtgtataacaggagtctcaaacccctatataccacagggcttgggagataaggtacaggtatgagtctgccaggtggtaaagcaatgtaatggaggggctaagaaggaaagccactacatttaatcattgccatgcataaatatgagccccaggttgccagatcctctcaattttcacagaaatcaatattttaatgtgcagttcttgttttgaacatagtgtaatgtttagacaggtaaacatgtctatattttgtatttggccaatttacaactcctaaatctacagggccttggggctgtatgtttggtacttgggggattaaaccgtaacaccaatgggtcttctttgaagacactaaatttcctctagattgacatggacttgtgtaaaatcctatgataactcttccatattcatcccttatatcttacacttcaaaacagcttaatctgacgtgcattagttgctaaatgaccgactgactgaataaatgaatcagtcaatgttagggagatgaagttcctactcctcaagaggaacaggcataaggattctgattttcttgacaactaatataaagctaaagctgaactctgcaaattccaagctggtgctgaaattcaagcaatctgcttttggttttctgatctctctggtggtgagactgggaaagcagctctgcctggcaacaagtggagggaaaaaaaaaaaagaatcactgaatgagatggtgggatttccttacctggagagcttttcaaacagaaacgtcacacctgtgcagaatggcctaggtggcatccttcctagagacatggggtttctcagttacttctctaagcctctgtaaggtcctactggcaagtggaatcatcccagctttaggactactcataccgaactgacccacgtgtgctgtcatcctaactgaaagtcatgcgagcaacagaaaggggctggaattgactaaacagagaaggggctgtgggtttggaaaatgctggcagggctggtcaagtcggatttatttaaaatggtctaccagccaccaggcacagttgaaaagttacagatttattgaatctaggcagagagactatccttcaggtgctcagcagctgagaccactgctgttgaaccatatgccactgaccaagccttca

SEQ ID NO: 348 - DNA, 11949 bp, Homo sapiens
tagcgccagtaggccaataagatgcacacttatattctagaacctgtgaaagaagtaatagccagaaactggaaaataacagtcaaactcttaaaaaaatgcctctcagaacacagtcacttacaccttttcctctggtagttctcttcagcaccaagtttcctggaagaacaagctactccccagttttcttaaagaattgtctgattgtattaagtaagtggcttctggtaaaataatggtaagagaaaagctctggcattctcttgatcactcatcttctctgccttcctccctagcaacatctcctggcctcagcctgtgggcttcagcaacaccaaactccatgttgctctctgacaagcccggccgtctccagttcttgggctttatttcctcgggggccctctgctgaaattcccttccccttgctgtattagcacctcctacccgccttcaacatgcaggcactgcctcctctaaggagccatctgtacttacgtagctgtgagcataggatggggcatacagcaggcacttaacaaatacttgtggaatggaaagaaactaagataggatcaaaaatacaaatcaagatgtgagagaaagacgatcaaaagccctcacgagggggctgggcgtgatggctcacacctgtaatctcaacactttgggaggctaaggcgggtggatcacttgagggtgggagtttgagatcagccagagcaacatggagaaacctcgtctctactaaaaatacaaaaaattagccaggcatggtgatatatgcctgtaatcccagctactcgggaggctgaggcaggagaattgcttgaacctcggaggtagaagttgtggtgagctgagatcatgccattgtactccagcctgggcaacaggagtgaaactctgtctcaaaaaaaacaaaaaacaaaaaagaacaccacgggaaaatcaagtgtgaagcaagagctcaactcttaacaggggcaatgtttggagttttgttactggaaaagatagagaccttaccaggtccaaagtttgtagacacaggaattacgaaatggagaagggggagaagtgagctagtggcagcataaaaagaccagcagatgccccacagcactgctcttccagaggcaagaccaaccaagatgaggtgggtccacagctttccctcctgcctttcctctggttctttatttcagtcttttttgcatacattggtacagatgcagaaatagaacaaagaaacagggcaaatgggctaaattatagtgaaccaaagggcttagtgtgttaaatcttctccttttctgcatccatagaagacagtgctgctgtctttcccaggagataagatttactctcaggagtgtctttttccttgaggttacgtttttgtctttgtagggtatgtcatcagctcccgtggtaggcttcctggcattcggaatatatttactagcagatattttcctctttaaaaatgtataataagaaagactaatagtaacacatttgaatgacacaattaattgactagtacttgggatacacactagtacctgggatacatctaattaagacacttagatcttaaaaaataaaaagactttttgaaatgttgaaataataagactagaaacttttttttttgtgagacagagtctcactctgtcaccaggatggagtgagtggcgcgatctcagctcatcgcaacctccccctccccggttcaagcaattctcctgcctcagcctcccaagtagctaggactacaggcgtgtgccaccacgcccagctaatttttgtatttttagtagcgatgtggttcaccatgttggcccggatgatctcgatctcttgacctcgtgatccacctgtctcggcctcccaaagtgttgggattacaggtgtgagccaccgcaccctgcctagaaactattttaatagaagcaaatagtgcctgaatggtgggcgtctgttagcgagatggtgaactggcagatggcgcctgtgtgtcaatgcccatggccaccgtcctgctttcagacaccagttctcttccaggtaaccttctggcattttggggtttgagataccatttcctaaaggtgaattatcacaaaatactagaaataaccacataagtgtttaaaattattgttaaatacagtaagaaattcttcttcaaaagtttagcctgcttaagtttccttgtcctttgtttcctgctttcaaggccagacttccttactctctgtgtttcccctaccctggtaaacaaccttcctgccagtccttacccatacagcccacattccacatctgctacccactctgtgatttacctctcccgtcgcaatagcctctcccaccaaaactgatcttcccgccttcccaccagtgcaaccacattcctgcactttgcaagttagccaaccgggttcggattgtgcagtccaactccagccaatggagtcaggacacagtagcagggacaagctgcgttagacataaaaacctctgctttcctttgtttagggtgctctcgtggcaaccagacttaccaggagctctattctgcaaaagtaaatttgccttgctgagagaccctttgtcctttggctcagtgttggttcttctttgcagcaccgagcatttgtttccaacaaatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgagtaactggagcagaacatgcactctaattccattggctatccctttcaccctggcatttcatcaaccagaaaagacagaaaccaaacactgtaaaacaagagaggcccctcatgggtctgttgactcccacatttatatagattccactggagtccaacgaggagtgccagatgaatttaaggcccaaaatcagacaactgcaggatttgaatccacgttcttctggtggttaactataaataaaaatgtgaattagataaactacatttattacaaccaatgatgatttttttttttttgacggagttttgctcttgttgcccaggctggaatgcaatggcatgatctcggctcaccacaacttctgcctcctgggtccaagcaattcttctgcctcggcctcccgagtagctgggattataaacatgtgccaccacgcctggctaattttgtatttttagtagagacagggtttctccatgatggtcaggctggtctcaaactcccgacctcaggttatctgcctgcctcggcctcccaaagtgctgggattacaggcatcagccactgtgcccagcctatgatttgttaattatactagagatgctcttaaagggacagctgaacaattaagacccaccagtcaaatggcctgggaaaataaaatagcattagacatgataccagcgaaagagggtggagattgtgtcattatcggaacccgatgctatacttttatccctaataatactactccaggtgggatcacaccaaaagcactacaaggtcttactgccttatcaaatgagctagccaaaaattctggactaaacgaccccttcacaaatttaatgggaaattctttggcaaatggaagggatttatgtcctcaatcctcatgtctcttgccatcagaatagggttgcttattcttgtaggatgctgtgtcataccctgtgccctaggattaatacaaaagctcattgaaacagctctccccaaaacctccctcaatcctcctcctcctcgttccagtgagctttttcttttagaagacccaagtagaataacagagccaaattatgttaaaagggtttaaagaaaaaatactgtaaaatatttaacagggggattgttaaatacagtaagaaattcttcttcaaaggttcagcttgcttaagtttccttgttctttgctccctgctttcaaggccagacttccttactctctgtgttctccctgcgctggtaaacaaccttcccgccagtcgttatctatagagcccacattccacatctgctacccactctgtgaattacccctcccatcacaatggcttctcccggcaaaactgatcttcctgccttcccagcagtgtaatcacattcctgcacttttcaagttagccaaccgggttcagcttagattgtacggtccaactctagccaatggagtcaggatacagtagcagggacaagctgcgttagacataaaaacctctgctttcctttgttcggggtgctctcgtggcaaccgaacctatgaggagcaaccttatgcaaaagtaaatttgccttgctgagagaccctttgtcctttgtctcagtgctagttcttctttgcagcaccaagcatttgttttcaacaattatatatttaaggaatctttgattatggaaaatttcaagaagtagagggaatagcatactaagccctctgttcccatctttgagttatctacattttattagaagtatctttggggtgactgagggaggtttctctttcctggagggcttctgaattattgccaatgtaccttcctgactgcagccagaaactgaggcccctatacctatgtacctttctatccctctctgaagcttctgcagaattcccagcaagacagagcttgctggaagcttggtatgctcagaagcagctaaagcgtgtatgtggggcggagggtgggggcaacttcttggtcctagcacttccatatattgattttcttttctggctgcttagtgggaggagtgtgtgtgtatgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcacggatatttcaggtcagtctttgagttgggtaggagcatgcatccctggcactgccacatcccactctgactctctcgggtc

SEQ ID NO: 349 - DNA, 24028 bp, Homo sapiens
ctttcctgctttctattctcccaagaaaatatatgcctactttccttggtggagtcttctgacttgctatctcccatcttgacttgtccagtgatagagagaagccttttgggctggattctgtttctcctcaagttaatgaaagatgcccagggcaggaaggctgtgtgtgaatgctcccctgttgcccaagacaaggggtcagagtaatagagttcagggtatgttcagaggaggaacgtgaattttcacgtacctggtgagtaaacaattgttctacaaaagtggtgagaaatgtttcattttagacaccctaggagggcaccagtctgaggaggaagtctctccctccatttcataggaccagcattctccccacttccctgaggacccacagagctgcagaaatagaggccatctcttccctctgtggaaaagtagcagcaactggacagaaaagaaaaaagaagcctggggctgtgacatttgcaagactctagatagaggactgtgagaggctgagatttgacagtttctgtggggagggatgatggactggatgaggtgggagggggaggagggcatgaggatgccataggacagaagtgctccaggtttagtggaatccttcacagtctacagtgcgggttctctttggaaaacgtagggtgtagctccctccttctggccattgaaggaagacctgggtggcaaagcacaggtaaagacaagctgtgacagaggatagcaggaacccagggacctagggagcagaattctaacaccttcaccccagattcagccagagcagctccatttccatcattgcacacaccagttctactggttaacatctgctacctatgagtgttcctcacgctttgtagcttaggacagtcatcttctatttagcttatgattctgtgggtcagcaatgtgggctgggcttagctggaggtggttttggtcaggatcagtttcagctgatcttggcaggagctcactcatgcatctgtggaggacttctggaaatttggggctggctgtctgtcagctggaatgcctgggttccactctatggggacctttcattctccagcaatggaggaataacttgggctcattcacagggtagcccccagattccgggtgctgtaaaagcagtcaaaccccaattcacaagcatgtttcaagactatccttgttacatctgctactatttcaacatagtcacagagccaaccccagattccaggggtggagaaatgggctcctacttatgactgaagagctgcagtctattgcctcatacctgcagggctggggagaagttatggacgcttgaaatgtagattctcacatccccacacacacctgttggatccaattcatggaaaaggggcctctcactatgtccttcgggtgactccctcctccttaatattttaaaatattttatttgatacttataatatattatatgtgacatatatgtgtgggcatatatgtgttttattaaaaataaagcacaataatataatgtacgttaatgaacctactacccagcccaaaagctgggtcattaacaatttatttatatttacctaagtgtctttctcttatgccttcctcctacctcctcttgagatgtaacattttacattttgggttttccattccaacaagaaatttaaaaatacagttttgactctttgatatctatgcctgaacaacatactgctgagtcttctttctttctctttcttccttccttttctctcttctttttctttctttctttccttccttctctttctttctctttctccaataaaaataagtttacttatttacttcttgaattttttgtgctaaaatatttgtaacataaaatttccgattttaaccattctgaagtgtacaattcggcagcatttattacaccagcaatgttgtgcaaccatcaccactatcagtttccaaaattttttcatcaccccaaacaggaactctgtacccattaagcaatcacttcccatttcttgcttctcccagcccctagtaaagtctaacctactttttcttctatgcatttgcctattctctagatactttattataagtggaatcaagtaatatttgtccctttatgtctggcttctttcacttagtatgttttcaaggtttattcatgttgtagcacgtatcaacttcattcctttttatacgtgaataatattccattgtatgtagatatcacagtttgtttatccatttgtctgtggatggacgcttggattgcttctaccttttggatactgtgaaaatgctgctatgaacattggtgtacacgtctctgagtctctgattttaattctttgggtgtataccctgaagtggaattgctgggtcagatggcaattctatgcttagctttttgaggaacgataaaactgttttctacagcaactgcaccattttacattcttactagcaaggtaatgtaccagggttctaactcttccacatccttgccaacatttctctctcacacacacacacacacacaaatttgtagccatcctagtaggtgtgaagtggtgtttcattgtggtattgatttgcaaatttccctattgacattttccaatggtgttgagtgacttttttttttttttttttgacgacgtctcgctctgttgcccaggctggagtgcagtggtgcgatctcagctcactgcaaactctgcctcccaggttcaagcaattctcctgtctcagcctcccaagtagtagctgggactgcagatgcatgccaccacgcctgactaatttttgcatttttagaaaatatggggtttcaccatattcgtattggttagactggtctcaaacttccggcctcaggtgatccacccacctcggcctcccaaggtgctgggattacaggtgtgagtcactccccagccttgagtatcttttatgtgctttttggcactttatgtatattttttggagaaatgtctatttaaatcctttgcccatgctttaattgtttgtctttttgttgttgtagttaggatatgctctggataacaaccctttatcagatatagaatttgcaaatattttctcccattctgtagactgtcttcacttttttttttgagacagagtcttgttctgtcacccaggctggagtgcagtggtgcgatctaggctcactgcaacctctgcctcccaggttcaagcaattctcctgcctcagcctccgagtagctgggattaaagcatgcgccaccatgcctggctaatttttgtatttttagtagagatggaatttcaccacattggtcaggctggtctcaaactcctgacctcatgatccgcccacctcagcctcccgaagtgctgggattacaggcgtgagccaccacgcctggcctgtcttcattttattaatactgtcttttgatacacaaatgttcattccgatgaagcccaatttatctaatttttctttgattgctggtgattttggtgtcattatctaagaatccattgccaagttttacttggttttgatctctagaagactgccatcatactgaaggtaatcttctgaaacttgcggttttctttcaaaaattatgtttataagatgatccatgttcttgcagagtttattcattttatgctgtataatattccattatatccacatacaatgcagtattgacccttcctcctgttgatgggcatttgtcttgtttctagttactttgctattatatcagtgtcaccatgattatccaaaagtaattcttttgtacactctaatttaagaacaactaaccctttttaatgaataaatcaaccttgtattgagttgctactaagtttcagttgactagtacctgggatacacacaggtgcagacatttgactgagacatattgatttttctcatctgcctatttaggctaatcaccagactataaaaccatgagaaccactgccattgagtatagtctgtgtcagtctacactatagctttaactagttgtgtgatttcttgcaaagagcaatcagagaagacacaataaacacatttactgatttcaggctggagagcttttaagcaatagggagatggccacacacaaggtggagaaaattactgtgaaaaggaagtactttctttagagccccacctaagctaggctgcagaaatgtctacaatgggtttgaaaaaactcaaaatgagcctttctgcagtgtgaaaatcctccaagataaagagacagattgatggttcctgccgccgccctgtcctgcccagttgctgatttcaggaaatactttggcaggtttgtgggtcatagagttgccaggtttcttgggatttgtaatagaacatcacaagaaaatcaagtgtgaagcaagagctcaactcttaacaggggtattgtttgtggttttgttactggaaaagatagtgaccttaccagggccaaagtttgtagacacaggaattacgaaatggagaagggggagaagtgagctagtggcagcataaaaagaccagcagatgccccacagcactgctcttccagaggcaagaccaaccaagatgaggtgggtccacagctttccctcctgcctttcctctggttctttatttcagtcttttttgcatacatcggtagagatgcagaaatagaacaaagaaacgggcaaatgggctaaattatagtgaaccaaagggcttagtgtgttaaatcttctccttttctgcatccatagaagacagtgctgctgtctttcccaggagataagatttactctcaggagtgtctttttccttcaggttacatttttgactttatagggtatgtcatcagctcccgtggtaggcttcctggcatcctgagtatatttattagcagatattttcctctttaaaaatgtacaataaggaagactaatagtaacacatttgaatgacacaattaattgactagtacctgggatacacactaatacctgggatacatctaattaaggcacttagatcttataaaaataaacactttttgaaatgttgaaataataagactagaaactttttttttttttgagatggagtctcgctttgtcaccaggctgcagtgcagtggcatgatctcggctcactgcaacctccacctcccaggttcaagtgattctcctgcctcagcctcccaggtagctgggactacaggcgtgcgccactatgcccacctaatttttgtatttttagtagagacgggctttcaccatgttggccaggatgacctcgatctcttgacctcgtgatctgcctgccttggcctcccaaagtgctgggattacaggcatgagccaccgtgtctggcctagaaactattttaatagaagcaagtagtgcccgaatggttggcatttgttagtgagatggtgaactggcagacggcacctgtgggtcaatgcccatggccaccgtcctgcttttggacaccagttctcttccaggtaaccttctggcattttggggtttcagataccatttcctaaaggtgaattattataaaatactagaaatacccacgtgtttaaaattatatatttaaggaaccttttattacggaaaatatcaagaagtagaggaatagcacagtaagcccaaagttcccatctctgagttatctacattttattaccactatctttgcggtgtctgagggaggtttctctttcctggagggctcctgtattattgccaatgtactttcctgaatgcagccagaaactgagcccacccctccacctatgtgcctttctatccctctctgaagcttctgcagaattcccagcaggacagggcttgctggaagcttggtatgctcagaagctgctaaagtgtgtatgggcaggtgtgggggcaatttcttggtcctagcacttccatatatcgactttcttttctggctgctaagtgggaggagtgtgtgtgtatgcatgtgtgtgtgtgtgtgtgtacatgcatgtgtgtgtggatgcatgcatgtgctgtgaagcagggagactagctttccactcctccttgtcttctctctgcagtgccctgggagctgtcattgccctcctgctctggggacagctttttgcagtggactcaggcaatgatgtcacggatatcgcaggtcagtctttggttgggtaggagtgtgcatcccactctgaccctctcgggtctgcactctctctgagaacacccaattcccccttcttatctcgacctctgggctttcaggaccataaagaacattggggttcctgccagaaatgaggggagcttgcctttccattggcttctattcggggtggaaggagattgatgtgcagagcagctcccgctcatctgacttttcacggttcactgggaacaatttccaaatagcaaactctctggcttctctctctttgcagatgacggctgcccgaagccccccgagattgcacatggctatgtggagcactcggttcgctaccagtgtaagaactactacaaactgcgcacagaaggagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcacatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggtgtccaggcacttggcttccagcacagcactctttcccttcctccttctcatattctctctcctttctcccttcctgtctgcctcctttcttcttcttctttttaattcttctccttaaatgccttctcactctgctctgggtgcagacttgacttttcctttggctcatttcttgccttttgtttcaggagtatacaccttaaatgataagaagcagtggataaataaggctgttggagataaacttcctgaatgtgaagcaggtgggtgctgagcactgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaagggtcaccaagggtcttgttcattggggcctgaagggcactggctgaatccactgtcggcactgcccacagatcaggagagcctgtgcatacagagagcctgctagaaagccctgggtctaaggagaagcaagctccagggagaacaagtcaaggaatgacataaaatcttaatccatggaagcctagcaggaggctggacatgggctggaactcctgcttctcgttattaggaggagctgttgctctctcctttcattctcagaaccagaggcaaagacccagcctcttctgctcttactggtgtggaaatgccaacctgcctcgtattaactgcaccatctacaaaatctgagctccagccagtgctgctctagattcatctttctttagagagaatgaattattgtagcccctagccctttcaatgaatttcagggaattgtggaaattcctttattgggataattgtttaaaaataatacagttcgcgagcttctattcggggtggaaggagattgatgtgcagagcagctcccgctcatctgacttttcacggttcactgggaacaatttccaaatagcaaactctctggcttctctctctttgcagatgacggctgcccgaagccccccgagattgcacatggctatgtggagcactcggttcgctaccagtgtaagaactactacaaactgcgcacagaaggagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcacatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgagaagcagtggataaataaggctgttggagataaacttcctgaatgtgaagcaggtgggtgctgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaagggtcaccaagggtcttgttcattagggcctgaagggcactggctgaatccattgtctacatcgcccacagattaggagagcctgtgcatacagagagcctgctagagagccctgggtctaaggagaagcaagctccagggagaacaagtcaaggaatgacataaaatcttaatccatggaagcctagcaggaggctggacatgggctggaactcctgcttctcgttattaggaggagctgttgctctctcctttcattctcagaacaagaggcaaaggcccagcctcttctgctcttactggtgtggaaatgccaacctgcctcgtattaactgcaccatctacaaaatctgagctccagccagtgctgctctagattcatctttctttagagagaatgaattattgtagcccctagccctttcaatgaatttcagggaattgtggaaattcctttattgggataattgtttaaatataatacagttcaccagccagggctcaaaaatctcagtatttcccacttcctttgttagaaaagtgggaaatagagctttttgtaatgtaaacaatttaaaaaacagaattattttaaaactgcaactattggaaatgagatcagcaggtggtaagggcaaagcatttaaatctttctactttacgcagcagtgacagccgcccatgctttcacccctttctcagatggaaaggctcttgcacatttccactcacgagtgtcttgctctccttgacagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccatttctgtgttgtgttcagtcttgagtcttttttatttgctcctttatggtccagggtagtcagaaggtatagagtctactgggagtatggcagaaaacaccctaaacccactggaaatcccgaaggtgatacaaactcttccaccttagggaatcatgctcactgattgagtgcctattgaatgctaggtcccagaaagttaactgttgtccttgttttacagacaaggaaacagagactcagagatggtaagtgagttgcttaaggttacatagctatgaaacagggaagcagaactttgaacccaggtctgtttgatacaaactcagaggtcctttcactgcatgctgttgcctcctcaaagtgaattaggagaaaaggcatgggcctggttgaggaagaggctagctcaaaatgggatggggaaaaagtgttttaacacagacagtacttcagagtttgggatctaacctaccagcactccagaaaacaaaagacaatgatgtaaaggcaggatctctggacttactgagtccaaatcacagaatggcccataaatttgctaagtaatttaggtttcctggccatcagttcctggtctcttccatgaaggacttgagccaggcgatggctaatgtccctatcagcaataaccttctggtattccataaagagtggggaggtagagtccctgcatcagtagaagctgcttttcctactgggaacaaacccaccctgcaccaggaatcaaatgcaggctgtctgagcctcctctcctgatggcaggtcatgctattaagggtctcccagaagaaaggttctggaactctgagaaacagaagctcttctaacagaactttttcttgctataagctttcaataccaccaatcaccagtgcaccttcttctcatgccaaaatacggcccctcctttgtagggtgtaaaacgacactgatgtcactctctctcaccaaggtctggccatctctgtgaagctctcctcacaggcaccctgcagattcatcaataaacttcaacaggttagcgccagtaggccaataagatgcacacttatattctagaacctgtgaaagaagtaatagccagaaactggaaaataacagtcaaactcttaaaaaaatgcctctcagaacacagtcacttacaccttttcctctggtagttctcttcagcaccaagtttcctggaagaacaagctactccccagttttcttaaagaattgtctgattgtattaagtaagtggcttctggtaaaataatggtaagagaaaagctctggcattctcttgatcactcatcttctctgccttcctccctagcaacatctcctggcctcagcctgtgggcttcagcaacaccaaactccatgttgctctctgacaagcccggccgtctccagttcttgggctttatttcctcgggggccctctgctgaaattcccttccccttgctgtattagcacctcctacccgccttcaacatgcaggcactgcctcctctaaggagccatctgtacttacgtagctgtgagcataggatggggcatacagcaggcacttaacaaatacttgtggaatggaaagaaactaagataggatcaaaaatacaaatcaagatgtgagagaaagacgatcaaaagccctcacgagggggctgggcgtgatggctcacacctgtaatctcaacactttgggaggctaaggcgggtggatcacttgagggtgggagtttgagatcagccagagcaacatggagaaacctcgtctctactaaaaatacaaaaaattagccaggcatggtgatatatgcctgtaatcccagctactcgggaggctgaggcaggagaattgcttgaacctcggaggtagaagttgtggtgagctgagatcatgccattgtactccagcctgggcaacaggagtgaaactctgtctcaaaaaaaacaaaaaacaaaaaagaacaccacgggaaaatcaagtgtgaagcaagagctcaactcttaacaggggcaatgtttggagttttgttactggaaaagatagagaccttaccaggtccaaagtttgtagacacaggaattacgaaatggagaagggggagaagtgagctagtggcagcataaaaagaccagcagatgccccacagcactgctcttccagaggcaagaccaaccaagatgaggtgggtccacagctttccctcctgcctttcctctggttctttatttcagtcttttttgcatacattggtacagatgcagaaatagaacaaagaaacagggcaaatgggctaaattatagtgaaccaaagggcttagtgtgttaaatcttctccttttctgcatccatagaagacagtgctgctgtctttcccaggagataagatttactctcaggagtgtctttttccttgaggttacgtttttgtctttgtagggtatgtcatcagctcccgtggtaggcttcctggcattcggaatatatttactagcagatattttcctctttaaaaatgtataataagaaagactaatagtaacacatttgaatgacacaattaattgactagtacttgggatacacactagtacctgggatacatctaattaagacacttagatcttaaaaaataaaaagactttttgaaatgttgaaataataagactagaaacttttttttttgtgagacagagtctcactctgtcaccaggatggagtgagtggcgcgatctcagctcatcgcaacctccccctccccggttcaagcaattctcctgcctcagcctcccaagtagctaggactacaggcgtgtgccaccacgcccagctaatttttgtatttttagtagcgatgtggttcaccatgttggcccggatgatctcgatctcttgacctcgtgatccacctgtctcggcctcccaaagtgttgggattacaggtgtgagccaccgcaccctgcctagaaactattttaatagaagcaaatagtgcctgaatggtgggcgtctgttagcgagatggtgaactggcagatggcgcctgtgtgtcaatgcccatggccaccgtcctgctttcagacaccagttctcttccaggtaaccttctggcattttggggtttgagataccatttcctaaaggtgaattatcacaaaatactagaaataaccacataagtgtttaaaattattgttaaatacagtaagaaattcttcttcaaaagtttagcctgcttaagtttccttgtcctttgtttcctgctttcaaggccagacttccttactctctgtgtttcccctaccctggtaaacaaccttcctgccagtccttacccatacagcccacattccacatctgctacccactctgtgatttacctctcccgtcgcaatagcctctcccaccaaaactgatcttcccgccttcccaccagtgcaaccacattcctgcactttgcaagttagccaaccgggttcggattgtgcagtccaactccagccaatggagtcaggacacagtagcagggacaagctgcgttagacataaaaacctctgctttcctttgtttagggtgctctcgtggcaaccagacttaccaggagctctattctgcaaaagtaaatttgccttgctgagagaccctttgtcctttggctcagtgttggttcttctttgcagcaccgagcatttgtttccaacaaatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgagtaactggagcagaacatgcactctaattccattggctatccctttcaccctggcatttcatcaaccagaaaagacagaaaccaaacactgtaaaacaagagaggcccctcatgggtctgttgactcccacatttatatagattccactggagtccaacgaggagtgccagatgaatttaaggcccaaaatcagacaactgcaggatttgaatccacgttcttctggtggttaactataaataaaaatgtgaattagataaactacatttattacaaccaatgatgatttttttttttttgacggagttttgctcttgttgcccaggctggaatgcaatggcatgatctcggctcaccacaacttctgcctcctgggtccaagcaattcttctgcctcggcctcccgagtagctgggattataaacatgtgccaccacgcctggctaattttgtatttttagtagagacagggtttctccatgatggtcaggctggtctcaaactcccgacctcaggttatctgcctgcctcggcctcccaaagtgctgggattacaggcatcagccactgtgcccagcctatgatttgttaattatactagagatgctcttaaagggacagctgaacaattaagacccaccagtcaaatggcctgggaaaataaaatagcattagacatgataccagcgaaagagggtggagattgtgtcattatcggaacccgatgctatacttttatccctaataatactactccaggtgggatcacaccaaaagcactacaaggtcttactgccttatcaaatgagctagccaaaaattctggactaaacgaccccttcacaaatttaatgggaaattctttggcaaatggaagggatttatgtcctcaatcctcatgtctcttgccatcagaatagggttgcttattcttgtaggatgctgtgtcataccctgtgccctaggattaatacaaaagctcattgaaacagctctccccaaaacctccctcaatcctcctcctcctcgttccagtgagctttttcttttagaagacccaagtagaataacagagccaaattatgttaaaagggtttaaagaaaaaatactgtaaaatatttaacagggggattgttaaatacagtaagaaattcttcttcaaaggttcagcttgcttaagtttccttgttctttgctccctgctttcaaggccagacttccttactctctgtgttctccctgcgctggtaaacaaccttcccgccagtcgttatctatagagcccacattccacatctgctacccactctgtgaattacccctcccatcacaatggcttctcccggcaaaactgatcttcctgccttcccagcagtgtaatcacattcctgcacttttcaagttagccaaccgggttcagcttagattgtacggtccaactctagccaatggagtcaggatacagtagcagggacaagctgcgttagacataaaaacctctgctttcctttgttcggggtgctctcgtggcaaccgaacctatgaggagcaaccttatgcaaaagtaaatttgccttgctgagagaccctttgtcctttgtctcagtgctagttcttctttgcagcaccaagcatttgttttcaacaattatatatttaaggaatctttgattatggaaaatttcaagaagtagagggaatagcatactaagccctctgttcccatctttgagttatctacattttattagaagtatctttggggtgactgagggaggtttctctttcctggagggcttctgaattattgccaatgtaccttcctgactgcagccagaaactgaggcccctatacctatgtacctttctatccctctctgaagcttctgcagaattcccagcaagacagagcttgctggaagcttggtatgctcagaagcagctaaagcgtgtatgtggggcggagggtgggggcaacttcttggtcctagcacttccatatattgattttcttttctggctgcttagtgggaggagtgtgtgtgtatgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcacggatatttcaggtcagtctttgagttgggtaggagcatgcatccctggcactgccacatcccactctgactctctcgggtc

SEQ ID NO: 350 - DNA, 3639 bp, Homo sapiens
cgacgcacatttactatgtaagaattaacgtctttgccttctactaaagtaatgttaggaaaacaagtgggtttagggagcatatcattggcctgaactaccatatcctcagaatctgtctccccatacactctcttgcctcagtttaatctgcatacaattctccacattgtaaccagtttttcaaaatacagatttgatcttgttactcttttgctaaaaaacttttagtgaattcccactgctatcaggataaagtacaaaaccctcaagacgactgccaaggccctagataatctgcctctctccagtctcctctgccccactcttccccttctctagcttcagtggcaatggactagctcctttcctgcctcaagtcccatgctgttctgtctgcctggaatattgtttctactctctcatcctctttccccttcttcactactattagccggtttaactttccactcttccttcagatattggctcaatagtcacctcctcagtctgaccttctaaactccatcagattcttctatactgttttatagtgtaaatttccttcgtggtattcatctgttggtaattatgtgttaattatgtgttttggattcaaaagccaagggaggctgggtgctgtggctcacgcccataatcccagcactttgggaggccgaggcaggtggatcacttgaagtcaggagttcgagaccagcttagccaacatggtgaaacctcgtctctactaaaaatacaaaaattagccaggcattgtggcgagcacctgtaatcccagctactcaggaggctgaggcaggagaatcgcttgaacctgggaggcggaggttgcagtgacccgagatggcgccactgcattccagcctgggtgacagagggagtctccgtctaaaaaaatggaaaaaagccaagggggacattcaggtcagagttaaacagatgagggagtgagcaagagattgatggaaaattggaagccacaggagaagacaagattgcttgaactcattgaatggaaaaacacaaaagaaggaagagtgaagaacagaaacttggatgacaacaggtaagacagagaagagcccattaatccagaaagggagaagtagatttaagagaaagaagtagcagtaaaggtgggaggccaatcatctgaggtcaggagttagagaccagcctgaccaacatggtgaaactctgtctctactaaaaatacaaaaattagccgggtgtgctggcgcatgcctgtaatcccagctacttaggggactgaggcagaagaattgcttgaacccgggaggcagaggttgcagtgagccgggacggcaccactgcactccagcccgggcaacaagagggagactccatctcaaaaaaagaaattagaataacaggagttagttttaaaatttaaatattagatggcattagtctgataagtatctctataatatagtggagtataatggggtaataatgcctgaaatgcactggccaaggctctcttccttgaatgggcactaagtcagccccagccctcccattacggttccattactgactaacctctctctttttcaggttgattcattctccctttggatatgctatatatattctgtatttttcagagccactctgtctcctaaactaactttacatatctctgctgtgatccattaccttctgagacggtatagtgtcagggattgtggtagtagtctgaatctccactatgctgcctacttacattctcttaagtatcagtctctgcatcagtaaaatgggagtaacaccataaaatacgagtaaacccgtagagggtttcttagggattaaatgacagaatatatacagaaagccttgaatagtagctattttcagtaccaagggaaaccctgctgtgtcattttgaatagtgtgtttgtcactgcatgattaagtagtaaaggatttcagataaactgttgtctttggcatgattatagaatctagaaaattaataaaataagcaggcaaaagttttatgtgtttggctgtgtaaaaataaccaattacagtcatttatgtaaacaatttaacgtgtagggcctaattatcatgcaacaccataacaattacatatattattaaatatgcatcagattaaccttgttgttaagttttgattacaataaaagtactttgtactctaaggaacagtcttatagttaattgctaataatgcataagtttgttcactatttgcattaattaaatgagacatagctcctgagtttgctctccatttgaggcaaggctggatcctccatcctatattgcaactacacatttgtcctgcgacctgtgagataacatacactttccttagtattctatagtgaggaaaatgctgaagaaactgccagtaaaaaaaaattctgtttaattggctgttgttcctgaacctacaggtttccagtagataagagtttttgatttaaacaatgaaaaattctatgctgagcactagttaacctatgtagaacaacttctaaataagccccaggatcatcctgtggagcacttctataaataaaattatatttgactcccaccatgaacaaggtagtagtatacatacatatatcatcccaccccaccaccttttttttttagactgagtctccctctgtcccccaggctagagtggggaacagactgatcatgccttactgcaacctctgcctcccggattcaagtgattctcatgcctcagcctcccgggtagctgggattacaggtgcatgccaccatgcccagctagtttttgtatttttagtagagacagggtttcaccatgttggctaggctagtctcgaactactgacttcaagtgacccacccacatcagcctctcaaagtgctgggattacaggcgtgagctactgcatcgggctttcatcatatccttatgaaacgcttatgaattagacattattattttcattttacataggaggagaaaggagatgcaggaagataataacttccctaaattcttttttttttttagatggagtttcactcttgttgcccaggctggagtgcaatggtgggatctcggctcacggcaacctctgcctcctgggttcaagcgattctcctgcctcagcctcccaagtagttgggattataagcatgcaccaccatgcccggctaattttttatatttttagtagagatggggtttcaccatgttggctaggctggtctcgaactcctgatctcaagtgatccacccgcctcagcctcccaaagtgctgggattataggcatgagccaccgcaccaggccctaaattcttaaaggtgataaggagtggagacagaattcaaattcaggaaagtttcaaagtccatgcttgctttttcaattatattaaacaatgccaagttccttgcatattccaagcatttattgggcacctgttggttgcacaagagtatagactgcctgtcaccaaatgatgcaaaataatttaggagcctgttttgacagtcacaagatggaggtcctgtacattaggcagaaaagtatgcagctaggcagcctagtaggcattttagaattgtctga

SEQ ID NO: 351 - DNA, 8686 bp, Homo sapiens
aaaaatgacatagaaatacagtaggataaattcgagagtggactttctgaaaaatcccaataatatatgagtacctacagcaaatctaattggaaaagaaaaagaacgggggaaatcatttaaaaagttaaaaagaggatcagggagagatcctaaatagtgtgagagactgctatgcagagttgtgtggtaatatatttggaaatcttgatgaaatctaaaatttcctagcagatataaaaatcagctagagaaatagaagactgtgattatgtcattcttctgcttgaaattcccctaaatagcttcccattgttctcaagataaagatagatactttcaacttgtcttccagtcctccctgatctgacctgtttcttgccatccaggccttgcattcttttcccttgggctcctgcactctggccatattgatcttctttctgttcatctaatactgttctcttttgcaccaggacctttgcacgtcctgtttgttttgtgtgttttgaacacttaatttctattaatccttagatttctactcaagtttcatgtcatggggaaactgaaccttactcttcacagactaggtttgggtccctgtgccatctgctctcatagctccttatactttgttttcatacttaacactattaacaattatttctgggtatttatgtctctttctccccaagtatatcataatttctttgatggtagaattgatggctgttttgcttattcttgcctagcacagagagaggtactcagtattttctgattaaataaggacttgcatagtcaaataacctcttccgttttttcttttttctctctcttttttttttggagatggagtcttgctctgtcgcccaggctggagtgcagtggcatgatctcggctcattgcaagctctgcctcccgggttcacgccattctcctgcctcagcctcccgagtagctgggactacaggcgcccgccaccacgcccggctaatttttttttttttttttttttgtatttttagtagagacaggatttcaccatgttaaccaggatgttcttgatctcctgacctcgtgatccgcccacctcagcctcccaaagtgctgggattacaggcgtgagccaccacgcccggccccattttttctttaatagtgagatttagaaacccatcctctctctctctccctctcaaacataaaaaacaacctaagttgtttcacagacacattcttgtaagctttctaggaaataattttctatatccaactgttttgtaacatacccatatacatatagaaagctatccagttcattttatttcaatctcaaatttgataaagtaccaaaaagtagtaatacagacctagttcagtcatgaatatggatgggaaaagtcaatataaaattctagcaaatcagattcagcaggatattaaaagaacatttcataacataagttatacattgaatttaaaaagtaggtgaatattagattaaaaatgaaaaaccacatggtgatcttaatgccacaaaagagtttgataaaactcaatattcattctttataaaagtatttaatggtttggatgaagacttcttcagttaaagaaaaacaaagaagaatttctgtccaaaccaatatcccagtatcttgctatataatgaaatgatagagtcatttctatgaaaataggataaaataaagaggcttgcggatacagccttttttttttttttccaagttctagacaatgcaataaaacataacagaaattagaagcagggcttttggaaaaaaggagatacagttcccatttatttgcaggccgattggttatatctagaaaccaaagagaaaattaaaaacttttggaattagtaagaataggtatgaattaatatgagagttgagttggatacacatgtttttgagctgattcatgcaaaggctttccaagctcctttgtgttttactaggttgtgtttgcttaaagttggctcgctagtacgcagtcatgagtcaggggaagagaaggagcctgactggctcctatattgttctgagtcatatttctttttttcagtggaattaaaccaacatgattgttgaaagagatcaaaatttggcaggttttcatttgcttgatatctgtaaacagacttttctttcaggaaaggaatttggaggagggcagagccatcattatctcttttttacaaatctacaatttcccatttgacccttacaattaatctgaaagtcaatttgtgtttgagattatacgacagtaacaggttgataagcagacatttctatgtcttattcgataagaaatactgaattaagttggagaatggaggtcatgtgctgccccgtacatttctcatcttgtcctcagcaaggactatatggtaattttcatagattttgtcaattaaatgaccgatatttgagtaccttttaagtgctagttcctgttcttggtggtaggattgcagtggtgaagaagatatattctgttcttaagaggattacattgcagaggggatagatagataataagctgtgtataaataagataaatttaattataaataatactgataaatatagagaagataaaataggtattgaccaattatgaatggcatactgtatggcaagagctttttagatggagtcaaagaagtctttgctgaaaaggtgacatttgaattgagtcatgaaggatgaggaagaggaagccatgagggcacctgttctaagagcatttcccagcataaagaactatgtggtgacaataaattcagggacagaaaggaggccaatgtggctgaagaacagtgaactaagtgggagagtaagaagaggtaatgctggagaagtagccaaaaaccaggtcacgtaggaacttgtgggccataagaaggagtttggatttttggaaatgtgttggaaaacctttagattgtttgtttgtttttcaaagtgagatgtttatgatctgtgtggaagacagacaagaagaaaacaaaagtggaagtagaaagaccaggtaggacatcgttgcttgtgctggtggcttgggtccaggtgggtgcaatggagattcagggcagcaagtagaatttgactgatggattggagtggtatgaaagaaagagtcaaggatggccctaattttttgatctgaataataaagtgtataatgaatgctgtttgctgaaatgggcaactcttgagattggaagtgaagctatgagttgagagcactttctctgttttggctgtgttaactctcagtatcccccggaagtcattattatcatttgccatctgaatccattataccctgtttactttcaatttttatgttttttacttttatatttttttggagacagtatctcactctgttgcccagactggaatgcagtggcatgatcatagctccctgcagccttgaactcttgggctcaagtaatccttccaccccaggctcccaggtagcagctaggactacaagagtgtgccactgcacccagctagttttaaatttttttattgttttgtggatacgaggtcttactatgttgcctaggctggaatgcagtggcacaattatagctcactgcagccttgaactcctgggctcaagtgaacttcctgccttggcctcccaaagtgcagatattacaggtgtgagccactgtgcctgttcattttctaagttattttataaataattaacacaagtaaacaatgaaaaacaaccttattagaaactttaataagaatttaaccatagcaaacccaattttttttatcctgtaagttcctggttttgaagacacatacatattcaaaatgagaaaaagtcctttgaatataatcatcaattgctatatacaaacctgtaacatatacattatataaatactgatttccagatttaaaatgaatctcttaatatgttctgggtttatcattacttctggtttttgcattttattgtcaaaaggcagtatttttgaaaactttgatggctaagattttgttgaagaaaggataaacactttcaattgaaaagtatttttgttttttagatttatcaactaatgagaatgatcgatttaatgaaatttgttatttctacatcagttattttttctccacactttttatatagatacttatcatcagcatttgtctacctatgaacttcatcaagtaaatttagcttcataaacatcataaaaagatcaatgaatactaccacatattcttttaactaaatgggatggtctaggatcttgtaacatattgcacaatgaagtttcctgttgaatgactgtctggctaaaagtacttcttgtccttaaaaatcatattgtacattcattccttcttaagtttcagaaaatttatctaggatatcatcatctgaagattcataacctgagatttcactactacctgcctctttacattcaccatctaataactgtgaaatatctttctttgtcagttttcttctctttgccattatgggtagaaaatgaaatattctgaattttcaaccgtgtttactgaaaccctcaaaaatacaaagataggatttccagccttcttttcaaaagatgagacaataccaccaaccaaaaaaagcctgggacctgatggattcacagccagattctaccagatgtacaaacaagagctggcaccattcctacagaaactattccaaaaaactgaagagaaaggactcctccacaacttattctatgaggccagcatcatcttgataccaaaacctggcagagacacaacagagaaagaaaacttcaggccagtatccttgatgaacattgatgtacaaatcctcaacagaatacttgcaaactgaatccaacagcacataaaaaaggtaatccaccatgatcaagtaggcttcatccctgggatgcaagattggttcaacatacacaaatcagtaattgtgattcatcacataaacagaactaaagaccaaaaactacatgattatctcaatagatgcagaaaagacttttaataaaattcaacatcccttaatgtaaaaaactctcaataaactaggtattgaaggaacatacctcaaaataataagagccatctatgacaaacccacagccaacattgaactgaatgggcaaaagctggaaacattacccttgaaaaccggcatgagacaaggatgtcctgtcttaccacttcaattcaacatagtactggaagtccttaccagagcagtcatgcaagagagagaaataaagggcacccatacaggaagagaggaagtcttctctgtttgcagatgacatgattgtatatctagaaaacccaatagtctcagccgggcacggtggctcacgcctgtaatcccagcactttgggaggccgaggtgggcggatcatgaagtcaggagatcaagaccatcctggctaacatggtgaaaccccatctctactaaaaatacaaaaaattagccgggcgtggtggtgggtgcctatagtcccagctacttgggaagctgaggcaggagaatggcatgaatccaggaggcggagcttgcagtgaactgagattgcgccactgcactcaagcctgggtgacagagcgagactccatctcaaagaaaaaaaaaaaagaaaaccccataggctcagcttgaaaactcctccagctgatacacagcttcagcaaagttgcaggatacaaaatcaatgtacaaaaatttactagcattcctatacaccaacaacagccaaactgagagccaaatcagaaaggcaatcgaattcccagttgccacaaaaagaataaaatacctgggactacagctagccagggaggtgaaagatctctacaatgaaaattacaaaacactcctcaaataaatcagagaagacataaacaaatggaaaagcattccatgctcatggataggaagaccccatatcattaaaatggctatattgcctaaagcaatgtacagattcaatgctatttctatcaaactaccaacagcattattcacagaactagaaaaaactagtttaaaacccttacggaaccaaaaaagagcctgaatagccaagggaatcctaagcaaaaagaacaagtgccagaggcatcatgttacccaacttccaactatactacaaggttacagtcaccagaacagcatggtacaggtacaaaaacaggcacatagaccaatggaacagaagagagagcctagaaatcaggccacgcatctgatcatcaacaatgctgacaaaaacaagcaatggggaaaagactccctattcaataaatggtgctgggataactggctagccatatgcagaagattgaagctggatcccttccttgcaccatatataaaaatcaactcaagatggatcaaaggcttaaatgtaaaattcaaaactataaaaaccctggaagacaaccaaggcaataccatcctggacatagaaccggcaaagattttatgacaaagacaccaaaagcaatcacaacaaaagcaaaaattgacaagtgagatctaattaaacttaagagcttctgcatagcaaaagaaactatcaacagaataaacagccaatctacagaatgggagaaaatatttacaaactatgcatctgacaaaggtctaatattcagcatctataaagaacttaagtaaatttaggggagaaaaccccatttaaaaagtgggcaaaggacatgaacagacacttcccaaaagaagacatacatgaggccaacaagcatatgaaaaaaatcttaatatcactgatcattagagaaatgcaaattaaaatcacagtgagataccatctcataccagtcagaatggttatcattagtcaaaaaataacatgctggtgagattgcagagaaaaggaaacacttatacactgttggtgggagtgtaagttagttcaagcattgtggaaagctgtatgatgattcctcagagacctaaaagcagaactgccatttgacccagcaatcccattactgggtatatacccagaccaatataaatcattctactgtaaagacacatccatgtgaatgtttattgcagcactattcacaatagcaaagatgtggaatcaacctaaatgccctcagtgacagattggataaagaaaatgtggcacctaaataccatggaatactatgcagccataaaagaatgaaatcatgtcttttgtgagaacatggatggagctggaggctattatccttaacaaactaatgcaggaacagaaaaccaaatactgcatgttcacacttacaagtgggagctaaatgataagaacctacaaacgaagaaaacaacagacactgggggctacttgatggggagggtgaaaggagcaagaggcgcagaaaatataactattgggaactgggcttaatacctgggtgatgagataatatgtacaacagacccccttgacacatgtttacctatgtaacaaaccttcacttctacccccaaacctaaaataaaaggtgaaaaacaaaagatgaggcaatactttgagtaatgcaataagaaaactgaaggagggtatagtagtacagcatccttttaggcaattctattattcttacaattttagatttttaaaaatatagttgggaataactgataaataatgatgaaataattttcaggatgatggattaccgaaagatttaaggtataggaaaaataagatcactgaggccctgtaatatatcttagatttatgaaagagtccaatggacccatatggtaattgcaagacaaaatgagtgtgttttaaaaacaagtaagagttctgtttgctcttgaatacctctaagaaagaataaattcatgaaatatcaatccttacaaatagaactgcccagaaacaaatttaaaaaacaaatctccagtctagtggtcccagataataccaagggataagtttgaagtgtgtattaaatatcccattggagatgtagagtagtggttgtctccagaaatctaaacctcagaagagaggtctagactagaggtttcagtctgagagtcatcaaccatttgaagctttggatctagatgagatcacccaggaaagagaggataaatggaaagagaagagggccaagaatagagccctgtggcacactagattttagaaatctcatttaggagaaagatactgagagggtgcaaccagtgaggtagaaacctgtgatataacttggagaatagtgttttaggtggggagaagtcaactggatcaaaagataagagtaatttttaaaaaagtaaggtcagagaagtttgatcattgacttttttaagaatagggatctttgatgacccttaggagagctgtttcattgaagtgatgaggctgaaagcctgtttgtgatggattaaaatgaggaagtagagataagcaatagaggcaaattttacaataaattttgctgtgaaggcgggggagagatggtatttggtgagagtttcttttaacccactttagaggattgagaggaattggtagagtacctggaattggggatgtcaatcagggagatattggtaccttaaattaacatattaag

SEQ ID NO: 352 - DNA, 6285 bp, Homo sapiens
tcttgtcctcagcaaggactatatggtaattttcatagattttgtcaattaaatgaccgatatttgagtaccttttaagtgctagttcctgttcttggtggtaggattgcagtggtgaagaagatatattctgttcttaagaggattacattgcagaggggatagatagataataagctgtgtataaataagataaatttaattataaataatactgataaatatagagaagataaaataggtattgaccaattatgaatggcatactgtatggcaagagctttttagatggagtcaaagaagtctttgctgaaaaggtgacatttgaattgagtcatgaaggatgaggaagaggaagccatgagggcacctgttctaagagcatttcccagcataaagaactatgtggtgacaataaattcagggacagaaaggaggccaatgtggctgaagaacagtgaactaagtgggagagtaagaagaggtaatgctggagaagtagccaaaaaccaggtcacgtaggaacttgtgggccataagaaggagtttggatttttggaaatgtgttggaaaacctttagattgtttgtttgtttttcaaagtgagatgtttatgatctgtgtggaagacagacaagaagaaaacaaaagtggaagtagaaagaccaggtaggacatcgttgcttgtgctggtggcttgggtccaggtgggtgcaatggagattcagggcagcaagtagaatttgactgatggattggagtggtatgaaagaaagagtcaaggatggccctaattttttgatctgaataataaagtgtataatgaatgctgtttgctgaaatgggcaactcttgagattggaagtgaagctatgagttgagagcactttctctgttttggctgtgttaactctcagtatcccccggaagtcattattatcatttgccatctgaatccattataccctgtttactttcaatttttatgttttttacttttatatttttttggagacagtatctcactctgttgcccagactggaatgcagtggcatgatcatagctccctgcagccttgaactcttgggctcaagtaatccttccaccccaggctcccaggtagcagctaggactacaagagtgtgccactgcacccagctagttttaaatttttttattgttttgtggatacgaggtcttactatgttgcctaggctggaatgcagtggcacaattatagctcactgcagccttgaactcctgggctcaagtgaacttcctgccttggcctcccaaagtgcagatattacaggtgtgagccactgtgcctgttcattttctaagttattttataaataattaacacaagtaaacaatgaaaaacaaccttattagaaactttaataagaatttaaccatagcaaacccaattttttttatcctgtaagttcctggttttgaagacacatacatattcaaaatgagaaaaagtcctttgaatataatcatcaattgctatatacaaacctgtaacatatacattatataaatactgatttccagatttaaaatgaatctcttaatatgttctgggtttatcattacttctggtttttgcattttattgtcaaaaggcagtatttttgaaaactttgatggctaagattttgttgaagaaaggataaacactttcaattgaaaagtatttttgttttttagatttatcaactaatgagaatgatcgatttaatgaaatttgttatttctacatcagttattttttctccacactttttatatagatacttatcatcagcatttgtctacctatgaacttcatcaagtaaatttagcttcataaacatcataaaaagatcaatgaatactaccacatattcttttaactaaatgggatggtctaggatcttgtaacatattgcacaatgaagtttcctgttgaatgactgtctggctaaaagtacttcttgtccttaaaaatcatattgtacattcattccttcttaagtttcagaaaatttatctaggatatcatcatctgaagattcataacctgagatttcactactacctgcctctttacattcaccatctaataactgtgaaatatctttctttgtcagttttcttctctttgccattatgggtagaaaatgaaatattctgaattttcaaccgtgtttactgaaaccctcaaaaatacaaagataggatttccagccttcttttcaaaagatgagacaataccaccaaccaaaaaaagcctgggacctgatggattcacagccagattctaccagatgtacaaacaagagctggcaccattcctacagaaactattccaaaaaactgaagagaaaggactcctccacaacttattctatgaggccagcatcatcttgataccaaaacctggcagagacacaacagagaaagaaaacttcaggccagtatccttgatgaacattgatgtacaaatcctcaacagaatacttgcaaactgaatccaacagcacataaaaaaggtaatccaccatgatcaagtaggcttcatccctgggatgcaagattggttcaacatacacaaatcagtaattgtgattcatcacataaacagaactaaagaccaaaaactacatgattatctcaatagatgcagaaaagacttttaataaaattcaacatcccttaatgtaaaaaactctcaataaactaggtattgaaggaacatacctcaaaataataagagccatctatgacaaacccacagccaacattgaactgaatgggcaaaagctggaaacattacccttgaaaaccggcatgagacaaggatgtcctgtcttaccacttcaattcaacatagtactggaagtccttaccagagcagtcatgcaagagagagaaataaagggcacccatacaggaagagaggaagtcttctctgtttgcagatgacatgattgtatatctagaaaacccaatagtctcagccgggcacggtggctcacgcctgtaatcccagcactttgggaggccgaggtgggcggatcatgaagtcaggagatcaagaccatcctggctaacatggtgaaaccccatctctactaaaaatacaaaaaattagccgggcgtggtggtgggtgcctatagtcccagctacttgggaagctgaggcaggagaatggcatgaatccaggaggcggagcttgcagtgaactgagattgcgccactgcactcaagcctgggtgacagagcgagactccatctcaaagaaaaaaaaaaaagaaaaccccataggctcagcttgaaaactcctccagctgatacacagcttcagcaaagttgcaggatacaaaatcaatgtacaaaaatttactagcattcctatacaccaacaacagccaaactgagagccaaatcagaaaggcaatcgaattcccagttgccacaaaaagaataaaatacctgggactacagctagccagggaggtgaaagatctctacaatgaaaattacaaaacactcctcaaataaatcagagaagacataaacaaatggaaaagcattccatgctcatggataggaagaccccatatcattaaaatggctatattgcctaaagcaatgtacagattcaatgctatttctatcaaactaccaacagcattattcacagaactagaaaaaactagtttaaaacccttacggaaccaaaaaagagcctgaatagccaagggaatcctaagcaaaaagaacaagtgccagaggcatcatgttacccaacttccaactatactacaaggttacagtcaccagaacagcatggtacaggtacaaaaacaggcacatagaccaatggaacagaagagagagcctagaaatcaggccacgcatctgatcatcaacaatgctgacaaaaacaagcaatggggaaaagactccctattcaataaatggtgctgggataactggctagccatatgcagaagattgaagctggatcccttccttgcaccatatataaaaatcaactcaagatggatcaaaggcttaaatgtaaaattcaaaactataaaaaccctggaagacaaccaaggcaataccatcctggacatagaaccggcaaagattttatgacaaagacaccaaaagcaatcacaacaaaagcaaaaattgacaagtgagatctaattaaacttaagagcttctgcatagcaaaagaaactatcaacagaataaacagccaatctacagaatgggagaaaatatttacaaactatgcatctgacaaaggtctaatattcagcatctataaagaacttaagtaaatttaggggagaaaaccccatttaaaaagtgggcaaaggacatgaacagacacttcccaaaagaagacatacatgaggccaacaagcatatgaaaaaaatcttaatatcactgatcattagagaaatgcaaattaaaatcacagtgagataccatctcataccagtcagaatggttatcattagtcaaaaaataacatgctggtgagattgcagagaaaaggaaacacttatacactgttggtgggagtgtaagttagttcaagcattgtggaaagctgtatgatgattcctcagagacctaaaagcagaactgccatttgacccagcaatcccattactgggtatatacccagaccaatataaatcattctactgtaaagacacatccatgtgaatgtttattgcagcactattcacaatagcaaagatgtggaatcaacctaaatgccctcagtgacagattggataaagaaaatgtggcacctaaataccatggaatactatgcagccataaaagaatgaaatcatgtcttttgtgagaacatggatggagctggaggctattatccttaacaaactaatgcaggaacagaaaaccaaatactgcatgttcacacttacaagtgggagctaaatgataagaacctacaaacgaagaaaacaacagacactgggggctacttgatggggagggtgaaaggagcaagaggcgcagaaaatataactattgggaactgggcttaatacctgggtgatgagataatatgtacaacagacccccttgacacatgtttacctatgtaacaaaccttcacttctacccccaaacctaaaataaaaggtgaaaaacaaaagatgaggcaatactttgagtaatgcaataagaaaactgaaggagggtatagtagtacagcatccttttaggcaattctattattcttacaattttagatttttaaaaatatagttgggaataactgataaataatgatgaaataattttcaggatgatggattaccgaaagatttaaggtataggaaaaataagatcactgaggccctgtaatatatcttagatttatgaaagagtccaatggacccatatggtaattgcaagacaaaatgagtgtgttttaaaaacaagtaagagttctgtttgctcttgaatacctctaagaaagaataaattcatgaaatatcaatccttacaaatagaactgcccagaaacaaatttaaaaaacaaatctccagtctagtggtcccagataataccaagggataagtttgaagtgtgtattaaatatcccattggagatgtagagtagtggttgtctccagaaatctaaacctcagaagagaggtctagactagaggtttcagtctgagagtcatcaaccatttgaagctttggatctagatgagatcacccaggaaagagaggataaatggaaagagaagagggccaagaatagagccctgtggcacactagattttagaaatctcatttaggagaaagatactgagagggtgcaaccagtgaggtagaaacctgtgatataacttggagaatagtgttttaggtggggagaagtcaactggatcaaaagataagagtaatttttaaaaaagtaaggtcagagaagtttgatcattgacttttttaagaatagggatctttgatgacccttaggagagctgtttcattgaagtgatgaggctgaaagcctgtttgtgatggattaaaatgaggaagtagagataagcaatagaggcaaattttacaataaattttgctgtgaaggcgggggagagatggtatttggtgagagtttcttttaacccactttagaggattgagaggaattggtagagtacctggaattggggatgtcaatcagggagatattggtaccttaaattaacatattaag

SEQ ID NO: 353 - DNA, 131183 bp, Homo sapiens
tctcttcagagatgctcgagagttgttgttttttttttttttaaataagtgaatctgggaataaaaggctggcccacaacaatgtatggcagttaaacaacttcaagagaatgttttggaggtaaccaaaggatattgtgggcagacatttctggagacccctgtcctttggataaatgtgggtgcgccatgtccccggcaatgtaatggaatatttgaaggccagactgaggatctagaacttcccaccctcctacccccactgtgaggagtgtcttggcgaggggggctcctgggaccatctaacctctagggcaaaagggtgacgcagcgtggttaataaatcagcctgccttgctcctgtccccagagggtctgaggctgtgtactcttcaaagcaatggtctggtgacttcccagaagattcctgtgactgaagattgttccaaataaagtcactctcaagtgggttcctagggtggagacaccaacccagaagtacccacactcagcaggctctctaggcagagctctgaggggagggcagaaggggaaatgtctgggtgggttggttggttggttggttggttttgagacaaggtctcactatgtcacccaggctccagtgcagtgactatttccaggagcaatcatagtgcactgcagcctcaaactcctcagctcaagcaatccttccacctcagtctcgcgagtagctgggattccaggcacgtgccaccacgaccagcaggaaaatgccacctttacagtaacaccactttcagaggaagggatcagggagccttgcccactccagaaaaagccctagaaagagcaaacttgaagtgtccacacaccatctcacactcattaggatggctaccatcaagaaaaaagaaaaacagaaaataacaaatgttggcaaggatgtggacaaatgggaacccttgtgcactgttgatggacatgtaaaatgatgcaaccaccatggaaaatagtatggctgttccacacaaaaaaaattaaaaataaattctgcatgaacaagcaattcaacttctgggcatatacccaaaggagttggaagcagggtcttgaagaggcattttacaccatgttcatggcagtgttatgcacaatggccagaaggcagcagcctgagtgtctgttggtgaacgggtggataaacaaaatgtggtatgtacatagtctattagtcggggttctccagaaaaacaaaaccagtagaatatatacagatacataagaggagatttgttacaggcattggctcatccaattaagggggccaaagaggcccaccctatgccatctgcaagctggaaaactaggaaagccatggtgtcgttcaggctgaatctgaaggcctgggaaccaggggagccattggagtgaccaacgttcagctgaaggcctgggaacctggggggctaagggtgatgagtccccaagtcagaaagctcgagacaggagctccaattccccagggcaggagaagacggatgctccagctaagaagagaaagagagaatttgctcctcctctgcgttttttttttagacggagtcttactctgtcgcccaggctggagtacagtgacgcgatctcagctcactgcaagctccacctcctgggttcacgtcattctcctgcctcagcctctcaagtagctgggactacaggcgcccgccaccacgcccagctaattttttttgtatttttagtagagacggggtttcaccgtgttagccaggatggtctcgatctcctgacctcgtgatctgcctgccttggcctcccaaagtgctgggattacaggcgtgagccaccgagcccagccctcctctgccttttttattctacttgggccctcaacagatgggttgatgcccacccactggcgaaggcggaccttctttactcagcctactaattcaaatgctcatctcttctggaaacgtcctcaaggacaaacccaaagataatgttgtaccagctatctggacaccccttaacccagtcaagttgacacataaaattaaccatcacgcatgcaatagaatattattcagcttaaacaggaaggaaattctgacacatgctacaacacggatgaactttgtggacattatgctgaaatatcccagtcactaaaagacaaaatagtgtgattccacttatatgaggtacctagagtaaaccaaaaataaaattctaagcatccccccatgcccctgcaaccatctgaaagggcttccttctcagccagggctcttttaaaatttaacctgagagactgtttcaggccatgatggaaagcaggggtcagacatgcctcatgatacctctccagcactgacatcaacacagactttaagtctgataagaaacattttaaaacctgttccctctgaagcctaccacttgaaggctttctctgcaaaataaaaacttgggtctccataatcctttatcttaacccagacatttctttccgttggtcccaggtctttagataaactcagccaattgtaaaccagaaaattttttaacctacctataagctggaagtccccccgacccagttttgagttgtcccacctttctgaaccaaaccaatatatttcttaaatgtatttgattgatgtctcatgcctctctaaaatgtataaaaccaagctgcgccccgaccaccttgggcacatgttctcaggacctcctgagggctgtgtcgggggccacggtcactcatatttggctcagaataaatctcttcaaatatcttacagagtttgattcttttctttgacactagagtaatcaagttcatagagacaggaagtagaatagtggctgttaggggttgggggagagaagaacagggagctgttgtgtaatgggtagagagtttctgttttacaagatgaagagtcctggagattagctgcccaacagtgtgaacgtacttgacactaccgaactgtacacttagaaatggctaagatggtaaattttatgttatgtgtattttactacaatgaaaattttttatttagaaagtgtacacatgtattaaagtcctcatcgccccgttgttgaccacgttccactttttgttttgctgcaatgtgtctcttcatccgcttcgtatttatctggtgccaatgttattaagggtagaatgagattcaaataaactttcctccagggaaacgacaaacccaagaagcaggcaacttgccaggacaaaagaataaaaaaataagcaaacagcccagaaggtgcagcccggccctgctgggggtcatgaggtgggtaagctgactccatgcaaggggatcttgtctctccttcctaaacttcacagctgaaggaaggtggagagggcaaggtggaccttggaccaggttacaatccacaggatgtattctcattgtccttctgggttctaaacgtttctctccatgagtcacaaaggttaactggctctaaaattttaaaaccctcagggttttccttttttagattgtcctcaggagacctctcactgagtgttccctccatcctcatttccaactggcagctgcttcttagcatgcatgtttacagaaataccagtagttattgcatgttcccttccatgtgattaagcattgccataaagccaggactggattagaaatagatcttccccttctgagaaagcacccaatggagcaaagctggcggcagtgatggacaacttgtgccacctactggccatcgatggtatcacatgcccaatgccaaagactagacaaggttttgccacctgccaatgaactggccagagccactgcctcacccactttgcatggcagagggtgactgggaaatatgaccaactgtcccacactggaaccgacctccaggtctgtgctccctagccaaggtttccaatcacctaggttattatctgagggaacagccccttggagctcttgctccaaaagggcctggaggaatggcatttcaggacacagggccatagattgtggcattattctacacgtaagttcagacttgggaatgaatgaaatacactccactgtgttatgcaacttttgtcacaacattttacctcctttgatcccccttaacagttatatgagctaggttctattattattttagagatgaggaaactgaggcacagagaggttcaatcattgggttaaatgcctttccattgctacacagagggatatgatgccttgacggggtactcactagaaagcggagctataacataatggttctctttcatgtttatttttcaaagcaaacacaccatcataatgatatccaagtgttctcttaactgttcggaagatcttgtttagaagcttcacaagcaaatgaacatcctcaaccttatagccacagtctcatttcttggttcatttcagtgaatatggattgtccaccttccgggttccagatagaatggcaagtggggagtacgccatcacctaccctgcggggctatttctcaactataaggtaacttgaaatcatgagactctgccaccactgaggctgttcatgttctgtagcccattcacagaagtttcaccagtaataggagcaagtacataaaaaccccaaatgtgaccacttcaaacaggattacacccatgaaaatgcatgtcttgataggttcattttttaaaaaatcagtggtgtcctgtttagaatcccacctgaaatttaggaaaagaaccttccctgagacaggctcacctccttattataagaagggcagcctcagcttggcaggaagcagtgcctcattgactcctcctcacgtggccaacctgactgacagggagcccaatgtgccatcaaccggcaatgagctggggagacaccagagcagaacccaggcttcaagagagaagcaggaggcggctgggcgtggtggctcatgcctgtaatcccagcactttgggaggctgaggagagcggatcacgaggttaggagatcaagaccatcctggctaacacgatgaaaccccgtctctactaaaaatacaaaaaattagtcgggcatggtggcgggcgcctgtagtcccagctactcaggagactgaggcaggagaatggcatgaacccgggaggcggagtttgcagtgagccgagatcgcaccactgcactccagcctgggcgacagaggaagacgtctaaaaaaaaaattaaaaaaaaaaaaaatgagagagagagagagaagcaggaggcttgtttttataggctccttctactcagagtttgcctgggggctgcagcctgcctatggcaaaaattaacaaataatacctgcatgcatttattgaggactttacatccatcagaactctctggttccattttcatattaggtctctgttgcttgccccagaaggctgtagggtggggactgttactcccaggaggagagtgaggcagaaggtttgggcactttgcccaaggttccaggcagaatcaggatggaaattccatttcctggtgctgttgtcaaacagccactggatattaaaccccgcacgacagaaagaaagaagcttgagtctacaggaaattggaagatgagactaataaaaagctcttagacatgatctccttcctgaaaatttcctttctctttgacttttaaagaaatctggaagttgggggtgacaggttgggagtgggacgaaggaacatcctcaaccctcagggagctgtttatgttctggggaggcaggagagggaggaagcatagatatctggagagaagagagaaatgtgaccaggattgaggcccatctcaccagcacagtgactttttttttttattttgcaaagctggatatggcctctctgaacaaggtttgcttctatgattctgggacaaattctggaaatgtaagagatggaaatggttgtaggtggaatttaatccaatccacctcacattcctcttgaggaaacaaagctcagggagtttcggccatttccccagagtgattccaaccttgtaacatatattaaaggccttaaccccaagaacaatgggagctcatgaaggcatgtcacaatagagacatgatcagaagtcagtctacttggtcactttctactccatcgtgcttctgccaaaattaaggaatggcttctttctgaagttcaggtgaaactgatgatttatcggtgctgcagagagaaaggcaaggaaatgagaagaatagatgataaactcccgtgagagaaaaacgacagtgagaggctagtgtgagagccaagtggcacacattcccagtcactgtagctgacggcctgaaaatgacaaggaaggcaaatgtctggagaggcagcaagggatggaggcatgagtggagttgggtaaaaccatccaaaggagactcagagcttcaaggagtgtttcagaggaagcaacgcccaacagtactggcatttggagtctacagtaaggatcgagaacaaccccactcctcagtattaccctcagtgaacatctattcaaaatctattcagtttattgagcacctcctatgcttcgccctgtagattcagcagcataacatccaagccagcctagaccctgcccttgtagagcatacagtcaagtggaggatacagacattaaacatggagcgatttaatgacaagaggagagagcaccaacaaggaagacacagagtggtctgactgagccagggcaatgggcaatgggagtggaggaggcttccctggagaggtcacatttaagaggcacttaatgaacatggggatctttgctagcaatgcaaggcaagaacagtgttccagcagagaaaaagcatctggaaaagccttgggtatgagggactcagctcatgaccactggacagtaggtcatggtggctggaacataggaagggaaggggaagggggctggccatgaccttccccatgaaagatgccacactgacctcagagcaatgggaactcattaaagacacaaccaaatttgagcttttcaaaaaccataccagcttcagggtacagaatggtttgtcgtgtgcgtgagagaatgaagggagaccagtgtaaattctactgaggttaccccagcgaaaagtggttggggctgggtctggtgggcacatgggaggtagaagtgagtaggttcaaggacactttagaagttaggatcaagggaacatgctgagggactggatgtgaggggatacggtggggaggtgtcaactcccaggaggatggttgcagcatgtctgagacagagcgcatttgagctggaaggtctgagcacagcattgggtatattgagtttgagatgcatgaggtcaccaaggagggagccagggcatggaatcaggcatcctctgcaagtaggtgccccatggtaagcagaggcacagggaagaatgaaattgaatagaaagagaatatagtggccgggcgcggtggctcacgtctataatcccaacactttgggaggctgagccaggaggatcacttgagatcaggagttcgagaccaccctggccaatatggcgaaaccctgtctctactaaaaaatacaaaaatttgccgggcatggtggctcatgcctgtagtcccagttacttgggaggctgagccaggagacttacttgaacccaggaggcggaggttgcagtgagccgatatcatgccactgcactccagcctgggtgacagagcgagattccgtctttaaaaaaaaaagaatatagcaagaaatgaaggagaccagccccaaggatgttcagtgtctggtcaggaggtggcaaaggactaaaaagggacagccagggaggtggggaaaccagcagagcctgagatctccaaggccaaggacactggccctggggcgtggggaatgacaaacactaggaggtgcccaggggatgtcacaggatggcctcagagggctcgtcgctgacccctccacccagggcgacaatgcctaaccacccctgaaataaacaagccagccaagggcctgcatcctcatgacatgcgcacttcccacactttccagtgcttctgttttatatcaataaaaatgcacaacgaacacacacacaaactatcacctgcgcttctcgcaggtctcataaggaattcatcccacccaagatttccacttcctgaataaattaagcatgttttctttggtggcttttgttaaaaatcctgagtatttattcactcatttattcacaaacgatttattgggcacctaatatgtgtcaggtaccattctgagcaattagaatacctcattgaacaaaagagataaaggtatttcctactgaggactttacattccagatctggaggcagagatggcataggaaagggtgataagcgctatggagaaagaaaaaataggataaagaggactagaagtgctggtcaggaaggaggagttatgattgcattttacacagagtggtcagggagaaagagacgttgggtaaaaatagggctcatttaatgttggacttctccctctcactacacaggcgaagcaaaagaacagaaaagtccagaagcacctggaagattccatccacaagatttatgatggactcatccacaaaactgggcacaaaactcaggaagggggaccagaaagctctccaagatgcaaacctgactttgcgacaaaacacgacaatgatgaaataggaaacctgcacacaaagtctccaaaggtcagggttttaagcggccttaaccaaagctggacaaacaacacacgatcaagcaaaaactctacaagtggtgacaagcctcaaatcacagaaacttaccaagtaagccaaacagatgacagcaaaagcagcctctgagtctcatccaaatgcagtggtgaagggagagagacctgctgctcatagccaaagagggcgctggcatgcaacagaaaaggagaaagcccttggcttcctgctctcctggctgtttctcatggatataaaaagggagattctgcttccaaggagaagctgcctcctctcaatggatttgtgtctcctgaccacatcagttccacttggccaacatcagagctgccctgtatggcctgttgagcaccacagggaaaagtagtgatgcccgaagactagagatggaaagcagcaccagatcgcaaaggggaagaagccgcacaacaatgagtagaaggtggaaggaactggcttcttcacaatgctgctgaacggctgactcgcccaccctggaccacctcccctgtgtctcctgttatgagcaggccattgagtgtttagttgggagctttcctttcttttcttttctttttttttttttttgagacagagtctcactctgtcacccaggctggagtgcaatggtgtgatctcggctcactgcaacctccacctcccaggttcaagcaattctcctgcctcagcctcccaagtagctgggactacagacacacaccaccacagccaactaaatttttttgtatttttagtagagacaaggtttcaccatgttggccagactggtctcgaactcccggcctcaggtgatctgcctgcctcggccttccaaagtgctgagattataggtgagagctactgtgcccagccaaggaggttttcctaaccattagatagaaatgcactggtgggggttatagacaacagaatcccctctaccaggtttcaggagtgaatgatttattacaggacaaagatagcatgcaggaggagaaaggtagctgaagacgtgggccatgacagagagatggatgagactgttgctgagtttattaagaggatcatctcaaacatcctcatggctgggtgtgatggctcactcctgtaatcccagcactttgggaggccaaggcaggaagatcatttgagccctggagttcaaggccagcctgggcaacatagtgagaccccatctctacaaaaaataaaattagccaggcgtggtggcacatgctgtagacccagctactcaggaggctgaggtgagaggatcgatagagcccggaaggtcgaggttgcagtgagctgagatcacaccactgcactccaggctgagtgacagaacaagaccctgtcgaaagaaaagaaaagaaaagaaaagaaaagaaaagaaaagaaaagaaaagaaaagaaaagaaaagaaaagaaaagaaagaaagaaagaaagcaggcaagctggcaggcaggcaggcaggcaagaaaggcaagaaaggcagaaagagagagagacagagagaaagagagaaagagagagagagaaataaagagagaaagagagaaagaaaagaaagagaaagaaagaaagaaagagaaaggaaagaaagagagagaaataaagagagaaagagaaagaaaagagagagagagaaagaaaggaaagaaagaaagaaagaaagaaagaaagaaagaaagaaagaaagaaagaaagaaagaaagaaagaaagaaagaaagaaagaaaagagagaaagaggaaccccatgacggaaatgacaacaatcctaaagcctgggattttttgtctgaaaatcaactgcagactttaaatttccggcagagaaaggactctctcgttcagcacttggttctgctgtgtgagaagcatgcaaatatccctatgacgcagccctttgagacacagtttatactcaatttcatcagcacaagaaagtttgggatgcttttcagacgagtaaaggaccaggtgaagatgctgacctttttgatatgaaacaacttaaaaattcatttaagaaaattcctcaggccgggcgcggtggctcgtgcctataatcccaacacttcaggaggcagaggcaggtggatcacgaggtcatgagttcaagatcagcctggccaagatggtgaaaccccgtctctactaaaaaaatacaaaaattagccaggtgcagtggcaggtacctgtaatcccagctactcgggaggctgaggcagaagaatcacttgaacccaggggcggaggttgcagtgagctgagattacaccactgcatgccagcctgggcaacagagtgagactccgtctcagaaaaaaaaaaaaaaagaaagaaaagaaaaaaaagaaaattctgcagtaagcatttacaaatgtgacagctttagagacattgaggggaatgcagtctggattagaattgcctggggaacacagtacacaaatccaagtcagtacatacaaacctaccacctttctttttctctccttccttccttcctgcctgcctgcctgccttttccttcctttctctttttttcccagactgcatgtgccttcactttttcctccaagctgaggtgcaatagaccgcttctgggtcaggcactgataattgctagcagacagcatcagactgtgaaaatggatctgagaagctgacatctggactcccaagcctattgcttttaaacagtatgatcagatctttgaagctgtcacaactcgacgacacctctataggaaagaagccttgggctggatataaatatggattctagaattattcatgaaaacatagtagaaaaaggaagagtccaaggaataactcaaaaagctgttggggacgatcctcaaccacaactagaatttgcacaattgaagcttgaaaggaaattcaaaagtgatttaaatgggaccatcttggctgagaaggaagaatccccttcagtgagtaataaagttctcttgctcacgtcttttggaagcaatgaaatccttaacccccgccagccttgcagatagaccgctttctccaccactcacttgcatatccagcaagggaatgagttattttaaaattagagataaatgagacgtgggtggttttgtatgcacaggagctccttcactgtatggtacatgcgtttcagttcatggctagctatatggcttctgtttatacactagtactttagaagttaacccttggtattgaaatttcagaaatgttcatgtaatttttgggactgactcattcctccatgatatgcctcctctctcccatatctgctaattgtcacagttgcgagcacttgagatgcaggatatagacgtggctgcacacttgaccttgagtgcctgcatgctctgaggtcaagcatacggcgcagtgctggagacggtgggagtcgtgtcctgcatcctttctcccactcctgtcctctttgatcctggggaggtctggttccaattgctgcgtttccagagactcattcttaagtctcggatcacagaaagaagcaacaagaaactatatccaactcaaaactttttaggagaatcataaaagtggtccattcagagggtagagttgggtccactacgttattgttgcaagaggctgcatattcagtaaatgggttgtgtaaaataatgttctcttttttttttttttttttttttgagatggagtttcactcttattgcccaggctggagtgcaatggcgcgatctcagctcaccgcaacctccgcctcccaggttcaagtgattctcctgcttcaccctccctagcagctggaattacaggcatgtgccaccacacctggctaattttgtatttttagtagagacagggtttctccatgttggtcaggctggtctcaaactcccgacctcaggtgatccaccctcctcggcctcccaaagtgctgggattacaggcgtgaaccactgcacccagccaataatgttctcattgttaatatgatactttttatcatctgtttttatcatatgtgttacattaaactgataaatagcaatattataacgacttgtgaatagagataatgaaaagctgatcaaagaaaaaaaaaagataacataccaaatcgaatgctgaagaaagagacccccagtgccataccatagatctaatgcagtgaggggcagccgctctggccccatctggaggcagctgaatcaggacgcctctgccacagctgtcagcccctgcccctgcccctccaccgcaatctgccccagccatgggaactgtttgggatcaaagccttgagtgggtgcctatgatccctggacctaaatcatatgtttgcacctcaaaaacaaggatggttgtgaaatggaatatttggagactcattagaaggcaggaggtacactgtggggaactatcaaactgtgaagagggtgctgaagatttgaggagctacaaatggcagaggtccaccacagcacactcactgactcagccaacacatgaaaaaacaaaagcgaggttaaggtacgccaccggagcgctgctgcaggaggaatgcggcacactgcattcttgcctcctttgttggacaatgggagaaaacaatgcgtggtactagaaaaatcagaaaaggatgttgctgttcactgacaaagtgatttccccggagggaccccaccacgacagcagccacatccatgggccacagcttggaaagtgtccaggccacgccctctggggaaatcctagcactcctcttgtctgtctctccctctcagggaccacagctctgcgctgtctgatggcaagagtttcgctttgttgtttttttcctcatctattttgtcctgtgttaattatgtcaggtgaaaggataaacgccgtccctgctactccatctcatctggaagcagaaaagcagtgcaatgaccctaagagtcacagggaggataagggtggctttcaccaccccagcccagccacctctgactctacctggaacctctcctgacctgcccccaactcttcccaaggagaggcttcctccctctctggtcctctcgcagaccccccgctgcattctgagccactcctcttccctcagctcccactcacctcccacatcccctccatccccctcaccacggccccactgcattttagtgtctgctgtggttgaccccagatgtctgcaccagcctgtctcatctgaacacgctcccctctccagctgcccatccatcactgcccccttcatgccatactgaagacagtgccttgttcatgtgggtgacatttatgtatctgcatagcgtgggttcttttttctgctctgataaggacccagcatgtagaaatggaattcatttcccatacataaactcaggcactaaccagactgcatggcccaataaatataattcagaattaggagccgcaggagcacagcccttcctcacttgaccatcctatcaccaaaaggcccaccaaggaggaagccttaccacacactcaatctctattgacagcaatcaaaatgcttagcaacttctctaagagactctaagagagaaatggccctagattaatcaacgaccatacatacatttaagcttcttaataaattgtcctataaattccacacattatttctaatgaaaaaattaaaattcctcatacttatgtaaccatttaccaaaacactctcccataagttatggtggtaattcctcaaaaccgccatgaaatagctaagcgactggccttttttacaacagacataaacaaattccaatgtattaacaatttaagatggtgactgatatggttttgctctatctccacccaaatctcatcttgaattgttgctctcacaatccccacatgtcatgggagggacccagtgggaggtaattgaaccatgggggtgggtttttcccgtgctgttctcgtgatagtgaataagtctcacgagatcggatggtttcataaagggcagttcccctgcacacaccatataagacgtgcctttgcttcttcgccttcagccatgattgtgagggctccccagccatgtggaattgtgagtctattaaaacacctttataaattacccagtctcgggtgtgtccttagagcagcgtgagaacggactaatcacagtaattgttaagcacaagtcccttaagcacgtatgtcctttgatgtggcgtgcacgttcagcatcatttctgccctgtggcaaggatgctcgcattttgctctttagaccttctcccactagagggcgcgctaagccaacctaggccggtccgatcgccgccatcagtgcctgacacatacctggcaaagcctgagcggttttcagacccatcatgcatcagccaggcctcccaccaaccccaggagttgctcccacactgtgcaggggtttggctgcattggcacggggaccaagtattcctgaattcatatttggagcccagttttttataattacatcccggaacaacgttatattttgatcacccctttctccctaggcgttctccagtcctcaaagcccttctacctaaaacgaaggaacacatccattttccttttctctcacagatctatgaggggaagaggaatggagggctggtaaagaccacagccatgttctctccggggtgttcacagccatgaacaccccaccaggcctaagctgtcacagagacaggcctttgtggtctagaagtccccacacagcctgcctgctgcagacattcctcagcttcctttgaggaagaagaggtagccatttccagaggaggaaacaagaaagaacggaagactctcttagcccagaattctctttcccagacccattctgccataactcaaatgccacatggcccccagtagcccacacctcccactgcaatggtccacgcatcccagttcaaggatccatgcctcccagggcaataacctgcacctcccagtgctatggtccgcacctcccagggcaatagtccacacctcccagtgcagtggccacacctcccagtgcagtggtccacacctcccagggcaatgagctgcacctcccagtgcaatggtccatgcttcctcgtgcaatggtccacacctctcattgcaatgatccacacctcccagggcaatgagctgcacctcccagccaatggtccacgtctcccagtgcagtgagccatggttcccaccaatggtccatgcttcccagtgccactgagccgtacctcccagtcccaatgctcaataactcccagtcctaatgggccatgccttccagtaccaatgggccatacctcccagtgccaatggcccatgcctcccaatgccaatgagtcacacctcccaatgccaaaatcagccacacctctgtgtgagttccctctcacattgagtctggacattaccatgtttttccttttccatccatttactttcaatgtatctgtgtcatatttaaagtgtatctttgtaaatactgtatggtttggtcttgcttttttatccagtctggcaatctctatcttgaattcatatcataccactttacatctaatgtaagaaactctggtagcccaaccccagcctcttgcattgctataattaaaggattcttaccttttcttcatgtttggaagctggggagtggctactgtttcagacagtttggattcacctttaggttcaccttctgcagggctccagaacccaagcctcacagagatgtgtaaggctgtctgtattctccctgctaccaaccccttctccaatgccactttcccagcaaaattccaggtaaggaagagagttgttgggctgagagatggatatttgcatttggaactcctccagagccacatgttgcccctgacgcaggatgctccttcttaaccctgcaaagcctcctgcctgtaggcagctgctacttttcccacctgaactcattcaggcacttgccccagagagctccagggtctctgctcatctagagggcgcgccctctgcaattcagttcatcagagcttccttacatcttccaatctttgaaagccccatgaacgtacgattcttatgtggttcattcttgtcatcaccacaggaggaaagttttcacgtctttctacatcctaacgagaagcaggtgacctaatcttgtttacgccattgatatttgtgcttttgttatatacagaaaagcttaatttccgggttcataatgtagaaaagccaagcacaacttatattgaagcagctgctgaccatctgtggtcagatgtgattatccagccatcacaatgtttaaaaatttgaatttgaaaacattcatattgaatccaagatctccagtttattgacaatgccccatactttctattattatttatccactaactccttatatttacattttcttctggcccttactgacatttgagtgtgagacatttcataccatcaatgaaaactgagaaattctgtgcattttacctagtaatcatgtccactttacactaaaatacatacatgagggtaatttatctgctttctacccagatattttgcatctcatcgcaaagttcccataactgcattcatttttttgcgccccaatttctactaagaaaaccattctctatgaaagtcagatgctacagttcactaatgcaggattatctcatctacctgccccagaaggtgggttctatagtttacctttagagatgagaacaaacttgaaacaacataaagcatcttgcaactctggctaatttttttctcctccttatactcacaaaagctttctagttcacggtatttcttctgtccttggcacgtgacaaagacttgaggccaaagtctgcatgtgatgtcagcctccgtgaaagactcatatctcttctgctctccatcaataggggagggggcacagaggtatctggggagtgtctggcgtttagcatctttgtacagagccagtctcagtggatgtagcctcaggactgtgcagagaaaatcacctggattattcagaagggcattaaggacagcagtggaaaccaatggtgcctacataagtcagattctccctcttgtaactccagaataggaccaaatctcccctcactcactcaaagcccaaacaatagctcatggagaaaagaacaaccaactcttacacaattgggaaaaaacaggttctctatgcacacaagagactattaagcagaagccacattagactgtccatttcctctttgcaccggggaagtgagtagggcagtctgcagaggaagaaagtacaaaatagcaaaatgctttgctttgctttttaaaacttttttcttttgaattcattgtagactgacacatacagttataagaaacactagagagactcccatacacccttcacccagtttccccaatggtgaaaacttgcaggactatatagtacaatatcaccagcaggggagggtcactgaagtctctgggtagtgtctggcctcaaccacaaaattgccattgatacaatcctttcgtctattgatatttcaccacttttacatgcactccagtatgtgtgtgtgtctatgcagttttattatgtgtagatttgtatgaccaccaccaccacagataacacagtacaaggaatcctcatgctatttctttcatagccacagccatccctctccctaccctcttccctaaactggcagctacaaatctgttctcgacctccataaatttgtcacttcaataatgctacataaatggaatcatgcagcatataaccctcaaagatttttttactcagaataattcccttgatatccacccaagtcgtttctttttttgctgatcagtattccatgctttcttaaaataagagagggatgtcttatattctcttagaattccaaggattgtcagaacgttattaatgttattctctattctcataacttttaggtataatagtgaacaaataaaagagaaaagaagtgtacatgaagttatcacatactctcaggttgcatttttcttcctaattttttggtaccttattttttatataaatgcagctttcagggtaaacactccctctgttgaagaaagtttgctaacagtaatggcctctagacactcaaaatttaatggcaaaataaaattactctcttgaacctctggttatggacaagatggagtagataaatttctctctattcctccttctaagtgctgcgaaaacactggacattatatatgaagcatgaaagactttgaaatatggaaagaagacaaactgaataaggatcccaggacataagaaatgaatgacatggttataagttctctgattggcttcttttttttagacagagtctcactcactccgtcatccaggctggagcacagcagtggtgtgatctcagctcactccaatctccacctcctgaattcaagcgattctcctgcctcagcctcccaaatagctgagattacaggtgcctgccaccatgcctggctaatgtttgtatctatagtagagatggggtttcaccatgttggccaggctggtcttgaactcctgacctcaagtgatcagcccaccttggcctcccaaagtgctgggattacaggtgtgagccattgtgcctggcctctttttggcttcttatgtctcaaactgggtgccagagaagcagcaacctagaaataccaacaggcacagccaaaaaaaaaaaaaggccccaagaaaagcttccccagccaaaggaccagaaaaaagtcagcctaacaaggcagaaaacttctgtctacaacataagcacccccagccaaacaccatgaaaaaaatgtgactccagccccacacttgttagcaaaggctgagtggagaatctagacttgcatcctctcctggctgcaacaaagcaccctacccatcccacgccagccagaatggtgttggacaaaaccagatgagatccaggaatttcattcatgcctggcattaatgaagcatgcccttccccctcagtagtgttggtgaaagctacatggaaatcttagactctgacctctacctagcagtaacaaggaaccccttcccagcataggtgtcaatggtgccaaatgggtaacctggacttccactcccatctggcactaagaaggcaatgcccttttcccctctgccaacacaatgtcaaagaacactcgctaaaatagaaaagcttcagtgagcaattatgaaaatgcttgaaacaaatgaaagaataaaaacgtctcagcaaaaaagatattgaaaagaaccacatagaaattttagaattgaaaaaaatacaataaacagaataaatattttagcaatatggctgaagaacagaaacaagaggatagagaaaagaatcaatggacttgaatatagaaaaatagaaggtacccaatctgagccagaaaaagaatatatactaaggcagggggaaagagcttcagggatccatgggactatttttataaggtctagcatttgcatgatcaaaaaccaagaaaaagaggagaaagagtatggggcttaaaaagtattcaaagaaacaatggttgaaaaatgacaaatttgacaaaaagctacagattcgagtagctgagcaaattccaaatcccaaactcaaaagaatccgtgctaagacatattataatcacaattctgaaactaaaggaagaaatcttgaaaacattgaaatgacattttacctataagaggaaaacaattcaaatgacaatgtgtttctcatcagaaacaacagagactagaggtgacagatttttttcaagtaatgaaagaaaagacctgtcaacccctaattctatatctagcacaaatatcctttaggaatgcagggaaaatcaacatattgtcaaataaaggaaaacaaacaggatttattgccaacagacctaccctaaaagaataactaaggaaatttcttgagatggataggaaatgatgatagaaagaatcttctagtagcagaaaggaagaaaggacaaaaagagaaaaaatatgggtaaatatatgctacacttagcttctcaagttttctaaactatgatggttgatgcaaaaattataacattgtctaatatacttctcgagatatagaaagaaactatttaagataattatattatcaatgtgatagggtaaagttatctaaagggagatgaagtttctacactttattcgaactgataaaacatcaactcaaatagactttcctgagttacatgtacaggatgtagcacctagagcaaccactaaaaaattgatacaaggaaatacacttaaaaaacactataagtcaaaatggaattataaaatattttcaagcaatccacaggaaagcaaggaagataaaacagagaaaaaaaagagataaacacacaaataagcacagatagataaaatggcagacttagccttaatatctcatacttatattaaatgtaaattgtctaaatagacctattaaaaaacagaaactggcagagtggattaaaaatcatgacccaactatatgctatccatatgaagttaacttcaaatataagaatataagtaagttcaacatacacggatgagaaaaatatataccatgttactatgtaaccatcagtcaaaacaaagcaggagttgctattaatatcagataaagcagacttcagagcaaaaagattatcagagacataaagggatattacataatgataagagtcaatctaccaggaagacatagcaatcttaaatgtacatgcatcaaataacagagctgcaaaatatgtaaagcaaaaactgatagaaccaaaaggagaaagagagaaatcacattatagttggaaatttcaacactctctctcaacaactgatagaacaactaggcaaaaccaccaaataaagaaataaaaagtgataataaaaaagaacaactaggcagaaaatcagcaagcatttagaagaacacaaaaacagtgtcaatgaaaagaatataattgagatttgtagaacattgccccagtgacatcagacagcacacattatcttttcaaatgtccacaaaacatttatcaagatagaccatatccagggccataaagcaaatctcaacaaaattaaaattgaaatcatacagagtatattttcataccataatggaatcaaactagaaatcaataacagaaagacatatgaaaaatcttcaaacactttaaaactatacaacacaattataagtaatccatgggtcaaaaagaaagttctcaatttctcagaaaatttttaaaatacatagaactgaatgaaaatgaaactatcacataaaatttgtgaaatgtacccaaagcagtgctaagaggaaaattcacagcattaaatacttacataagaaaagaaaagtctcaaatcaataatctaagtttccacctttaaaaattagaaaaagatcaaaataaaaccaaaacaggccgggcaaggtgcctcacacctataatcccagtgatttgggaggcagaactgggacaactgcttgagtccaggagtttgggatcagactgggcaacatagcaagactccatctctacaaagaataaagaacattagccaggtgtggcagcatgcacctgtagtcctagctactcaggaggatgaggtgggaggattgcttcagtccagtagttcaaggttactgggagctataatcatgcactccagcctggatgacagagcaaaccttgtctctaaaataaataaatataagaaaaccaaaacagaaagaaggaaggaaatagtaaagagcagaaactaatataattgaaaccagaaacacagtagagaatcaatgaaacaaagagttgattattttaaaagattaataaaataaacctctagcaaatctaacaaagaaaacaaagacacaaattatcaatatcatgaatgaaagaggggatatagatatttaaaacattaaatgataataagggaatactataaacaactctacaaacaaatttgtcaacttagatatatgaactacttctttgaaacttacaaactgccacaactcactcaagatgaaatagataatttaagaaattgaatttgtaattgtaaaactcacataaaagaaatctctagattcagataacttccctcgagaattctaacaaatgtttttaaaagtttaaacaccaagtttacaaaatctcttacaaaaaaaaaagtcagggaatacttcctaatttattttatgaaactaatattaacctcataccaaaaccagataaaaacagtattttaaaaattacagaccaatatttgtcatgaagatatatataaaaatctttaacaaaatgtcaacaaataaaattcagcaatatatattttttcttaaccatgactaagttattccagggatataaggctgactcaaaatttgaaaagcaatcagtgtaattcaccatatcaacagactaaggaggaaaaattacatgatcatattaactgatgggaaaaaaaaagcatttgacaagttcttttatgcataaatgaacattcttatctcttttctgctgaagaggaaacttaccaatgaaattgatgccccattctttaatattataatgccttaattcatgtcactaaataaccaacccctctcaagaagtataatagaaaatattatataagtgttcccaaaatacctgcaataataccaagttctttctcaaagccaaaactgtgataattctactttggaaattgtccaagtatttggataagtaaatatccaagtatttcctttaattgcccagctgagatttggtaatgatgatgtgagagagcaagcttactcttctctcgtatatggaagaaagtgaccatgtagtgtataaaggaggctctttgggagaaaggattatagcagacttctctcattaagaactctagccaggccatagctaagtggaaaggcaagacagaggatgcacaagacaaagtatcactccttgagctgggaattgtggcatgggcctatagtcctagctactcaggaggctgaggtgggaggatcacttgaggccaggagttcaaggttacagagtgctaaaattgtatctttgaatctaggttcctgcactccagcctgggcaatgtagtgagagaaagaaaaaagaagagaagagaagaggggaggggaagtgaggagaggggaggggaggggagggaggaggggaagggagggaaggggagggaagaaaggaaaggaaggaaggaaggagagagagatggaaagaaagaaaagaagacagacaaagaaagaaagagaaagaaagaaagaaagaaagaaagaaagaaagaaagaaagaaaaaagaggaagaaagaaagaaaaggaaaggaaggaaggagaaagaaggaaagaaagagaaaggaagaaagaaagaaaggaaggaaggaaggaaggaaggaaggaaggaaggaaggaaggaaggaagaaagagacagggctaggcgtggtggctcacgcctgtaataccagcactctgggagaccaaggcaggcagatcacttgagatcaggagcttgagaccagcctgaccaacatggtgaaaccccatctctactgaaaatacaaaaattagccaagtgtggtggcatgcacctgtagtcccagctactcaggaggctgaggcaggagaattgcttgaataccggaggcagaggttacagtgagccgagatctcaccactgcactccagcctgggtgacagagcgagactccgtctcaaaaaaaaaaaaaaaaaatacagaatgggagaaaatatttgcaagccatataaatgataaagaaattatatttagaatatacaaagacaattaaggcatttactgttatgtaaatatgtttacccaataaaatatctttaaaaattatggctcaataatgagaagacatgggcaaaggataaacattatttgccaactgtgtgatgttattgaaaagatatttcagttaaaaccacagtcttatatggttaaactagaaaataacgataacaccaaacactggcaatgcggagaaaatggatcactcagacactgctggcaggcatgtacaatggcaggaccactctagaacaaagtatggcagcttcttacaaagtcaatgtgcccttatcatatgactgggagcaccactaggcaataaaaatgaattaactattgattcatgcaacaacttggctggatatcgggaattacgctaagtgaaaaacaccaatcccagattatatactggctggttccatttaggtaatactgggggcttttcatttttgttttctttttgttttgagacagcattgctttgtcacccagggtggagtgcagtggtgctgttatagtaggtagctggtcaggtctgagcagggcaggagagagcccctcacaaccccaaaccaggaatgttaggcaaccaccaggtgatggtcaagcagttgttaactgtctctctaaaataataattggttacagccagtgccagagaaaggcagtttcctgataaatagaaaacacctgaacctggtgatcagtagcttcccagtaaaatctcaggagttgaacaagtaggctcacacatgcagactaagaggcaagatggcagagtttaactggtgtatgacctcctaggggcattcagctggtaagggaagaatgcctcaggtgagcatgcatacaactccagtcagcacactgcacatgctcctctcacaagcgctagcaggccactgtgcatgcagacagcccaccccaaagaaagaatcaggggagaaggaacacaaaaccccagaagtatgcctgcataccaaaccccaacaaaccctgcacttttgtccttcaagtcgcccacttgggcctcttccaagtgttctttccttccttttgttccttctctaaagctttttaataaacttttactcctgctctaaaatttgccccagtctcttcttctgccttatgctcttcagtcgaattctttcttttgaggaggcaagaactgaggttgctgcagacccacgtggattcaccaccagtaatagtacaaacatagatcattgcaggcttgacctcctgggctcaagtgattctcccaactcggctctacaagtagcttggactacaggtgcacaccaccacgcctggctaatttttgtattttctgtagagatggggtttcaacatgttgcccaggctggtctcaaacccctgagctcaagtgatccacccaccttgacctcccaaagtgcccggattagaggcgtgagccaccatgcctggtcaatattgttcaaataacaaaattataaggttgtaaagattagtggttgccagggattagggaagatgaagttctaaaaaaagtaataggaagtattcttataatacaactgttctgtaacttggtggtggtcacacaagtgtatacatgagataaaattgcatagaacaaaatgcacacacactagcaagtgtatataagactgatgaaatctgaacaatgtcaatggattgtaccaaactcaatttcctattgtgatattgaactatagttatgcaagttgttaccactggagaaatcttgatgaggggtatctagagcccctctgtgttacttcttacaatcacatgtgaatctatgattatctcaaaatattaaagcttacatttttaaattttaatatgatactaaacacaaataaggcaatagaaataaacaatatttgtaactttgtagtatagatgagaggttaatcaacttttaattttgcatattctcaattttctgctatgtgaatgtaacattttcatttgaaatcattaatggatttgattgaacacaagatgaggccccacgtgaaggtcatgttggggtaagagcaggtgactccagcattcgggctgggacactaacccccttccctgtgaggctcatggccttttccttgagtgccttttataaaccaaagagccattcctcgtggaatgatgtgatgtcatcagtgaatctagaccaacgctctggaatcttggaagcatttggtccctaacacttggctacagccagtgctctttcacactgtcatgggctgcactctgggtaagtgtaagctccgcttcaagggcctggaactccagagagccatgaaggcactcactcagggtggctatcactcattcctgtactagaccaagtctcggatcctgaactatcttctcccaaggagtctcaggggatggggaagggaccacctgtgagtctccagatgaatgattggggatgcagcaggaataaaaacagtttttgaattttgggggaagacaggagaggagggaatgtgggcaaaagagagaaggaaggagggctgacaggagagccaactcccacagagaacctggccatcagtggctgcctcgagagccttgaggagccccagggacaatgggggaggagcaggaagagagcatctgccagacatgaggaggatgcctcagacaggggtaggtgtcaccagccttcttgcagggcatctaggcactgcctcaatcagcttcaagggctattgtaggcaggtctgcgccactctggtcatatttttgggccacgcttgattgcccatgaatttatagtggttcacagggatatttagacacagctgagagcacagaaaataagtatgtcaggtcatcagtttgaccctactggaaatgagactgaggctaagtgtcactgtagcaggacgagctgcagacaaaacccctcagacaccaggttaaagaagggagctcagaagcccacaaatgttaacaaagtctttgaggtcattcaaggaaaagatgagagctcagttcttgagacacaagtcggccaacgctcccagccgaataaagcctcttccttctttaacccggtgtctgaggggttttgtctgcggcttgtcctgctacatttcttggttccctgatccagaagtgaggtgattaatggacagctgagggagccccttaggcagctttggcctgccctgcggagcatccctgtgggggactccagccagcttgagcaatgcagatcctgagagcactgccgggtaggcatttgccctggtggaacgcctcatcacagcagtgcacggcagggccccatggaggatcaatgcagcagctgaacaccgggaaggaactggcacttggagtctggacatctggaatacagtaggaccagtcctgggaatttgcccgctccatttgagtggaagcgtcgcctgatcacccacaatgtgcccttatcagcactttgatctcagtattgattttgatttgacttgacttgattgcaattggcactttgatctcagtattgattttgatttggcttaacttgtttgcaaaaaggaaagtgaaagtgaatgagtgcttgagtttgagacaggcaagatgagtgagtgacccctttagactttccttcttgtggtgtgagtgttgttttgtctcaggaggaagatgggtggaacgcaaagtaagcccactccactaggaactatgttgaaaaatttcaagaaaggatttaatggggactatggagttactatgacaccaggaaaacttagaactttgtgtgagatagactggccagcattagaagtaggttggccatcagaaggaagcctagactggccccttgtttcaaaggtatggcacaaggtaactggtaagccaggacacccagaccagtttccgtacatagacacttggttacagctggttttagaccccctacagtcgttaagaggacaggcagcagcagtactagtagcaaagggacagacagccaaagaagaatcctgctccacccgctgaggggagtcagctcctgaagtcctgtccgacccaacatcagaagattcatggcaagaaacggcaccagtggccccccgtttcaccaagaatgaaggcctcccactcctgaggccactgtgcctgagcttcccaaggcctacatacccctaggccacccagggtagaaaagacaggatgtgagacctcaggagaaacccctcccttggcagcccatttgaggcctagaactgggatacaaatgcccatgagaaagcaacagtatactggggtagatgaggatgggcatatggtggaaaggcatgcctttgtgtacaaacccttcacctctgtcgatctcctcaattggaaaaacaataccccatcctatactgaaaaacaataccccatcctatactgaaaagcctcaagctataattggtttgctccaaactattatccagacccacaaccccacctgagctgattgccaccagttgctcatgtacctctttaacacagatgaaaggagagtgctccaagcagcaactaagtggctggaagaacatgttccagctgattaccaaaacccccaagagtatgtgaggatccaattaccaggaacagacccccagtgggacccaaatgaaagacagggtatgcaaaggctaaaccgatacagggaagcccttctggaagggttaaagaagggagctcagaaggccacaaatgttaacaaagtctctcaggtcattcaaggaaaagatgagagctcagttcttgagacacaagtctgcggacgctcccggccaactgagacctgggaggcgagaccaagcccggacaacacctgcatagtgactctgaagaagacgacaagccctgctccagtcacacttggaagctgactggtccatgcacagctgaagcatgaggatagttagagacatgacaaagctggcacatgtgcccatgcaggtttggcataggcttgatcctggattcccgtttggaaaatggtttccagctctaggaggatttaaaactcttataatacgaataataatagtattaggaacctgcatgttactcccctgtacattacccatatttctccagtcactaagaggctccgttaccaccttagttcatcaaaagacctcagctgtctctcaggaagacctggatagtgaagatgaaagtgagaactcccactagtgagtgaggttctcaaaggggggaatgaggagagaggccatttctcttactgtctcctgtctctgaagagaaggaggaagtaaaagctgaaaaagattaaccccgcactctaaccacatgtgctatctatagatcttaatctatcatgaccctttcacgtggaccccttagagttgtaagcccttaaaagggccaggaactctttcttcagagagctcggttcttgagacgcaagtctgccaatgctcccagctgaatagagcctcttccttctttaacccagtgtctgaggggatgcctcttttcttgtagctcccgcccatccccgccttccccctcccacaacaaagaagcagtgaacttaaatcaacaagcaaaaaacaactccattaaaaagtgggcaaaggacacgcacagacacttctaaaagaagacatacaagcagtcaacaaacacgaaaatattctcaatatcactaatcactaatcatcagagaaatacaaaccaaaaccacaatgaaagaccatctcaccccagttagaatggctattgttttttaaaaaaacaatgacacatgctgggaaggctgcagagaaaagggatcacttacacactgctggtgagagtgtcaattagttcagccactgtggaaagcagtgtggagatttctcagagaacgtaaaagagaactgccatgtgacccagcaatcccattactgagtatatctatctaacagaaaataaactgttctatcaaaaagacacgtgcactcacgtgttcatcccagcactattcacaatagcagagacatggaatcaacccaggggctcaccaccagtggattggataaacaatcaccagcctgatgagcagcagggcaggttttcatttcctcagtccaggctttctctgaacttatgtaaggttgtactgaaagcatagtgagacccactgctgcagctttgagattggtgccacccaggtgagtttgttcaggggttaggaaattgcaaagaaattctggcattttagagaacaactgaggatttgagaatggaaaagtgaacagcactgggagctcagaggaggtaaccagagggctagaaattctagaagcaaagcctagtccctgagtggcagtgggtggttttggtgggactcgaggatggggacgactttacatctgagcattgcatccctcaaggggtcatggattttgctcagagatccaaacaggaaaatgaaggaagcagaggacagagaagctcctgtaaacttccagaaactcaggagtggtgacacctgccacagctggtattagcttcctgcagtcaggagtatgccatctgccctgtgtctgctgtagccagtgcaggagagtaaaggcttcacctcctcctctatcctccaggccctgcatgggcatctcccactggaagactctcatctgacactacatagggaaaacagctggaagctaaggaaagacaaaaggaggcactgaagacgccaagctgactgacattcagcccacacatggggcacagtgagatgaaccacaaatgaattagtgcaacagagcggggagtttggagggaagtgacactggagacagcacctacaccctgctctgtggatttgcagaaatttgcacagaacatggagtgagaaaggtttgacctcatcttctctagatccaacggggcaggcagatggcagctagggatgctaaccatgatggatttgctaacgcatcttccttcaactttagagttgcatacatttacccacatttccagctgatgaaactgccctaatttctgaattggtacagtaagcagcacttacaatattcttattttttgagatggagtcttgctctgtcacccaggctgaagtgcaatggcacgatctcggctcactgcaatctctgcctccctggttcaagtgattctcctgccttagcctcccgagtagctgggattacaggcatgtgccaccacacctggctaatttatatatatatatacacacacacacacacacacacacacatatatatatatgtatatatatatacgtgtatatatatatatatatatatatattttttttttttttttttttttttttagtagagacggggttttgccatgttggccaggctggtcccaaactcctgaactcaggtgatccgcccaccttggccttccaaagtgctgggattacaggcgtgagccaccacgcctggtctaaaatattcttgatatgcacaaaaacgaacgtaagacaaatgaaagaaacacgagtggcaccaactagcttccaacctccatccttatgttaagctcccctaatgagctagtgtgcctgagttcttaaagcacatggcctacagcatcacaaggaagagtgcctgagtgtgacagatcccttaactacagagacaaggcaagcactgagaattaagactttccagttatttatatattttattgaatttagtataaaaattttattttaggctgggtgcagtggctcatacctgtaatcctagcactttgggaggccaaggcaggagaatcacctgaggccaggagtctgagaccagacggcaccatagcaatacttcatctctacaaaaattttaaaaatttagctgggtgtggtggtatgcacctgtagtcccatttactcaggaggctgaggcaggaggatcgcttgaacccagaaagttgagcctgcagtgagctggagtgagctatggtcatgtcactgacaccagcctgggcaacagagggagactctgcttcaatcaatcaataacttattttaagatttcatgtaataatgtaccatatgaaataggaataaatctttttagctatgagaaaaaaatgtagattaaggtggttgttataatgtgaccaagaaagcaacacatagattaattcagttaatcaaattccaattacacaaagcctttgcttttccaaaggtgtaaagaagagttagtatgtctgcttctcaaatgtgttcataaactcttcctggtgccaagtccttttaacttacatttaatcactgctttctcctaagagtctgctggactgggaatgcaggcagtactggacccggttcagggtggagtataggaagtgtggttgaaagtcagcttcattagggttgtgatgggtgctttggggcagtcaacctccctccctgagccacagggatctcactgtaggaggggcaggaccggtgccatctaagggatctgtcagcaccaacatttgatgcaggtgtctgatcagtgggtctccttgcctgaagcctgaaggtcctgactgccccaagcagcccctactgcccattccagcttccctttcacccaaagacataagatagaggatgttgggcaggcaagtccatccttatccacaggtaagagttaaggacacagctgtagaggctttttatttaaattttttttctgcagcttgtgacgtaatgagaagcaaccaatctatttcagagaggggggaacccgggcagcccttggaagcaggaaaaggccaccacttgggaacctttgtacactagcgtggatatctgtggggtgctcgtgggcgctgagaggcagccagcccagttacaccgtccagagtggccacctctcccacctcacctctgcttctttcccctggtggctggaggtagcatgcgctaaggatacagaggggatcagattctgtgtcctcccccacagcttaattggggtgatcctcacacagtgagacattcccccccaatttgatcagcatgaggatgggagaccacagaagagaggccttcaaccccacatgcgggaggcaacgaagtcttcctggtttggattttcacatgctctggcttctactccaaatcctggcccacactctgacccatctgcccacaggcaccctggcctcccatcaagtgggtgtgcacagatcatcaggctgagagatgaaagacccccaccttattgcttcctctgggatgtcaggagaccccctgagctgagacatgccccttaccatgagctgtggagtcagctagttactagacaaagggtgagaaaatggccttattcaaggaagactgggcggcacacggcgaggttctgtagggtttcaacctgagtctcctgctaggtccttcagaagacctgcaagggaggaacgcagatgtcagcgtctactggggaaagaaccaccactctgagtgtatgtgtaaattgtatggtttctttaattatgtctatggaagcgatgatacctatttctatctatctaagtagaaaagatgggcatagggaattagtaagttaggaaccatgatgtaactggcataagatcctcaccagcgtctgcctctcctcccagtcctgggcacatgaggtagagcagtgtgactacttcgggccaacaggctttaacaggaaatgatgtgtgctattttggggccaaaacacttaacagccaaatgtttttctgcagcacttccctttgagccacggctctaaggaggctgcaggttctggatggtgagagccataccctcaggattttttgaggccccaaaaatagctgcaattgatttatttgatgatccagcaggcctactcaagggctgacttcccagcctcccctttgctccctgctagctaatcagacggcctaaaaatgctgcttccagactatctgcagtctttctgtcctctctcttttaaagctgatatttgctttcatcgacaatgttctaaaagctgttctcccttaggtatgagttaatatgtgtgcaaacaactaatgtctctccagtcattctttattcaggaaaagcacacaatcgtaaacaacggagagtgaagacagtaacaactggtttgatattgaatttttaaaatcttgattcaaatggaattttcataatctaccacttaaaatttatttttaattagaagaaaactatgtaactgtgaagagaagcacatttcagcctctcagtcagccccatcgtgcctctgcttcacatccaggaagaagcgagtcctcggggcagccacgcaaatgcaaggacagagagtccagagaataccacttggcctccaggtgcatgccttccaagtctactctgcagacgcaaatgtcatgtgggtttttgccaaaatctcaatggaaacatttctatttgctttaatttatttttaaagtcaaacaccacagttcaggatgtggaagaaatatgaagtcagtggatgaaggtcttgcttctaccagcttatgatcccactggccatccaggaagcacaggacacatatcagcatctgaacagcagggagcattcttcctcctgtgttggcaactcgaagctggaggtgcctttatatgaacatttttcatcatcatctagtccagaaatccctccttttatagacatacattctgtaaatcttaggtaaatatggattgtcttgtttttaaatacaatttctaaagagccctctgtagtaatttcttattttatctatttagagcaggcttcacgtattagtctgcctgggctgccataacaaaataccacagactgggtggtttcaacgacggaaatgtattttcttgcaattctggaggctggaggtccacgatgaaggtgctagccaagtctgttcctgataagggctcttcttggcttgcagacggccgactcctcactgtcttcacatggcagagagagaaagaaaaatctctcttcctctgcttaggaggccaccaattctactgaattaaggccccacccttatgatgacctcacttaaccttagtaatctcctatatgccctattgcctaatacagtcacacagggattagggcctcaatatataattctgggaggacacaattcagtccacagtacttcatgttgagcaactgagggcaaaaatctccttctcctgtttaaggtgatcacatcataagagtgtctggcattgtcaccagaagtacaaacttattttagacaggacaactgtgacatctgaggaaatgctaaagcgctcttttgccacagaaagtaaaactttatgacatagcttcttttaaaacttggcatttttgggcatagtcacttcacctataccaccacagttcaaagactttaaaaatcaatattcactccagcaacccctgctctattctctaagtccaaaactaaagcaatcatcaagagttttggaaacaaaccaaaaactttatttacaaaagtaaattttaacttgcttttatatgtcatataccgttaatgatgacagcaacagatttaaaatacattgaggtttgtgcagctcatttccccctagttataccataaaactttataaacattgctttagctttgatgtttggtcacgtttgttgtgcagaagtcacgtttcagggtaggttcaccgccagacacggtcacatcaccattggctgtggatttccaagaagcaaaggagccaatctcagcaaagctcgcactggcatttttagctgcttaaatttgaagagcagttcagcaaagcttgtgctccctaaaatggaaatggggtgggaaggtcacatctctaaataaattcagccatacctctcctttcaaggaagcttcagaaacacaatcatgtttaaaacaggcatttttccctttgaaaatgactatgcaaagacaatatttaaaattatgaaattccttaatacactgtaatgtaaattgagtatcccttttccaaaatgcttctgaagagaggtgttttggattctggatttttttagattttggaatatctgcattacacctactggctttctttttttttttttttttttggagacgaagtctcactttgccaccggggctggagtgcagtggcgctctctcggctcactgcaaactccacctcctgggttcacccattctcctgcctcagccccccgagtagctgggactacaggtgcccaccaccacgcccagctaattttttttgtatttttagtagagatggggtttcaacgtgttagccaggatggtctcgatctcctgacctcgtgatccgcccgcctcggcctcccaaagtgctgggattacaggcgtgagccactgcgcccagcctcggctgagcattcttaatccaaaaatcccaaatccaaaatgctgtaatgaacatttcctctgagcatcatgttggtgctcaaaacgttttcgatttcaaacacttcagatttcagattaaggatactcaaacctgtatatgatttgatagaatttacccattctagacttcagaaagtgacctataactacatgtgaaactactaatattgtttaattttatatatatatatatatatatatatataaattctttaaatataatgtgcaaaagtgcctgtctaccttcaaatactatctaagtggtattttactggttctaatacagttgaccattgaacaaccctgtttgtccagcctggcctgaaaagaagtctatacttttaaaatgtcttccttttccttttagtagtttgactattaatgtgactaggtatggttttctttgtatttatcctgcttagggttcactgtgggttaatatttaacacaatttttcaaaattcttagcttctgtctcttcaaatattgcttctaactcattttttctctcctcttattctcttattccaaccccatgcatgtttatttttttttcacggtttccacatgtctcttgtactcttctctgtatttcctaaccattcttccctctgtgcttcagtttgtttactttctacttgtcttccagcagataagtgtcttccagttcacttcaaataatccagtactgagatcttcatttcagttactatatttttcagttctagaatttccatttaactcttttttattgaccccaggtttctggtgaaattccctatcattccttctattttcctggaaacattagacatagttattttaagttccagtatgataactccaatatctgaatcacacataagtctgtttctattatctgtttttttattattattatgtttcgtaatttttgattcaacactgaatcctgtagactaaaaattgcgggggctctgggtatgttttctttctcctatgaaggttacattttcttctgtcaggtggggagaaagcacacagatcaccttagttctgctctaggctaattgtaggtcaagtctgcttggagtgaaactgaagcagaccagatctaaaattaggctagagcaggcttagggcttggccatgtattaattcacctgaggagctgggatgctgatcagagccacttcactttaacaagcgttgaattccaccctttgtctcctcagtcctatgctgctgctgacatttttgcttacatttttggccttgtggcttctgctagatctcttgaagtcttatcccatgtatatgaaggctaaaatatcattaagtaactcaagggaaaggtatatccagagtctgagttatgatttctattgttctctcctgcctgagactgtgttcctcaagttctaggctcttgggcaatcacaaacccaacctctggctcctcagccctgcagcattgctgctttttgctggcactctacttcttgtactatgaactggcaaatgcctttgggggagaagctagggtgaatataaagctctccctgttgtacttcccttttcttattttttttttttagcttttatatttgtttttgagggcaagtgagtccaatacaagcaattccatcatggccataaccagaagtctctagatagtaaacttttatcagaggcttgcaaaacagcaaaaaactagtaatgtaattaaacttcaagtttaaatgattaaatggaacaatctttgcccttatcaaaaaatattttttttgagaatctcaaaaaaattgggtgcttagaattcatcatatcttagtattcagcttaatggataaattttttttatctgtttctatattctgaaaaatacaatcaggtgataatactattaatttttaaaactattataaaaaaattcaaacacaaaattaggtatttattagttgtaaagctttgtaatattagaaattaagattatatgtgattctaaaaaacccaactgaaaacctagaaaataaagaaaaatagctttaataaaaaaatcaattagtaaagaataatatggaatatttagtttattagtatagatcagtgtttggggctctgtgaagaagaatccatccttttctgaataaaaatgaaagttattcatatataaagttgataattttttcttttttgctccaaaacagtccctaacaatgacactgcaacattaatgaagaggaaagtcaaactaggggcagtaactactgagaaactagaacataaaggggtaggtaacagagttactgaagataagacttagatatgcaattaccttctagtcctataggtggcaggtgctgtggagctggcacagagtggtagacgaggaagcaggccagcatgctcagctgtgattcctccaagggctgcccgctgaggtaggcgtgcacacacatatcacccccgactgtgagagaaacaaatggaacggaaccaactgatgacagaactgagaggcacaagaaatatcttctattactttttcatcaagaacttattgaacgctcagcatatataaagcaggttctatagccggtattgaggctactctgacaagctagactgagtccctgtcattgtagagtttagagtgttgttgggggagacagatattacacaaataatgacacaaacaaatgcataattacaaattgtgaggagtgctataaaggtgcagtggtcactgtggttgtctccccgaaataccccttgtcacaccctaccctccaccatatattatatttgatgggactgacttcagctccagaactagatccttactagtcttggccaggggtcctcaaactttaacatgtgccagaatcacctggaaggcttgttaaaccacagatgagtgggccccactccatgcacagagcacagagattcttattcagtaggtctggggtggggccagaaaaactccatttctaacaagtgcccaggtcatgctgctccataaaccacactttgagaatcactgatcttgggtgatcaaggcaatcccattctcctgatgcagtgttagttcagagacaggcagacccaggccattttttcaataagagacattctctgccacagggatagattgagaggtgtgcatgagatgcaactcgagccagaaacctgaggaggtacttaatgacaagcttgctggaggctccagggaaagaaattccctcattctcatcacaaaactcctagaagcaactctattcttcctctgagtatcatgctgagctagaggtgaacatgttacagccatttgattaccatccgaaaaatgcactgaggataaagtcatggcacagaatgtagctgatggaacctcagagaaatggagttgaagacactggaaaaagatgaccctttacgtgccttacctgcagacctctaataacataggcatacttgtgtccttactgtttaaaggcaggttaagtcaggccttcttttacttgcaaacaaaggcattttgatacagaaaaaaggtagagagcatgagcgggcaggctaaagatgtcaggaaagctgcctgagggagagtggtcttggaaggcctgggaggaaatgccattaaaactgaggctgcatggataaatatgagttgggcaggtgaagaatgagaggaaaaggttctagggagggaaaacagcatattcaatggccccacagtgaaaaggagctcagtgtttttgagtaagtggaaggggccagggtggtgtggggagcaagtggtgtaaaagaggctttgttgaggaaaacaggcgccttgcaggtcacacaggtcctggtgccacacagtagggatttctttcacagctgaatcaggagccattgaaaagctttaagcaggagtgttacatcagtttattctttaaaagactgttctgtcagttaaattgagatggttggaatggagatgagaaaaagcaaggaggctatttaggaggctataacagtggtccaggcacaaaatcatcattctgttctaggtagaaatagtaaaatgtggacaaattcaagaaatatctatgatgaggattgaaaggcatcagcaatgggtcagctattgcagagaagggaaggagggaaaggagcaaggatgacttccaaaagggtcaacaaaggagtgacagtgaaatggtgacaaatactgagaatttttaaagaggattttttttaaaaattgggaaagtgtgctatgacaaagtcaagggaggctcatttcaagaaggaaaatgtagctaaaagcctcaccattgtagagatggagtgagatgaaaactgtagactccactgaacacagttgtgaggatgtcagtctactgggaggtggaaacatttaggtttgggggaggcagcagagggagaaaggttaagggagaacagatgagattcttctttgaacagctcatcatgaaggagagcatggtggttcagcctctcttcaatgactttctcatgtctaccagcattttgtttcactgattttctctattgcttatctgtttttggtttcattggtttctgcttttatttgcttgctttgggtttactttgctttcctactgcacttgacaagtcttaaaaaaaaaaaaaaaaaaaaaggacaatgccaaaaattgcattgcaatccactgctggtgggaaagtaaaatggcacaatttggaaaattgagtgtggcaatgggtgaaggtacaaatgacgcaaaaataggagaatgctggcaactattaaaattggtgttgtggtttattacactagtctacttactttgtatattctttaaatttccataacaaaatatgaaaaagttaataaaactttttaaagttcttaaacttgaaacccgctttctttgcccaaaattataatttgaggagataaatactgtacaaaacatttatataggccaggcgccatggctcatgcctgtaatcccagcactttgggaggccaaggcacgtagatcatgaggtcaggagttcgagatcagactgaacaacatggtgaaaccccgtctctactaaaagtacaaaaattagctgggtgtggtggcgtgcacctgtaatcccagctactcaggaggctgaggcaggacactcgcttgaacccaggaggtggaggttgcagtgagctgagatcgcgccactgcactccaccctggcgacagagcgagactctgtctcaaagaaagaaaaaacaaaaccgacatttatataatataaattggctgcattttcagattagtgtagtgatttaatgggttatctcagatctaatgagttgtcagtgagtgatcctgaaagtccacatatgcatctgtgatttttacacacaaatatgaatgcaatttccaattttcagttaatttattgttctctaccccaaagccaactgctagtgcttgtaagagaggagactatatatttaagaggttttgttttaaaaaaaattctagtttttcactaaaaaataaacacatttttgataaatctgtgtggcaagtcaaattcaatggaggctgacagcaatgctggaaaccaccaaatgcgctaaagagcaacaaggcaatcagggccctgttttagagaatgttctaatcactgccaaagttccatacattatatgaaatgtgcaaatcagggaatctgcaaagatttaaggaagtatttattatcaatagcaaaggtctgccataggtgatcaaatgttaaattgaataaaaacgaaacacgaaaacctttgaaataacatgtttttccccaaaaatgaggataaaaatgactatccaaaaaattatgaagctatatgatctttgaatctgaacaggaaatgacaaatacaatgcagcttttaaatataaacatggagagtctgaaatcaggctttccaagtatatccctcacaacttggtttacaatttaatttttttcagaaatttatttcctagtgttacaggtggatagttttaaactcaattatattcaaacgcttagggtctattgattactaatagttttcactaatcaaagcaagaattgtttctactactattactaaggttagtattaacccaaagcaagcaactgtcagatatttactgggagcatttgaatgaactaaaaagaatgaaaagatcaaggagtctactcctgaaaatcagtttcaggtgtatttaacacacagatacatttccataaatctaaaggccccatcgcttgcctcatgtaagtcagaatcacttctacactgttaacgagtaactacaatttccttgcaatcacaaatcctgctgatagaaagccaccactgtgacatcacatagctgtgcggtcccaggttttcaaaactgagttggtacaacaagctcactcagcaagcacacgtcaacttctacatgtacatgtggtgccagtacaaaaacaggatggctgctggcctcaggaaggcaacaggccacacccctaggaaacaggagacagaggcactggaaaggaaatgtgacctgatgctagggaagagagaacaaggtcctgagcaccaagtggtatttaaaatgctataaatattatctgcctgggtcagatgtattttactaaagaagctaaagtagataatcaaagtctaattcatctagctggaaacgttaaatctatagccattcttgcttatactcagatttatcttgcttaccaatgaaaaaacaaagttacaacagaaaagcctgaaccgaatgtatctcaaaagcacaagagcgctatgctacaatgctactattaccttgtagccactggtccagggtattatcaatggtgcacttcacaacagggaggaattccgagttcataaagagcccccgcttagggtggttctgcagccgctcctgatggcttcgggagctgaaaaactctaacaccaactttatctgccaaagttcagaagtctcagacatttctcttctcccaagtcttcttatagccttgaagaggaaagaggacaacaatctatttaatcaaagagtgctctgtctcttcatcagagttgtagactgagtattttttaaatgtggctccgaattataaagggtcggggggtggtccattctgtgttttgatgcagtctgcccacagaggagccgtcactgggtacaggtgcatggctcacctccttcaatatggccctacatgagcagcttgcagggaaaagtaacaaaggtgaatgagctcattcttggctcaacagctccgaataaccaagacccaaaaggtcatagccagtcacctctgggaaactcgagctgggtacaatgacatggcagagatcccagggggtagagggcaagaagaacactactaataatactgcccttgagatccatctgcaagtcactacagctgcaaccagagaagatattcatgcataaagacctgccacccatgactgtaaaggtgtgagggttcagagagtaaaaagacacattctcagccagcaacattctcatccagcaaataacacaacttgttatttggctgctatacaaagaggcactgtgagaagcagtgccagcgtggataccatatatccatactttccaaccaaaaaagggtggattccagacaataatggcattctgggcctacttagttatattggaacttggtttttaatgatgttacttaacactgtgtgttttctggtttgggggaattatcctctgactaaatatatttttccattcagctttttagcaaattatttttatcattaaaggttatttctcttagacactgagtctcagatgctcagctgtgaacttactatattcacttaaagagctgtttaaaactagattctggatctcaccccagaaattctgattcaatagatgaggcatggaattaaaggatctgtatttttaagataccaaggcaaatttctgccaggttagaaaactactggcttggcttaactccaaatctgggtctgaaagatatgataatactgaaaaggtgtatgtattactaatttgcctaaagtgaataaattggtctgatcctttaagaacattattaagcattattttctgcattacccctttaggctcttttaaaatagcaataacaagagaaatttaaaaatgaactccaatgcctagataactgcatatggactctgtaacctcttgcaagctttatcacataggtctaatttcacagtactgccatcgctagggctctgttcactaacggctcacatgcagacttctacaaagaggcattgccaggagggaggcaaaaataagatgggagagaggaagggagtgctcccctcctctcctagtcaggggagacaaaagggaggaatgggaacccttaaaggaagacagccccccaaggggcactcctgtcaacataaagcccaagctttttggatttttgagagctttcaaattttatatggtttcctttcttaaatttccaaaagcaaatgggaaactaaaaggaaggacactaggaaccttaccacactattcagtgagttacttgaactacaggacaaatttcaccagaattggtataggtttttggatccatacctgatccattgcgatgtatgcaggcaacatctctggggtctcctgggtaacacattcatagagtactgaagaaaagagatccagaatttcctgtttctgcagaaaatcagaagttttgtagcacaaagtatattccaaaatcaattcaaaaacgaattgtatagcactactatggcccattcttaagttttataatgaatgacataaaagtaacactacaatcttttaaaaaagccacagcacatgtaacattaaacattaattaaaaaaaaaaaattaagtcccaagagacagttaaggatagtaagtgctacagaagagaggaatggaccaaactaggacaaaatgagtagataggacatcacagagctatgccttgggttgggctgggaagagtaggatccagaaaggaaacagagtaacaaagctgcaagaaaaaaaacactgtccagaacaagtttaggggaggcggcagagtcaagtccagctggggttaagggtgggcatgggctttattagagacccgtgacctggagtgcacagcccagctcttactagctgtgagatcttgggcatgtgacatctctcagtggcagtttcctcatctgtaagcccagaatgataaaatacctattctcagggtcataattaaatgacatttaagtattagcagagtgtcccatgtatagtaaagattcaataaaaaagagaggggaaggttatttcacttaatcctcaaaacaatactgtaaggtaggttctattataatcacttttagaaatgaggaaactacattttggagaggttgagaaattttctgaaggccatatatgcatccaatctttccttgtctctatggtggattaagtcaaagatctgggccaggcacagtggctcgtgcctataatcccagcactttgggagtccaaggtgggaggatcatttgagcccagaagttcaagaccagcctgggcaatatagtgagactccatcgctacaaaaaatttttttaaaaaagtagccaggcatggtggctacatgcctgtagtcccagctactcaggaggctgaggtggaaggatggcttcactccgggaggtcaaggatgcagtgagccatgatcacgtcactgcactccagcctgggcaacagaaaaaaccgaccctgtctcaaaaaacaaaaaacaaaaaaataaagaaaaatctgctaagcacccttggaatcttgaaggtaacaggtgtatgaacaataaaaagcagggttataatatacagaggaaacagttaatgaaattacataaaaataagagaaaggtggtaaacactgaaaacataaagcagaatatggatgggtatcattcttgtagatgacagaaactatcatctgtcaaaactgatgtcttataaattttaagttgtttcttctatcaaggtagaaagttgctgaatttaatagttttaggctatgcaaatctatacgtgccaagcaaaagtcatccaatgtgactgacgcatgtcatcaatctcaaagatagatatagatagtagagatgttttgggtgacccatgcatagaaataataacaaattctagtcctggggctcggcaaaccatagaatatatacctgacccatgttcacagttggcttgcagaaatattcagcaaatgacagaagtgctggatcagaagtgaatgctgagattgtttctggctaaaaaaacaaacaaccacaacagtataagacaacaaaagattattttccttacgcttaaactgtaatacacacagttctaacaactctacctcccctttgtcacccaacattcccaaaaaatcccagatgatgcaaacttgcctcatcaacctgttctgctaagaagttacaagaagcttttgcacaagttaacatgagctactaatttatcaaaaggccaataacaaacaggtcttcctgtttacacaactcatccaaaaaaggcttttccctccttcactgactaattaaaaagcctaccagaaactagaattgttactgaaaaggtaaggaaaaaagaatatcactcaagccagccacaaaaagataaacagtgtatgaaaccacataaatgaggtacttagtataatcaaaatcacagagacataaaatagaacggtggttgccagggactaggggaagtagaatgaggggttattgttgcaggtatagatctcaggtctgcaagatgaaacagttctagagatggatggtggtgatggttgtgcgttattgttgcaggtatagatctcaggtctgcaagatgaaacagttctagagatggatggtggtgatggttgtgcaacaatgtgaatgcacttagtattactgagctgtaacttgcaatggttaagacaataaattgtgtgcattttaccacaactttttaaacttgggaaaaaaacagtatcactcaaggttcaagattgaaaatgaaatatgaaggtattactattttccactgaggtttatattttatttctgaactccagtaggcaggaaatagaaatagcttttaatttttatatactttcttcgttcaaactcaagtctaaacttatctattttcttcacaaattgggttagagtctttggaatatgctctaatttttagaagaagcaatactacaaatttaagttaaactgtgtccaaaaatctttcaaaagtatttcataaacaacttactgaatactgccaaacaaaattcaccaatgtcaaccctgggaactatttatacatttcaatcctgggaaccattataaaggcttggtcataagtaactgactaaaatgaaatatgagttgaattaaaataaactgctgtctccgtacttggaagaacaaaggatgctaactcagtcctctggctgccactcatccagtccgcctgccccacttttgccgtctaattattccttagggtcctaactactttagactactctactttgtatcaccagcagggacacagttgctcatggaattacaggaaactgaagttaaattcagaagtcttaatgcctgattatgggacaaatttcttgtgttggaaacttatctgagtcaagaatatagagcaaaatatgtgctgaccccgccgtgggaatgagattgcttcctaccctcatttatcgtaactatttccttatttcaaacactactgcactggcagtcgagtactgtgcaaataataaagcaaactaataaaagaagtctgaatctgtcatcagtttatcctcaccaagattaaggaaacaaatggtggtttttaaatggagttaataattgctagcttgcaaaactcgttttctatttttgctatgaaattaagtaaatcttcaccgatttgaagatcaataataaaatcactatttgttacagtgtcaagatatggtgtgactgtccttgctgctaaatgtaaacattaacttacagtattttactttattatatatatattacttattatatacagattttatattcattatattttattatttattttatcacataaaaagcaaacagagccacagtcagtctttacaatctgcaacaatgaaaaaggaagcagatccacctttgaagtttatagcaatgggcgaggaagccggcaatttagaattatttctttccgtttttaccaatcaataatactaccttgaaagcccgggcttcagagttcctgttagcaacagtctgagccaacaaactttgccatcccattggatcttctttgtaggagagctgacccgcccggagtttaacatataaaaccccatccttggaaaggatggacctgaaagaaaaggaatgaatttaatataaggtattactggcagttcttggctggaaatagtgttttcccaataccatgttcacaggagatgaagcttttaccattttccactaaggtaaatgattatttactgtgtctaagattaaatcagtccctatgagaaagcctagaataaagttctgtttttctttggtgtctagattcatggaacttgttaaatgaggaggcactttgactattggctcaattacgagcttcgaagatagcattttgtctaacatttctttgtattccctatatcccctagctctatgcctagggtacatgaggtactaaatatctattaattggtttgcagcaagaagaaaataatgctgcaaatctaaggacagaacaatacagaaaacagctaatatacagtctggaaaaaatcacattgggaccaaactataaaaacttttacatgcttgttaaacttccttgaaatttaaaggcttaactgacatgctactttaggtataaatgtatcaacactctaaaataactgcacgtgattatttccacccaaaataaactggctgagtagtatatattatctacaataatcttaaatttaggagaactttctagcaaaagaatggtaaagagatgcaacaaaagatgtggtctgataaacactgattaataaagttcttttgtgcatgtacaaatcagctttactttctgacatggttaggctctgtgtccccacccaaatctcatgtcaaactgtaatccccacatgtcaggagagggacctggttgggggtgactggatcatgggggcagatttccctcatgctgttctcatgatagtgagtgagttctcacgagatctgatggtttaaaagtgttgcacctctctgtctctctcttgctgccatacaagacatgccttgcttcccctttgccttctgccatgactgtaagtttcctgaggcctccccagccaggcagaactgtgagtcaattaaatcccttttctttagaaattacccagtctcaggtagttctttatagcagtgtgaaaatggactaatacactttcttaaactaaatcttatgttaatataccaagagataagtccattactctcacaaggaagtcagtgcaagtttctcaataaataaatatttagggttggagtttgaaattaaaactttcattttctaacacaagtcctgtttcaaagatacagactgttttacagaagacataccctacatatagtcttgaatgagattaaagggtgatgagtcacattccagataataatctataatttataccttcttatatacttctattcacttcctaaaaggtaaatttgagaaatttaatgtacttacttcaagtgttgtgttcctttgcttaaatctatgagcagttcccagtatcttgggccttttactttaatctgtcaagataaacgtaaacatagtcaacccaaagctgaaaaatatgctcatctgacaaactgaaacctatgtttctcagaggaaacaataacagccagaaacaggcatctggaagttaacaagctccatttccagacaaaaaatgaatgtaaatcatgttctgaggccacctaagctatcaataaagatctctaagaaaagacttgctctattctttctgacttttcctcctgctgcagctttcttatctgctacaatacatgaagaaagctgaggcttttatttagctatctttaacgctatgccattctgttgaattgaccccttggacccaactcccgaccacacccagcttacctgctttaaaagatggagttctggaagaagggtaggagccatcaattcttctttggtttgttcataccactgagtgccctttacaaatgtaaaagtccagccacaattcactaggtagtcagtggaaacaacaaagaagaaacatctccacgctatacctccccctatccccgcagttcatacagagacctttaaatggtataaaatcctctctggtactcaaatcttaaaggactgatgtctaaattcctcacagggtatgtgtccttcccatcacttcaagccttgctcctcacaggccagcagcaccaaaggccgtgctccaatgctgctgggtttctgcacattgccttctccgctgggaaggagctccactcagtgggccaggcctagtccaaacactgtccactgttgacagcctcaaccccataactaacagctaagcgagggtgcttctctgcttcccctgcattccacagacatctccaattatcaccctctattcccattgtatccatgcctggctccccaggggatagaagttccttaaggaaaatgacaatgtcatctcattttgtaccccagagcctagcacggttttgagtcacagaaggtacttaataatttgctgaatgaaaggaggatataaaacttgtaatctatgcatctaaatgaaagctgtcatcaaatacacaattttgggttttcaagtttcagctaacaaatctaagaatgggtctaactcaatcagttatacaaaacactactgtcagtcacataaagttaacagggacattttcaaattataagctctaaggacaaaagagtagctgatgatccctaaaaagtgatacccagatcatttaaatgagcatgaatggcctggcaggatatacaataactttggaagcttccatttttatgaaagttcaattcattacttatcaccttttactggacaacacatttgaaatattatgacctgcaaagacggatgagtggtaataaaattacaagtaaatgatagggagagataccttgtaggtaacttctaagagggcatagcagggcgtgtttgtgtccacatccacaggcactagaagcctgggctccgcggccagcacatagaggtgccggagagcctggagatgatacctgttcacaaaaaagacagagagtgggtaacaaacaactgtgacaatatgagctctgcaatctgccgttgcctataagctaagacaggacagaagctcaagtaatatcttcaaatgaacagaaatcttaaaggcagataagattctattaaaaagtaatggagaaattatcttttaaaaattttatataactgacctttgacccaataattctttactttagtcttcacagtgaagaggttttacagggaggtaaaaagtatcataacatgaaaatatttactatcaaactgaccacttataaaatcaatcactctcaaaaacccctttctactcaacataggcatctgtttttatcttctcagattttttttttctttttccttaaggattgatagggaagaagggggaagacaggatgtcaattcttctcagacagcaaagttcttctacacatacatacttgcacatacatatacacacgtccttgaaacacagtacatcaaacatccatgtgggtatggcaatatttttctttggggttctcaaacagttttttaaactttaagatttctattttagaatgtaaaaacaaaaaagttttcatattttaagatctcataaaagaaaaataggctgggcacagtggctcacacctgtaatcccagcactttgggaggccaaggcaggtggatcacctgaggtcaggagttcgagatgagcctggccaacatgatgaaaccccatctctactaaaaagacaaaagttagccaggcctggtggcacatgcctggaatcccagctactcgggaggctgagggaggagaatcacttgaacccaggagatggaggttgcagtgagctgagatcacaccactgcactgcagcctgggcaacagaggaagactccatctcagaagaaaaaacaaaaaaaaatcgcccaggcgcagtggctcacacctgtaatcccagcactttgggaggccaagatgggtggatcacgaggtcaggagatcgagaccatcctggctaacacggtgaaaccccgtctctactaaaaatacaaaaaaattagccaggcgcagtggctggcgcctgtagtcccagctactcaggaggctgagacaggagaatggcgtgaacctgggaggcggagcttgcagtgagctgagatcgcaccactacactccagcctgggcaacagagtgagactctgtctcaaaaaaaaaaaaagaaggataaaatgagacttcaattttaaaaagctttatagacagtaacttccctcttcttactcaaatacatttatttctataaatctattaaaaataaaatcaataaagatcagaaaaaatgacactaacaaattacataaagattcttgtcaccggccaggcgcagtggctcacgcctgtaatcccagcactttgggaggctgaggcaggcggatcacaaggtcaggagatggagaccatcctggctaatacggtgaaaccccgtctctactaaaatatacaaaaagttagctgggcgtggtggcaggtgcctgtagtcccagctacatgggaggctgaggcaggagaatggcatgaacccgggaggcggagcttgcagtgacccgagatcacgccactgcacttcagcctgggcgacagagcgagactctatctcgaaaaaaaaaaaaaaagattcttgtcaccaaatggaaaatggcttcgtttacaatagctaagccaaatagctatgaccagcagtacgtgagtgtggctctccactgtaccctagccaataattggctttaacaactcaaaaaatctttcctaaatgacaggcatgaggccacatgtcagaagtgtattaacttaacaatattcttgtgctgcacctaccatcagagtgtggtcttcagattaggctacttttgtaaaacagctatctttcttctgtcgttggttatacattgtagtgtagtttaaaatgatggcttaggttactgtgataagtgctcctgacccttctcccataaacaataaagggctcttgacctgtctctggggagacaacatgggatgccttaagttgagcacagggctcaggtgtcttataggggctattttattctctgcccccatatgcaagagatctgctatgtctcaaactatatctagggaaacttaagtgttggtggttcctcgtaccctaaaacacagagcttttaactgcttctacatggtttgaagttctaccactcactgccacttctaaattgtctctggttttttgctgtattttgcttttcttgtcccgtctatgtcatttatacacaatttatcggcatctatgtgaaaggaaaaaaagaaactcatacagacattgccactaaatcagacaaacttttctcttggaattaaataattagagcacaaaaaaagtatcctgaacttcccttggcaactatcctttacctgatgattttttccctaaagacaactttacttgatctccttttgggtttagagcagttctatagatctgagaatggtggaagactggtcagtcatcaggtgtccaaagttatcctctggtctaatactttgtgagataattttcttaaaagatttagccaggaatataactaagttggagaacaaaacaatgctaatttggaaataattccatgaaaccaaaatacaaccaaatgatccccttagagaacttaataagtatcacattgaagacagaatcactagactcaccggttgtcagtgctgtgagctgggaagtgcggataaagggcacagagaagagcggcaatggaagaatttgatgtgctcaaagagtacctgcaaagtaagttcggtggggacagatgttattgattatattgcacatactttcaaggcattcttgagaatcaggaaactggtgtataatagtaaggcatactgataagatgccctcataatacaagagtgtcagtggtgtgaacattccacttttcatttagtccttgggccatttcaagatcatcactatttaaagccaaagtaatatcccataaatgttaaatttcaacccttgaagcaaggttttaacataaaatagcagagtagtgaagaccatgaatgcagtcctagaaattataaatattgaagagtcatgtaccaagtatgccaccttcttatccaattttattaatgtatatgcctatgtatatgcctatgtatataaatatacaattataaatctgagttttaaaaatacagaatgttgtaattggtatttaaacagttttttctgtttctgtgaagcatgatgattcctttagaatgactgactaaatgaaaaggcaaaagttatcattaaaaagttacaacgaggccatgcgcggtggctcacgcctgtaatcccagcactttgggaggccgaggcgggcggatcacgaggtcaggagatcgagaccatcctggctaacacggtgaaaccccatctctactaaaaatacaaaaaattagccgggcgccgtggcgggcgcctatagtcccagctacttggaaggctgaggcaggagaatggcgtgaacccgggaggcggagcttgcagtgagccgagatcgcgccactgcactccagcctgggcgaaagagcgagactccttctcaaaaaaaaaaaaaagttacaatgactgtataaacaactattcctctaaatataaattctttcctcaccaatatgatacacttttaagataaagtttcatagacttttaaaaatattctcttggtaaagggtctattaaaattttccttaaattactttattgttgctcaaatttagtatagcaaacaggcaaattaatctaaagtcccagagtttttctaaaaaatattttgaaataaagatggtgtaggacatcacataaaaccacttctaaaactattgagtataaatacttttcttacacacaaacatgcacacacatatacccaaatctctttccctgtcttttaaaataattggagtattaaataaggacttataattcattatatatgcttatatatttaatggattagaaagaagagatttcaaaatttaagcaaagagatacatctattttggcatgtgcatggaataagccattttctttgtacccttttgataaaccaaaattcaaagataaatattaagatactaatgttagaaattttgggtagaaacataatggtgtagctatgctaagtttaaatgttgttacagagtatatatgaccatttaaaaaccaaaaatcactagaaaagcagtagcagaatggtagaaaaatcaattcgatacgaaagaagagcgaggagagtcatacagtttggaacaatgaaagatgggattaagagacacggagaggctcattttgaaaggaaaaaattttcaaaaatcatagaataaaataaataagaattttcatagtaatatttctttgaccattattaattctaaacaattaaagaaagacaattccacaaaacatgttgagaggaaatacacacctttctgatcaactttactttttgtacttctgaaaaggtgagttccaatggtaagctcagtcttaaagaagaggggaaaattagcctacacagacactgtagccattgatcaaggtcacacacactacagctaaatatatacaggggtataccatattcacagaatggaagacaatactgtaacagattctaatctccttaacacagacacatacaatcaaggcaattctgatcaatattttatcagattatttagtatggaacagattccaatatttatatgaaaatgcaaggagccaagagaaaaacacacttttgaagaagaaaaccgagtttgaaggatttactcaactggataacaagactcataagacaatggagtattggtgcaagtacagaaaaacagaccagcaaaacctaatagcccagaaataaacacaggtgtataggcacttaacttatataatagaggtggtactgcagagcagtggagaaggataaacttttcaatagcagcgggaaaaaaacatggagaaaaatccgtgccaggtagattttagattcaaatgtgaatggaaaagctaaaaacttctagaagataagataggagaatatctccttttctctgggtaagaaaatatttcataaacaacacaaagaagtaaaaactataaaagaagaacattaataattgtgtcatcaaaagacaccactgagagagagtgaaaaggcaaacaagccctagggtggcaaagatagctgcaacaaacaaagctgaccaagggcttaggacatagtttaaagaatccacagtaatcaatacaaagctaaaccaatgtggagcagtcaacctcatcaaaacagaaagtagaatggtggctgccagaggctggtgggaggggcaaacagggagttgttcaatggctatagaatgtcagttttgcaagatgaaaaatttctggagattggttgcacggcagtgtgaatataattaacactacttaattgcatacttaaaaattgataagttttatgttatgtgtattttaccacaaataaaaattttaaaatagataaatataaaaactgggtagcaagagatttggacatcacaaaagaggttttgcagttggctattaaaagtgtaaaatggtactcaagaacattattcagaaatacagaaattaaagccacaatgagatcctgttatatacctactagttggctaaaactaaaaagactactaaaaagactataccaataacaagggttgacaaggatatggaacaactggaacttcacatcctgcccatgagtatgtaaaatggtacaagtgcactgcagcactgatggtattattcactgaaagtgaatacacacgtacaacctatgacccaattccacacagttctatatacaacaaaatcgaagacatgtacaactttccctaacagcactgttcataacagccccaaactagaagcaagaagcatatccatcaatgggggagatcaataaaatgtggtagtcatacaatgaaagtgtaatacaacactgaaacttgaataatccattgctacatacaacatgaatcttacaaacataatgttgagcaaaagtaaagtgcaaaaggatacatcgtgtataattcaatttaaatgtcaaaaacaggcaaaatcaacgtaaggtgttagaagaccagatagggctatctttggggaaaggaagataatagtgattgagaggggtgcatggcagaagcagagacgggtgctgtgagttgaaagtgctatacagaatcttgatctacatgataacaaagagatttttctgtggtagatagctctttgacctgtgcacctatgatttatacacttttctgtacatggtttttggttcatctaaagccagggcagtcttataaaggatgtagtcaggaatggcacatgttggaaaaagatcaagaaagctgaaaactaagaaaatgtcacaggatctggtaaacgattttgtttgtgacctttctgagaaagtagcttagtggaatggtaaaatttttaaccaggtgggcacaagcagtgatgcactgaagaaccgagcacagactattctgagaaatacagtgatgctcagtgtgtcagagaggatggtaattctactgagtagaccataagttgacggttaaactacaaagaagcccatcaagtcgaataatgctgctagttaagctaagagctagtcagaatttaaatttttcatgttatcttcaagatcaacgtaagtcacccttatagatctcaccaatgagatcttttcattggaaaaatacatattcacttaccttcctcctcccaaaaatagaagtccaagggccatgtggtgggctaagtgaaaaccatagttcatttcaccacccgttttcatgtgtaagaagcgacaaagctgcaaaacctttaggtttcctgagccagccatgaccatggcgagagacagcagcaccacgctcagacaagtttctaggttatgaggacctgtctgtcaggtgaagagatgacatcactgtaactgttgtgttacatttctttattatcagaactagcttagccatcattagaagactacaaaagtttgtaacttaaaaaaaaatctgggctgggcactgtggctcacgcctgtaatcccagcactttgggaggccaaggcgggcggatcacgaggtcaggagatcgagaccatcccggctaacatggtgaaaccccgtctctactaaaaaatacaaaaagttagccgggcgtggtggcgggcgcctgtggtcccagctgctcgggaggctgaggcagaagaatggcgtgaacccggggtgcggagctcgcagtgagccgagatcgcgccactgcactccagcctgggagacagagcgagacgctgtctcagagaaaaaaaaaatctgtaaatacaaatattttccctgattatgaaatataagttcaacagagataatttcaaatattgaatatcaagacataacaatcacttggaatgtcacacccaaagataactggtgttaacgttttggctttttctctgaatttttcctttacctacacatattttttccaaatgaaatggagatgttactctacacaatatttttaaccttttaaatgacctattacaagcaagcttcactcacaaaaaaaagttgtttcttttttgttgttgttgttttttttggagacagggtctctcactctgtcacccaggctgaagtgcagtgatgcaacagcctcaacctcctggggtcaaaggatccacccacctcagcctcccaagttgctgggactacatgtgtgtgtcaccacacctggctaattttttattttttgtagagatggggtctccctatgttgcccaggctgatctcaacctcctgggctcaaatgatcctcctgcttcagtctcccaaagttgctaggattataggcatgagccactgcacccagccacaaaaaattcttgtataacgtgattttggtagctccactgtgtaagaatatataaataaaccataatcaaatttaattaactacttttagacttttttgatgtttctaacttttccatattataaatagtgttgcataaatccatgtagcttttaccaggaaataaaatctctcagtcttgtcatcagagaagcaatgcctcaaaagcaactgaatccttactaagtactaatattttttaaaaaggaaattcccaatatttaatactgagacagaattacatgaggtatgacaacccgtgaatattatggccttttttattctcttgtcacaagaactagatacctgtgcatccttccagggtaatcatattctcacctaagttaatatcgcaaaacaaaaataaaaagatgagctaatggttcttcagatctctcattctacatttaaaaaaacagcagagatatctgataacacataagtaactggatcatcagtaaatttttttcaagtttaattttattcccaaggagaatgataaaaagacttacaacagaagcattaggtgcggacaaataagtcataaaatctttggcaaatttatgctagaaaaacaaaagaaaaaattccaagttataagaagcatcttaaagctttgttaaaacaaacaaaaaaaaagaacacagtaaactaaaatacttcttaccaaacagttaaatgctgataagttttctgagccagcaaatcgaaaacccagagacaagcaggctcctgcaattatgtagacatgtgcttggctgaaaacaggtgacaagaaatttaataatcattattttactttaaaattaacttgaaataagtaacaataaatattccagttctctaagctagtttatatctttctgggaatgatgaagtgccctcagtcagcagatttctatgtatttttttttcagcagaagcatcgggtcaccttactcatgaagtttgccccttgcctacagtttcatatgcagcaaaaacaatttttaaaattgttgccaatttctttaatggaaaggataaaagacaaatacatacaagttaaatctccaatattgctttttgagggcaagagctctatacttcagagagctttaaccaacgtcatgaacatctgataaataatggttagaaatatgtgggattcataattacttaaatcaaggacaatattactcccacatggtatatttcaatttaattatctgatagacgctaggatagctaatttgcattatacatcacttacgacaaagtttccaaattcaaatcctctgagcacggcaattcgatttcactgagagagatactattttctcttataatctgtcaatatagaaagcaagaatacttagatatcaatgttctcattacaaatatttaataatctgaagaataacatactgcttatcatggctatatttatataaagtaagctttaccaaaccatttcactcaaaagcctatattttaatctcattgaatgtaatcaaatttcaaatctaagatgggctaagtaagaataataattaagggcaggcatggtggctcacgactgtaatcccagcactttggaaggccaaggcaggtggatcacgaggtcaggagttcgagaccagcctgaccaacatggtgaaaccccatctctattaaaaatacaaaaattagctgggcgtggtggcgcacgcctgtaatcccagctacttaggaggctgaggcagtagaatcacttgaatctgggaggtgcaggatgcagtgagccaagatcacgccactgcactccagcctgggtgatagagtgagactccatctcaaaaaaaaaaataataataataataattaaatagggctgaacaaatataaacaggaagacgtaagtatattctaaatcagtaacagggtcataatattgcataccagtcaactgaaatacaaagatgatggctttagaattggggcaggggtgaggggaagaagtgggaaaagagaaataggagacaactctaatcagacttcttctttacgggatgtttccagcattaatccaacatacctaccacaggtgaggttattcactaggctaagataagctaaactgtcaatatgtttatcagctatgttacaactattgtttagaaaagacatccttttccttttagtataggtaatgaacaatttaccgaaaaacatacacagaatatctagctgtaataaccaagaagacatttgatccttttctcctaaaagaaaaaagccaaaaaagataaagctaatgtttgctaaacatatgaatgtatttaagatttattcttttaatcttctgagaagatttcttagaagatttcttaacatttcaggatgttttcttcaataaaacaataaatattggccgaacacagtggcttacacgcctgtaatcccagcactttgggaggccaaggcaggcggatcacttgaagcctggagttcgagaccagcctggccaacatggtgaaacccgtatctactgaaaaacaaaaaattagctgggcctgtaatcccagctactcaggaggctgaggcacgagaatcacttgagcccgctaagtggaggttgcagtgagccaagatcgcaccactgcactccagcctgggcaacagggcaaaaccctgtctcagtctcaaaaataaaataaaataaaataaataaatattagaaggcacttataatacagtcttcttatgtactgaatatcaccaaatcaaagacttaaaatatctttcctctttttttttgccttgagacagggtctccctctgtcacccaggttggagtgcagtggtgcgatcacggctcattgcagccctacctcccggactcaagcaatcctcccatctcagcttcccaagtggctaggactacaggtgcacaccaccatgcttggctaatttttgtatttttctgtagagatgggatctcactatgatgcccaggctggtgttgaactcctgggcttaagcaatccaccctccttggcctcccaaagcgctaggattataggcgtgagtaaccgcaccctgtatgtaaagctttttatgaaagaaaaagtgctatgaagatgctagttgttattttacatatgccctaagttcaaacagacaagcagtttacaaagtgacctttaaaaaaaaaatcctccttttaacgctaggttgctcactacaaggaaccctgctccagaatcaatgtagctccagatgagaacccagagaaaagtggaagctgataggaaatatcaatcaggagaactgtgaaattgttatctctcctatttgcagtatccctgatgtaataaagaccaaatataacattataaagtctgaagtaaaaaagagagagatgttattctatactaaaagtccaaaaaccatattttcataaaaacaaaaaacgaccactgttttttgtgtttttttgtttgtttgtttgttttttgtagagacagggtttcaccacactggccaggctggtctcgaactctgacctcgagtgatgtgcccaccttggcttcccaaagtgctgggattacaggcacgagtcaccacaccaggccgcaaaaaagaccactctctgacatgaatttatactttccactttggaattacagttacttgtacacatgtttaatctcagtaagctgaacttagtgcatttaataaactaaagttttttgagaacactctatatgtctgatgtatctttaatgtattacagagtttagcacgtgccttgcatttacagaggattaatgagtatgtgctgaatgaaggagtgaaagaaaaagtatttcatcctacaatatacatttcaaagagcactttcaaaaaaactaaaatctctgacatctgaatatgctagagttaaaattatggtaacaaatgagcgagtcatttaaaacaattcttcctcacctctttcatatcagtgattaacaaaactggaagaactaaacaaataaaaacaaacctaggagttctacttcctcaaataatagatgaataaattcctatcagatcaactcatacaacaagtataaaccctagacaaaatataaaatccaaactatctatggcaggggtcggtaaactatttctaaaagggtcaaatagtaaataccagcaactactgatctatgcatttgtaacaaaaaacagctacagacaataagtaaacaaatgggcatggccatattccaataaaattttctttctaaaaatcaggtgggcttaattcaccaactcctgacctcaagacactggaggacaaaagcaagcagattctagaggggagagtcgatccatggaagagaggaacaccactagatacattttcctttctgcggtttctgctctgaaagcaggtctatctgcgccaagaaagatggcaaaagctacaattaaaagctcataaccttcttggccttaacaaccaggatacaggaaaataccacacccattgggaggtgaggacagaatatgacaaaggagagagccacagagacagggccccaagctctgtatataaattctgtgcaaatgtctgcctgatccatgaaccatgtgtgcacagggcagactccaacagcccacaggataaagacgtgcaccaagattagagctagcaaccaagaaagaatgacaatctgattccaagtaaattaaccggttgctttaaaacaaaatgtatatacctgtgtttaccgtgcttgaactacaaacaacgtggtttaggctaacacacattctcctgagaatctggaacttgggtacatacaaggcagagggtaccttacctacatgtcaggtcccaattaaaaacttgggtgctgagtctctgatgagcttccctggtagacaacctcaacatgtacctcatatcatatacaaaattactttgaaatgaattatgtaagtatacacaaaactaaaactttggaagcttttagagaaaagcagaaaagattatcttcatgatggggttagacaaatggtttttttcataggaatagagaataaccataagaaaaaactgacaaatcagacattatttaacattctaatatcttctgctcattaaaattattactaagaaaatgaatatgcaagccacagagtgggagggatatttgcaaaagaaatctgacaggccaggcgtggtggctcacgcctgtaatcccagcacttcgggaggccgaggcgggcagatcacgaggtcaggagatcgagaccatcttggctaacacagtgaaaccccgtctctactaaaaatacaaaaaattagcagggcatggtggcgggtgcctgtagtcccagctactcgggaggctgaggcaggagaatggcgtgaacctgggaggcggagcttgcagtgagccgagatcacaccactgcactccagcctgggcgacagagcaagactccatctcaaaaaaaaaaaaagaaatctgacaaagaacgggtttctagaatgcattaaaaaaactccagcaacgcagtaataaaaatacaaatttttttaaaaaataagcaaaagacatgcacagacacttcacaaaaaaagatagatggaggaccaataaaccaatgaaaaagttctcaacattaacagtcagcagagaaatgcaaatttaaacaacagtcagatatcattacgtattcatcagcagcactaaaacttaaaaaactaacaccattaattatcggttagatgggcaacagccaacactctcaaacactgttggtcaatgtgtcaaatggtacagctgctttgggaaaagatttatcatttctaataaaactaaatataccatctaccctatgcctcagtaattccagccctacctaataggattgcaaatggaatacacaagttgaggatccctaatccgaaaatccaaaatccaaaatgctcaaaatccaaacctttttgaacattaacatgatgcccaaaggaaatgctcattgaagtatttcagatgtcagagtttcagatgagggatgctcaaccagtaagtataatttcgagtattccaaaatccaaaaacgcttctggtcccaagcatttcagataagaaatactcaatctgtaccacctaataataaaaaggatgaactattaatatactcaatatcttgaaaacgctgaaagaagtcttatacaaaagggtatatgccatatgtggcttcattaatataaagttctacatctggaaattaacatattttgggagataaacaaaatacatattggttacctgggggtacaggtgaatgcacaaagagggaaggggcacaagggatagaggctggtttccacaggtctatgtgttagtcaaatcttatccaatagggtacttaacatttgtgcatttcacgatatataaattttatcttaaaaggaaaaaatgtaaataccaattccagttaatacatatggtacaattttgggatggagtgtattactgtttggaactaacattgaaattcatcaaaaaatgttggattagatagaggaatagataagtggatagataagtgatgaaacatgtttatacagtaaaatattattatagagtctattggtgatgtgggtgttcatattaacttctttcaatctttgagatttttcttctgaaaatactgaaagaaacaatctacataaagaaactgagaccactagacatggacagttgtctaagggcagtggctagttacaatattcggttttcagtttttaccaaaaaaatctgttcatttttaactagtatacttggcttatcgaataaatatgatataaagtaattaaaagttattaggagatctaaaattgtcacgaagtaaaatagcatcttagaaatgtgcacttaattatgacaaaaatatcaacacttttttagagtattctggcaaacatatttagttttttcctttcattttttaactcccacgcaacaccgatattcatatttaatttttaaaaactacaatttctagggacctgaggctaaaagagaaggcggtggtctgtgcagcacagaatcttaaaatggaagttcttaggtctttaagaggtatcctaatgatcaatattgccttcataagaaaaaatattttacagaattttgaaaaatcccataagaaatcataattttatgctactaaagatataatatttattatatgtacttacttgaggaacattgctgtcaacccacttggaatttggtaaaatatcatcccacaaaatcaggcatcgagcaagtgtcttaaaaatgcaacagagataaaattaattagagcaagtaaagttcatacattttataacaatgataataataaacagaacaatttaagaatcagttcccaactgttgagaattttgaaaaataagtatatgcaaatgcaggaaggttatgtactgataaacctattgtaagttgaaaataccttaagctgaaaatacacttaggccaggctcagtggctcatgtctataatcccagcactttgggagaccaaggcgggcagatcactgaagcccaggagtttgagaccagcctggccaacatggtgaaaccccatctctactaaaaatacaaaaattagccaggcatggtggcacacgcctgtagtcctagctactcaggaggctgaggaacaagaatagcttgaacccaggaggcaaaggttgcagtgagccaagatggtgtcactgcactccagcctgggccacagagtgagactccatctcataaaaaaaaaaaaaagaaaaagaaaatacatttaatacaccttgcctgccaaacaacacagcttggcctagcctaccttaaacatgctccaaacactcaaattagcctataattgagtgaaattctctgtcagcatagtaaactgtagagtatgggtcatttaccctcatgactgcatggctgactgggagctgcagcttgctgccattacccaacaccatgagagcatcatactgccaggagtacaagaaaaaaattaaaattaaaattggaagtagtttcttctgaatgagtaccgctttcacactatggttaagttaaaaatcctaagttgggaaccgtcttactcattaaactactcattaaaataaagatttaaattttaacaaagaaaaactaaaattgagttgaatatcaccaaagtttagagggcttgtgcgggtactttttaaaatgtactctggaaaagaaaaaaatcacaaaggaaagaatcatagctctatctacacataatttaaaagcttctatatgctaagtttaaacatcagaaaaaaaagaattagagggaaaattttagacaattaagtgaattgttactttctttagattcaaccttaacagtattatcacatccctgatagtaatccaaaaatgtaaaacaaagcagtaaaaaagtcctaatcacttgttgctttttaggaagttttgaataataatgtgagacagtgaaatgtcactccaagtattaaatatcaacgtggttacctttcttgggattcccaaagtcctatttgtgaaatttcaaatgaacactgccaattagatatgcatgacaaattaaaaataaaaggctctcttgtaaagacatttatgtttgccattcattcattcatggagaacagcctgtgttgcccaggctggtctcaaactcctggactcaagcaatcctcctgcctcaaccttctgaagtgctgggattacaggcgtaagccactgtgcccggcttacaagctaagtttaagaaccacaaatagacttctcatgttaacacaaatgaagacaaagcataccctaagcaagagaaattctggcttcacaaagtccaacaaatacatggtgtcaggggctcggagccaatctgcaatagatctggtggtggaggaaaacagtaaggcacactgttcaagtagagggcaagacaatcaagaatctcaagctctatttcaaaacatttcttcccgctccactacagctctacatatttttcacaatacttcacaccttctaatgtaatagttattatagatgtacatgtatgtcttactataacataaactccatgagggaagatatttttagttttgctcaatgaaatatccccagtgccaaggaagcactgccctacacattcatccaaatagtaaagtaataaatatctatttttaaacactttgttaattctgcacacatttactttttctaaagggagaaatgtggaacactgaaaactccttgaatcttagaatttgtttttaattaatagactaaagacatggcataacgtcttgtactcaacttattcctcatgcaaagtgtaagcataaatgccaaagatcttactttcaagcatcagcattaatatagcaagttaggaaggcagacggtttggtaattacaaaagctcctgaagtaggcaaaaaccattgttttacatggtaaccaagatcacactaaatgataagtatttctggcttaaccagtcctcacagcaatatgctaaattaatgaaaacaaacatgggcattgcttgggtgttactgacatcaactacaaaacagaaatgaacagaaattgaaaactatattgtcaaataccattaaaatagccaaatacattatttccaggtaaaatctttataacttcaaatactgcaagttttctttcaaaaacttacagtacttgaaagaacaaaaaatcagcttaatccagcacaggggaaagaaacacatgagataactgaattttacaaccaaggtcagggaggatatcacactatcaccgcgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaattattataaaattcctctgaataataactatgcttaaaattaacacatttaccaatgtcagtatgaacactagtattttccaattaacttcccagcttccagacttttgatctattactttgctgtgtacttactttgatttgataacttggtgatttatgtttctccctatgcattcctgtttgaaagcgcctatgtcctccaaccatgtactgatagagctgctcaggcacattgagatcagacatacctatcaaattgctgccatgctggaaaagacaataacagacgagtgaaaagaaattttatgaaggaagatccacaacacatacccataacaaatataaaaatgaactaacttcaaagcaggttattttgggttttgttttttttatttccaatttaaagcaaacattaatcatgagttaataaatattaataattctcataaaagttttaatacatgaatgttcaactttaagtactgtcttaaaatacataagagctttagagttagttacatttaacaataaagaaaaatattagttatataattgaaactggaactgtaaatacctgaatactgtcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcacagagggattaagcccaaggttatacagctattatagttaagtcgcagggctatatataaaacacggccatctggctcaacaatccatgaagctgattaagcaatacacaataatgtagttaaatgacttgaatcactagttaggaccagaattcaagttgcaattccctgtgtgattcttttctttttttttttttttttttgagacggagtctcgccttcttgcccaggctggagtgcagtggcacgatctcgactctctgcaagctccgcctcctgggttcacaccattctcctgcctcagcatcctgagtagctgggactacaagcacccaccaccatgcccagctaatttttttgtatttttagtagagatggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctcgattcaccacaacctccgcctcctgggttcaagcgattgtcctgcctcagcctcccgagtagctgggattacaggcatgcgccaccacacctggctaattttgtatttttagtagagatggggtttctccatgttggtcaggttggtcttgaacccccaatctcaggtgatccgatcacctcggccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatcagatactgcattttgtcacaaggaagatgctactgggacaacattctgggatacacagtgaacatcactacggcaaaagggggttagggtttgtttcaagcagctactatagactcttaaggctcccgatcatatacgttttcactattctctgttttcagtcatagtgggctgtcacttattcattctatgtcttgaacgctttaaaaaaaaaaaactttattcccttcagtttgttcatgaacactgcaagctggaggaaaagaaatcttaaagtcccactcttgaccacagtttctctcaatttgcaaatctggtactttgaaaaatatccaaaaagacaatagagctgggcagcagattaagtcatagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactctctgtcagtgcagtattccatttcaggaccaggaggccgtcctgtaaaaacaaaagcaacacagttcaaactagcttctcaaaatctcatctcataaaaatcttagagttaactttctagcaagttgcactggacatacgaatggaatataactccattcagaaagttatgacactataataaatggtgtccacaactgtaggtttacctaccaaaaaaaagggcccaaaatagttctttttaaattgccaatttaagtctttataagcaatgatattcaaatactgtgaaactttgagtcttaccaaaaaaattaccaagtagtagaaaaaaattttaaagggaaaaaggtaagagtattcaaaaaaaaagttttatttttttgttaaaacatctgggccgggtgtgctggctcatgcctgtaatcccagcattttgggaggccgaggcaggtggatcacttgacgtcaggagttggagaccagatggccaacatggtgaaaccctgtctctactaaaaatacaaaaactagccagggtgccaggtgcctgtaatatcagctactggggaggctgaggcaggaaaatcgcttgaacctgggaggcagaggttgcagtgagccaaaatcaggtcgctgcactccagcctgggtgacagagtgagacaccatctcagcaacaacaacaacgaaatatcttacattttgttttcattactttcaaatccacacatcacatgtggtgaaacatgttcgaatgatgataatgaataaggaggtcacttacttatgttgttaagctgttaaatattatgtttagacatttatttcgagtgtatataataatgagccctactatggtagaatttctgtgtactgatcctagaagtctgactggatacaaaattcatacttttaaaaggcaccctataactctaacactaccgtgttgaaaacgataaaatgtactatgtattaaaacccttccctctgaaaaaatgttcacattcctgaaattttatccctataggaaaaaaatgcaatttaaaaaaaaagaaaaaaggctggacgtgctggcccttgcctgtaatcccagcactttgggaggccaaggcaggaggatcacttgaggtcaacgagttcgagaccagcctgtccgacatggagaaatcccatctctactaaaactacaaaaattagccaggcatgctgacagacacccgtaatcccagctacttggtaggctgaggcaggagaattgcttgaacctgggaggcagaggctgcagtgaaccgagatcgccccactccactccagcctgggtgacagagcgagactctgtctctaaataaataaataaataataaaaattaaagaaaaaaatcacacaaaggtaatcagtgtaatgtttatatataacaacaaaggattattagaaacaatctaaaaagttctaaaagttaaaaaaaggcattttacagaccatcgactcaatgaatattacacaaaatttgttttaaaacccatttataacaatgatctataaaaacaatttttaggcggggcacagtggttcatgcctgcaatcccagcactttgggaggctgagacaggcggatcacaaggtcaggagatccagactatcctggctaacaccatgaaaccctgtctctactaaaaatacaaaataattagccaggcatagtggcgggcgcctgtagtcccagctactcgggaggctgaggcaggagaatggcgtgaacccgggaggcggagcttgcaatgagccaagattgcaccactgtactccaggctgggcaacagagcaagactctctcaaaaaaaaaaaaaatttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcttaggtttctatcaacaccacgagagaaacacaccctccagcctgggtcccagaatgaggcaggtgaggcagaacggcagcagaacagccggctacacatctacagcctaaagcagagctgcctgggccaatgctatgcctgtatgtatgtagcatcactgtggcaatagctatctgatacaattatactaaagaataatacatctttaacaatatattcacaaatccatatagaaaagatcttgaataggacatataagtatgtaactaaattgttgagcatattaataatgccaatagcatttccatttggcagaaaaagatgacaacacataaagatttccaaaaagtttggacccaataaaaaacagagacaatgttcactaaagtgagtgtgtggaccttaccatttccaggttcatcaccaacatacccaccagcatgtaaaggaggaaagcaggagtccattacttgacttctattggaagtgctgttatccaacacagtaaacactgtgatgtgtttagtttagtgtctctcagggaccaaaacaatctactctgagttttaagtgcaggccactggtagacactgctggtaaagcaggataaacagcatactcatagctgattaaaaccacaggtacctcattaaatgtgaccactggaattcagtaatgagctagcaaataaacatggaggttaataacctgcagttacattagccttggataacattacttagagttttgttgttttttttaattagtactagatcattctttgctcataaaagctaccattgtctttccttaatttttataattttactatcacttttaattgggttaatgtggagtggagagtacatgcctatgaagattcagcactattaatcccatacctatctcagccaacaggacttctgcagtatgtctgtgagctgtcccttgatatacaaggccaatgccaaccactgcagccacttggacattgtgaggaacatccagctctgtggacgttgggggtaagagagcaggaatgtgaatgctaagaagccgagtaatagacatatccatggtgcctagttttgcagcagaaacaccaagtagcagtccaatgcttgtcatttcatggccctaagatagaaacaaaacaaatacatagtttaaaataaaatactgcctgccactttcaagaagtacttttatgttgacaggcaaggtgagaggcactgagaatacagcagtaaactaaacaaacatggtccttgctctcatggacctaatgacttaataggaaaaaaagtgttaaattaaaaaacataaacaaatatattattaaaaagtagtacaataagaaagtacaaagtattatgaaagagtattttaaaatagcttaatttagattgggagggactagaggattattagggatgaaatctctaaagattatacaaagaaatttatattaggacctgaaggatgaaaacaaattagccaggaacagtggcaggaaagaggacactcaagtttagaaggtgaggaagactgtttcaggtgataaaacagcatgtaaataaatggctctgaggcgattcagaaataaaccctcacattaacatcaactgaccacaagggtgccaagacaattcaacaggtaaagggcagtcttcaaaaaacagtgctgggacaagtggaaggacacattcaaaagaatgaggctggactcaacacaatataacaagtgttggcaaaaatatggagagattggaactctcatgtattgctgatggggttgtataatggtgcagtcattatggaaaacagtttacagttcctcaaaaagtttaacagagttaccatataacccagcaattccactcctaagtatgtaccactacttaccattacttcattactcttgagtaatgaaaacatacatctgcacaaaaacatgtatacaaatgttcatagcagtattattcgtaatagctaaaaagtacaaataacccaaatattcatcaacttatgaataaaatgtacattcataaaataaaacatttattcaacaataaaaaggaatgtattgctgatagatggtacaacatggatgaaccctaaaattatcaggctaagtgaaagaagcccatcctaaaataccatattttatatgactccgttcacatgaaaggtccagaaaaggcaaacccatagacacggaaagtagattagtggttggcaggaagtgaagtgaaggtgggggggggtgaggtagaggaatggggagtcaccactagtgggtacaaggttcctttatggggtgaaaagatgttctaaaattaacagtggtgatggatgtacaactctgtgaatacactaaaaaccactgtaccacatactttaaacagtgaattgtatggtatgtgaattttatatatttatataaataaagattccttaaaaaaaaataacgctgtgaagtgaaagagtttagtttgccagagagctaaaatagccaatctgtatggttagagtgtgggggagcaagaagagtggggctgggtgcagaggctcacgcctataatcccagcactttgggaggctgaagcgggcagatcacctgagatcaggagttcaagaccagcctggccaacatggtgaaaccctgtttccatcaaaaatacaaaaattacgcaggtgtggtagtgtgcacctgtaatcccagctactcagaaggctgaggcaggagaattgcttgaacctgggaggtagaggttgcagtgagacgagatcacaccactgcactccagcctaggtgacagggtgagactccacatcaaaaaaaaaaaaaaaaaaaaaaagaacagtggtaccaactagggctggagaagtgaacaggatcacaccagctcctagaatgtatattaagagcaatggtcgatccccctttgccctctggtgttgggaatgttggccttgttctaaaccagtttcccttcacagaagttcggccatcatgtgggatcagaataaggtcctggggcaactaaaggtatctggccaagggtacatccgaaggaccctacaccggcccccagtccccaccagcctgttcaggtgtcggacaaagacttccaatctttcctatcatgtttttcctactgctcttctgagaaatgttacttagttatgtgtctctttgagaaattgcttcttttcagggcaggatgctgggttatgcttgatgaagctaaataaactgccagccagatgagaattatagacaaataatatgcagggaccccccctggattcatcttagtcttgagctcatatagaattcagagaaatcaaaggcagttgacaaggagggtcaaggctgagtgcaagtgaacgcaactactcctgctggcttgatccccccctggtcatgaatggtggctgcgcgcacatccacgaccaaggcaagcctgagagacgccttggactctagcacagcagagggaaagactaaggatgcctttttctcccctctctctttctaaatgggtagcctgcactcctctcaagtgcgagacattgggactcctttgatcctcagactctgaagaaaaaatacctggtatttatcagtaccaaggcttggcccagctagaagttggaagatggggagacctagtcagctggggaaaataacaactataatactatcctatagctagatctcttcaaccacagagaaggaaaatggtccaaaattccatatgtataggccttttttgccctgcagaataaccgcaagctctgtcagcaatgtataatagaccttgcacttatagcagtgatatccagccagacttaatccagacagaagggaaaaaacagtctgcctccttagaagaggagacagaggcccctgcaccagcccaggtcccagctcctcttggatcatctcgtcccccttatccaggcccccttttgaacctcatcctgttagaagagttcgacctggatgcgctccagcatcacttcttcctttacaggaaatgcatagtgaatatggtcctatcaaagtacaagtccccttttctttacaagatttgaggcagataaaaagaaatctaggacaattgtgtcgaccttgataggtatattgaagcctttcagaaccttaatcaaatgtctgagctttcatggaagggtatcatgttacttctcaactagactcttagagcttcagagaagcaggcagctttacaggtcactgagacatttggagatgaaatgtttatcttattatggcacctaccaaaagggggaagaaattagggagccctttctgacagccaagcaggcagcatccaccaataatcctcaatgagactcagacactgctctaggaaagtggccgagaaaacatttttagggatgcacagtggaagatctgaaaactagaggcaaatctctcaattacattaagttatcaaccataaaccaagggtctgaagagaacccttctgttttcctggaaaaaactgagagaggctttaattaaacacccatctctctcctgactctataaaaggatagttaattttgaaagacaagtttataacccaagcagccccaaatattggaagaatgctgcaaaaagttagctattgcaccagacagtactctaaagaaaatcctgaaagtcaccaccttggtcttttataatcgggaccatgaggaagcccaagaaaaagggagaaaaggaacgagaaaaaggcagaggcactaatagctgccatacaggcatataaacctctcaatcccagggagcttctcattctatgaccggctgttatcagtgtgggagcactaaaagagagtctgcccccgaaatcagaagcagcccccacggccctgtccaatctgtaagggagactactggaagacaaactgcctccagaaacatacgtcccaaggttcagagccggcttctcaaatggtccagcaggactgatgggtcccagggctctcctccccagctctgacagcccaggctgcattaccatccaggagtcccgggtgagtctggaggtcaaaggactcagaggacagacttcctactcaacaccagagcagccattcctgttctcctctccattctgggcctcccctcctcccttagcacaactgtgagggtcgtctcaggaaagcctctgactcgatatttttctcaatcccttagctgtacctagggagacctttcgtttacctatgcctttttaatcatacctgaaagcccgactcctctgaggtagggatattttagctcacatgggaaccaccatccttatggctccattatggctccaggacagactctttgcctccctctggtggagactgatattaatccagatgtttgggcaattcaggaaaatactggctgagctacaacagtctcaccagtccaaatccatctcagggatctcatctccttccctaattaaagacaatatcccctaaaaccagaagctaggaaacaactagaagccatcattaataacctaaggatgcagggccttgttaaaccctgcgacagtccttgtaatatcctaatattggaagtacagaaagaaacccaacagggaatggagactggtccaggatctccacctcctcaatgagtaactggtgtaattaaccaatttacccagtggttcccaatccctatactttgttaacttagatacctgaaggaactaaatggtttgcattcttggaattaaaagatgctttttttctgcataccattataccccaactcccaaaacttgtttgcattcagggatccctccaaccagactacccagctaacctggatggtgttaccacagggattccaagacagcctccacctgtttgggcaggcaatctcaaaagatctctctgagttctttcaaactcaagttagtcttaatatgtagattacactctactctgtgccccaactgaggaaatttctcagaaaagcaataaggctcttcttaattttctaactgacagaggacataaagtttcaaagtccaaggctcaactccgtcagacttcagtgaagtacctatgcctggtcttgtcagaagggaccaggacactgggcgaggagagaattggatccattttctccttccttctccccaagaccctcagctaactaaagggattatcaggcattactggattctgcagcctatggatcagaaatctaattaaaagcattgcaatgcctaattataacatatctaataatctagggggacatgcccatgacaaccctattttgcaaaatcctggaatagaacagtccattttcagaggttttcttcctgtcctttctaggtgtccctaatatatgggcatggattttcccccttttagttcctctttgtgttctcattgtaatactcatatttggtccatgtgtacttaacctccttgtaaaatttgttttttctcgcctagaggccatcaaactccaagtggtcatgcaaatggaacctcggttgatggctctcttttaccaggggacacttagataggcctctaagagagacctgactgctgtttcccaaaacaacaccctctgtcagcatgaagcagaacagtcatcacccctatccgaacagcagttagatatacctcttcagagcggggattgatggcggtaggaggcaggtaaattctcagatgaaactcaaccttcaagccaaggacagtcgaaagcctgaaaaccaagctacaagttctggataaatccatggactagagagctctcattcctgtttggcatgctctctcctgattggtccttatccttcacctaccttacatatacctgcccttccccagttggtcctctacactatcgtgcctatttctaaatggtgctttttcaagcatacccacagaccaatcagcatgtacctcccccatttcaagcccataaaaacctctagactcagcctcgtggctggcaacccaccttcgggtcccctctcgctgttgagagctttcttgtcactcattaaattctactctgccttactcaaggaaaaaaaaaaaaaaaaaaaagcaatgggagatcattaattaaatggctttgaccagggaagtgacatactctgatttatgctttagaaagattattccatgtactatgagacaaatggacttagaagtacaagaatgaagaaagaagagcaaatagagcaattaggagctactacaatagccagccaaggcacaaagccaggcactgggagcacaggtctcaccttggtcaagtagtcatggatattgagagtcgccagcttggtaaggtgcccattcaaacccagagccatgagaaagccagcatactcattggccaactcagcatgcttgggcttattgtaaacaatccaagctgagtcgatctgggaggcaggagctatcttcaggccagcagccacaccattatgaaagctggcccagcttgtcatgttgggaggcacatcgatgtttccactattaaggtctactgttgtgttccgaggaggggcacgccctatccagccaaacgaagaacattgagagaataaaaatccacaaaaccaagattgttaaatttagatctttgagactaagattacttacgttttctacattcaaaaccattaaccccataatgcctggaacgttaggtctctatgaccacttaaaacttttgtacatgtgagtcaaacttaatggaactggaaaaaccttcactgtctaaacagttcattgtcctttttgttaaaatgtatgaggctatataatgagataactgataccaatttaacattatacagagatgactgggataatcactcattttttctttcaaacagagagcttaaaaaccaaaatgaagactaacatcactgttaaactatacaagttataaatcccaacatctgatgacactgatgttaatttcaaatgttctatcctatattttcccctagacattaaggaaaaatgacatcttaagaaaagacaaaagccaggcctggtggtgcgtgcctgtcccagctacttgggaggctaaggcatgagaatcacttgaacctgggaggcagaggttgcagtgagccaagatcatgccattgcactcccacctgggcagcagacagagactgcatctcaaaaaagaaaaaaaaaaaaggaaacaagaaccttaataaatctgctacaggtcttacctatatatgcccccttctctctctttttttctctctctctctatatatacatacagatatagatatctaattatatgctatcgtttaaaatgcttagagatagttttgtaaaaagcatccttttatagacttgagtcacccagtgaacttcaaaagggcattcaccagattatacttttacggtccatttatttaagaacaatgtaaattatatgttcacaatgctatatgttccctacgaattttttcttgattcttttctttttgatctacattatacacagcaaacattgaatctttttaaatatattttgaatattgtcttaagtcacggataaaataattaacataaatattttaattactgcataaagttatccatttcactgcagctttaaaaataccatttttaaagagttctaagatgttatgtaaaataaattttaagtagatgcagtgtcttatttgtagcatgtacacatacacacacaaagcacaaagtaagacttatttgtctttactatatgctttttgtacctaaaagctaactcaactgctagtgttagcaccacaatgagtaataagttcataagttacacttgtactttctcaaaaaaggcagacatatcaatatgaaaaaactgagtgacctttctgaaacattcattcatcatatgcaagagacataatatttatacacgagagaaaataaaatgcaaagggtaaggtaaattttcttcaatgagaataacaacatacaaaagtacaacaggccacatcagtgtgggttaagcaactatttaagaaaatattctttcctaaattaagaggataacctttctttttggcctaccagaatgactaaaagaataaaatgttggattaatgtcataaacacattttaaatcatgcaaattcaattaaatgtattcagaaaaaaagatgcatgtatatattttttaaacccacccaagtatcacttgagtgctaaatcacccagattgaatacattttaacatttgccaattttgcattagattttctttttaatctgcacttattatatgaaatctttcatataaacagttggaaagactactaaaatgaacatctatataccatgccttccatcaagaatcaataattgttaaaattttgccataggtgctttacctctgagacaatttaaatattaaaagcaactctgctcactatgtccctcagtgagatcagggctcagaataagcatgatatggagatgggaatgtgttctttcacttagtcaatctcatttcctgcatgctgctcaaagcacaagcttttcacaaatctgagtggaactctggattttttaaagtatgcaatttaaaatactgtataattatgtttgcatatattatgtactatttatcatatattaaattatacattatatgctaccacatatactatacactcctacaacatacattatacattttgtataggtttcacaaaaccatatatactataatagagtttcagtgataatttcaactatgtaattgtcacctttagaacacattcaaatcagcattagggggacatgcactataaaattcattgtaatcaagactataactacagttatatatggcagaaataaaaacttgtgccagccagaaaggcaatttgacatgttccttaaaaccattcatcttgctgtcctaagagttctacttctaagcatttagcctaaatacacaggacgaatacgccccaacaatgtttataataccaaaaaactgtaatttccaacaataccaggctgcttctataaactatggtatatccgctgaatgaaatactctgaagcaaataaaaatgaatgtattgattaaaaacacgtgtatacaatacatacacataattataaacacatacatttatttgctagatataaaaggatgttcactgtaaatttttaaaaaaatctaaaatagatataaattttctgataattaaacaaatataaaattataaatatgtggaaataaacttagtaaacatatatactaaaatgttaaaaggagtgatgcagaagagtgggagtactgcaagcgaccattgtttctctttttgcttagtacatttcttgatttatacaatgatcatctgtttaaactatgacgtaagacattttaaaactaaatatttttacatattaaacttaagattatttaaaattcaagtctcatcgttatcaataatatctttctgaacttctccaagtgactttttagatcttaaaatcacctcattaaaaagcaaaaatgagtaatgaactatattctgcttctctcaaagtttagtttcacatggcatttgagctttgataaccactacagcagctattaggaaaattttaaatcactggggatagagggagcatttcttttgttttaactaatttaaagaactacacttaatgcatgtacttaatcattttcctttctcattgagcccagaatttaacataccagtcagattcaatttaggaataggcaatggctctgttggaacaggatggtacgaaaacaaggtaaacattcctcgtcctacaggaagagccatagttcgctgacacaattggagcaatctgtaattaaagtaaaaaccaacatatgaaaatgtttaaagcaaagagcaattgaaatatcatctgtaagtatttcaaaagaaggtgtactgtataagatgaagttgtctcaaagtaaattcatacacagatgtgagtgaactacccaaacatgattattttcattttaatattcttgttcctattacactcttagggagagacatatttcctctgttttgtttcatatttacattgaatgaaaaccacctggcctataaacccagccgactctctctaggcattcaaaaaaaaaaagaaatttaaaattccactccgatggatgctaaccttctcaaaggaaaatacagtacttttggggtttttatcactgtgttaatttcagtctagctgtcctcagtacatgtgggatcctcctcccatcccttttgccaatacagcctcagaagtaccatttctgtggcctgtacacaagaaaagaaacaaggtccttgtgttagaggtgaatggatttcatggtgtctccaagggaaatacagattggtttcacttacatgatggctagatttataggactaataccattatgtatcaggtatgttcaaggttaaaatggtttctgttggctctactgtgaaattaatacaccactcttcaacttcttcctatgttaaaatagcttaacattccatatagccacttaaaaaaaactaacagaaattttggaagtagggcatttataactaagaaacgcctatacaagctatatctgaagacacagaaatatcccttcagaggctgacaactgacaaacattttctctgcagacaaagctattcataagcatactccctccttaactggacacacataactgcttttctagctaactggaaagaaaaattttgctgtcttaaagattctctgggaacacaaccgcaacattaatttgggatcaggaaaattcaaagccaagaggctgttgcaacccatagaatttttttagaggaaatcttacacataattcacttcaactttgcgcaagtaacaaaattataatgagaacaatattatatcccctgaatataagatgccactgataagatgtatcattatttcatgagaaactaagaaagaaaaagcactgccaattaaactatgacacctgttcactgaaatacacaactgatttcagagatattaaaaagtgaaaaaacttgcatcttagaatcaatgaactctactactaataatggctgactgcactgagctttactatgtattgagcagtattctaagtgctatgtaaaaataattcacttgatacacagcaccatcccatgaagtatgcctacttttacaaatgaagcaactgaggcaacaagaggtaaagtaatttaaccaaagtcacccagcacagcatggccatgcctggctctagaggccatgctcataaatcctatgctctaaactcaacttctgtcactccatctttttattcacaggtgactaataactgggtacatgtggagaggaaacagttaatagggaaatcacaactaattcagatcttcagcagcctgtggctaagtgtgggtgatggttcccctcaaaacagtaccataaaaaaagtaaagagaactagaaaacagtggcagatgaatgatagatgatagagacaagcagataaaagaacaggagagaattttaaaacagaagtgtcccaagagaatagctctggaatgtcataggcatgtgagtcttataatgtatcaagggatgtatcctgtgcaggggagtggcagaagaaaggcttatctatttttatttggagtatcatctatcatatccaaaaaaaaaaaatactcatacaagtttaaactacactaaaaaccccactaacctcaaaatctattcctgatcaagacacagaaaaacaagtccagtgttttctttgtttgtaaattcttaaggtaactatcaggcaaaatagttttacattcaccttttctaaagagtaaagtgttatatgtatttcaagaggaggacgatatgaaatacaacaattacgtcctcaaaagccaaagacattttgctaacacacgtggtttgttgaagttggatgaaaacttaaaacacagggcatattttcacttgaaagtatcttttaaatctctttagggttttaaatgctaaaaacttgaaggaaaaacaaatatacacaagacacaaatgtaacaatgaaacatgacaagagatagtgcacgtgttttctttcacctgttttccttttcctcgatgaactcgtggtcactgagctctgggtactgcactacgttgacacggacaggatgcgcactctgaagaagccttcgcacatcctgcacccttaaatcttcactccatattaatgacatgacctcgtgattcatgtcattcatgccgtcatcttcctcctcagtttctgttcctgaaggaacatctgatgagagcacctgagtaacagactttattgtaataataatttcaaaagcagttaacatgcacttgctgaacatgaggatatataggctgatgtgtcttgactatactagcacagagaaaatatgttttccaaagcaggcatgggttggagccgcaatgtatactgggactctaatctacaaatctttctaaaaagtactatattgctggccgggtgtggtggctcacactctgtaatcccagcactttgggaggccgaggtgggcggatcacccgaggccaggggttccagaccagcctggccaacatggtgaggatgatttaaaaagataattggagagtaatgaaataatttaactttctacttgcaggattcctagaactcatttgaaaaaaaaaacagacttgatgattgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatatttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgctcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagggatcaggaaaatgcaaattaaagctactgagaaatataaatgtcaaagccaatcaatactaaatgttggcaactatgtagagcaataataattctttttattctttttttttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttttagtagagacagggtttcaccgtattagccaggatggtctcgatctcctgacctcgtgatccacccgcctcggcctcccaaagtgctggcattacaggcatgagccaccgcgcctggcccaagcaacaataatgcttatccatagccaatggtagtgtaaactggtacaaccactttggaaaacagttggtatgtataggtcaatccacccatttgatccatcaacagccatatagaaacttatacccatgtacaaagacacaggtataaaaatattcattagcaatactggtttgttatggaaaaaaaaaaagagatggagaaaggggtgagtccgattgtctatcatcaatagaatgggtaattaaattatgatatgttcaaacaaagtaatctctatatcagagaaaatgaatggcccgctgctactgctacatgagtcgacatggatgaatctttaaaaaacaaagttgagtgaagaaaaaggaacacatatttacatctatatattttcaaaactacataagacctagcaatttataaagatgtaaaactataaagaaaaacaagagtaaggtaacacaaatgtaggtagggcagtggttcactataacattggggtgtgtgacaggaggggaccatccaagaacagatatgtaagggccttctactatgcgggtaatattctatttctaggggtgggtgaccagtacatcaatactcactttagtaccattctctaaactaaacatatacgtttgacatattattttgtaagtataccatatttcatatttaaatttatcctcaggttaattaaatcatgtttttcttatgattttctaaatttcataatactatgcattatttataatataaaaagtcgattaactattgaggcaaaaaatgtttccttatatgagaataacacttattaaatattatgcaatatacaaatggatagaactaatccaatatttttcagcataggtatcctgtatgtatactatgcaacagttattgtcatttttaaggtaaaatgcaaaaaaaaaaaaaaaaaacctgtcagaaacttcatttagaacatactttagataagacttcaaaaacatcttttaatattcattaaaactttactttttaacatacatcccatataacatcctcatttttaaaatcatgtcttcgtggcagtaatttttgtttttcagttctttgtgaaaaaaaatttctttggtattttacttaatttaaaacctaggagcataggtttggggaatagggaatatagaactcttttccttcctcttcctcttcccagttcaatgttcatcttggtgcctgaaatcccttcaaaagtgcatttatccttcaaaagtataccctgaaatgtttatattattgcttttagactttgccaaaaccacccatttctgatatctgagtatcacaatgatttcaggtgtgtatgtaggtgattagagttctccattctcagagaccagcttacatagccacagcctcaaatgttccaattaaatggcaaataaagattccttatgcatcaagataaaaagctggtatcccaaatattattatatgaaagttgtgagattgtcgagaaaaaaagaatatggcttgatgaaccataatctcaatcttgtgaggccttttcacaaagccagagcccctctctcctcatgccttccacttctagctagtctggaggaagcacggcctagttaggaggtaacaaagaagctctcacctacattagtcatccagacaaccaatctttcagctagactagaaacagatgtagaatgcctgaaactaaacctataagagaataaaacataaagttattaagcagaacagtaaataatattgttttaagtgtttgacataaaagcacagtctaaataaaagtcacctgttttcctcttgttctacttgcaacttctggggggctaaaaggcaacaaaatgaaacttaattttgatagtcatcctggtaaagaaaacatgtaacatgtagaaaacatttgaaaataagaatcaattagcaaacaacatctaaaaaaaaataaaataagcaatactgtggcaggctgaaaagtacagtcaaggccctcagaatactcaggggattggttaggacaccccatgcgtacccaaatccgtgcatgctcaagtcctgcaactggccctgcagaacctgcatatgggtttcacatcagagaatactgcattttctatctgcatttggctgaaaagaatttcattgtaagtggacccacacaactcaaactcatgttgttcaagagtcaatggtacaataatttccttcaggctaaaatagtcctttttacccgcactgaaaatacaagatgtattagattttaagtaatcctgatacctgaaaattagttgtggacaaaagaccgcaacagaccagaacagtactaaaaaggtaagacatggccgccaaagcaaacaagaaaaattcaattcttttttcaattctgatactgacatttacaaaaatttgtttccagaggcaacattgcaccaacttacctatagttattctggttaaatactgtgaggattcatcagaaaccaagctctcatcaccaagtatgtacagtgcaatactctgcaaaggaagaaaattaacattatttttctcttttcagagacagcatctcactttgtcacccaggctggagtgcagtgacacaatcacagctcactgcagcctcaaactccttggctcaagcaatcttcctgcttcagtctccagagtagctaggactataggcacacaccaccatgcccagcttattattttatattatttttattttttgtaaagacggagtctcgctgtgttgcccaggctgggctcaaactcatgacctcgagcaatccttctgcctcagcctcccaaactgctgggattataggtatgagccaccacacctagctacataattgaagtataactagaaaataattataacatagaataattcatccattttaggtgtacagctctgtgagtttcgacaaatgttgtatcacataaccactaccacactcacaatatagtatactttcatcacaccaaaaagttcccttgttccttttgtagtcaatcctttcctcctacacccagcactggaaacaattcatctgttttcttgctctacagttttgtctatcctacaatatcatgtaaatcaatcatatgatatgtagtcttttttgtgctacttctttaacttagcataagtctttgagattcattcacgtctctccaaggatcactagtttcttccttttcatgctaagtagtattccattatacagacataccaaactttgtttacctactcaaaaactgatgaacatttggttccagtttgtggtcactatgaccaaagctgctttatttatttatttattttttttttttttgagacggagtctcactatgtcgccaggctggagcgcagtggcacaatctcggctcactgcaacctccgcctcctgggttcaagcgattctcccaccttagcctccagagtggctgggattacaggcatgcgccaccacgcccagctaatttttgtatttttagtagagacagggtttcaccatgttggccaggatggtctcgatctcctgacctcgtgatccgccctcctcggcctcccaaagtgctgagattatgccaccgcacctggccccaaagacattcacatacatgcgggtctttatgtaggcatatgttttcatttatcttaagtaaatacgaaagtgtatgtttaacttcacaagaaactgccagttttgcaaagtgccatgccacttttgcagtcccaccagtaatgtatgagagtttcgattgctccatatcctcaccaaaagttattttcagtcattccaacaggtatcgaatagtgctctctcactatctaagaagtatctagtagtacagagctgtagtgttatttgctttgaagaggaaaagaaaaagataacacaaaggaaaaagtctctcaaaagagttaaaatattcaacatataacacaaacacaaaagtacataagatctctctattaaatgagaaaacatacataaagttccttgaagacaacaggctcccaataaatgttatctcacttccttcctttccctcatttcaacaaatggtacacagacaatgccatctccgcatatacaagtgactcaatagaaaaagagccaccataagctagaaggttactacaaatgtctcattagctaaacatcacataaaaaaaatttatcacttgcggtcaggagttcaagaccagcctgggcaacatggcaaaaccccatctctactaaaaatacaaaaattagccgggtgtgatggtgtgcacctgtggtcccagctactcaggaggccgaggtggaaggactgcttgagccccgggaggttgaggctgcagtgagccatgattgcaccactgcactccagcctgggtgacagagtaagaccttgtctcaaataaaaaaaataaaaaataaaaaaagtccaataaaacttataatgaggaaaccaaaaacgtatcaacaagggcttctgttgatatttttcagaatatttttataaataaaaattaaattcatatttttataaatagatctctgagctaacaagttataaaggaatacgaagaggataaaactaagatgaaaggccagagaggtaaactgagcactcatgacagttttactgaaaagacattcacagaaaaacctatagaatgggagaaaatatttgcaaatcatgtatctgacacattaatatctagagcataaaaatgcctaaacttgaaaataaaaatccaattttcaaatacacaaaagatctgcatagatctttcttcaaagaagatacgtaaatggccaataaacacaagaaaatatgctcaatatcactaaattaaggaggcaaatcaaaacaatgagatatcacttcataaatactaggatggctataatttttaaaaaaacaaatagaaaataataatatgtgttggcaagaccgtagagaaattggaacccttcctcttgcattgctgataaggatgtaaaatggtatagccactatgaaaatgagtttagcagttcctcaaaaagttaaacatcgaactacctaccatatgacccaacaattccaccaccaggtatatattaaaaagaactgaaagcagagacttgaacagatatttgcatacccatggttcacagcagcactattcgcaacagtcaaaaggtggaaacaacccaaatgtccatcatcaggtgaaatgataaattgtggtatatccatacaatggaatactatatagaatactgcctttaaaacaatgtaattttgatacatgctacaatatggatgaacattgaaaacattatgctaagtgaaataagccagacacagagagataaatattgcttgattcccataacatgaggtacttacaagagacaaattcataagaaacagaacggaattaccagggcctgggaggaaggggaatggggagtcactatctaataggtacagagtttatgttggggatgatgaaaaagtcttgggtacggacagtggtgatggcaacataacaatgtgaacgtattcaacgccactggattgtacactcaaaaataatttcaggccgggcacagtggctcacgcctgtaacccctgcactttgggaggccaaggtgggcagatcacctgatgtcaggagttcaagaccagcctggccaacatggtgaaccccatctctactaaaaatacaaaaattagccagacttggtgactaacgcctgtaatcccagctactcgggaggctgaggcaggagaatcgcttgaacctaggtggcggaggttgcagtgagccgagattgtgccactgcactccagcctgggcaacagagtgactccgtctcaagaaacaataataataacaatttcaatgacaaatattatgttatatatattttgctatcattaaaaaaatcccgtgttttttaaacagaaacatcattctgtatgtctgttttggagccatgggggggactgtgaagcacttctcaccatgaagcagagcaaaatgtagagtaaagaaaaagaagggcagggggcaaagacatttacagtctgccaacatttgagagaagggacaaaagcatatggttctcctgcaagcctgggaagaccccacctggaaaggcccacaaggggcctatgagcaggctgctccaggatggggggactgaggaacaggtatgccaagaaacttaccttattcaccgttacagccctatggttctatatgaaggtttgatcttggacatgtattaaccagtaataacaaactaatttctaaaaataaataaatcatgagatttgcagctagaggtaaacaaaaaataataaaaataaataaagaagtgtttcttgaaaaaaatttcaacaggatttttctttgtagctatagacaagctgattataaaatcagtatgggacgggcacggtggctcacacctgtaatcccagcactttgggaggctgagccaggcggatcacttgaggttgaaagttcgagaccagcctggacaatatggtgaaaccccgtctctactaaaaatacaaaaaattagccgggcatggtgtgggatcctgtaatcccagctatttgggaggctgaggcaggagaatcgcctgaacccagaaggtggaggttgcagtgagctgagatcactccactgcactctagcctaggcgacagagtgagactctgtctcaaaaataaaaataaaaataaaatcagtatgaaaaggcaagaagagtaatgaagggaggagtaacgctaatcaattttaaagacttactataaagctacagtaattacagcgtagacagccacaaagatcaatgaaccagaatagaaagtccagaaacagacacacaagaatgtggccaaattaacttttgacaaaagtgcaaatgcaatagagaaaggatagtctttttaaaaaacagtgctgaaagaactggatatccaaatgaaataataaaaaccttgacttaaaacctgacatgttataaaagattaacaaaatggattagagatctaaatgtaaaacatgcaaagaaacccaggagaaaatcttcaaaacctgaagttaaacaaagaattattagacatgacactaaaagcaacatccattaaagaaaaatacagataaactagcttcatcaaaattaaacacttttgctctttgatgtattaagagaatgacgagacaagacaaggtagaaaccagaagaaaatatctgcaaaccacatatctgacaaaacctcatacctagaaccctgaaaacatcattagccattaggaaaatgcaaattaaaaccacaatgaggtataactacacatctctcagaaagacaaaaataaaaaagagtgacaataccaaacaccaacaagaatgcaggtaaatgatctcttaaatattggtggtaaaaatgtaaaatggaagagccactctggaaaacagatgacagtttctttaaaaacaaaatataaacttaactatatgacccatcaatcctactcccaggtacctgtcctagagaaagcaaaacttatgttcacataaaacgctaagcatgaatgctgacagcatctatatttacaattgctaaaaactgaaatcaacccaactatcttgaatgaaaaaccaactatggcacattcatgcaataaactactaattagccatagaatgcgatgaactgtcgatacaggaaacaacttggataagtctcgaaatcatgagagaaatttttgagggtgatgtaaatgttctatatcctcattgtagtaattacatgaatctatacacgtactgaaattcacagaactatacacagaaaaaaacttaatatcaggtgtactttttaaaactaaattttaaaagaaaaaggagataggtagtaacactccacatacataccaagactacaagtctgcttctttcacagattccagggaggtaaggataaggtggcattccttcacccttcagacaagaactcacccactgataaatacttggtggctcagacgtaaaaaatgatggatgatgcataaatcctgtttgacctttaaaattagataaatattcaaaaagacacgaaaatacattaagacaacattattttattttaaacggaagatgatcaacagttacttgtcattttgaaacaactagaataatatttttccagctgggtgcagtggctcacgcctgtaaccccagtactttgggaggcccaagcaggtggatcacgaggtcaggagttaaggacagcctggccaatatggtgaaaccccgtctctactaaaaatacaaaaaaaaattagctgggcctagtggtgcgcacccgtagtcccagctgcttgggagactgaggcagaagaatcacttgaacccaggaggtggaggttgcagtgagccgagatcacgcctaagagacagagcgagactctgtctcaaaaaaaaaaaaaaaaaaaagaataacgtttttccatattctccaaaatgcttcatgttttctgccacagtacataaggaactatgttattaaatgtagaatttaaatgacttctattttatcccaccctggatggaaatttagcaaattcttgttcccaaggcatacaaagaatctaaccaaaggctggatgtggtggctaacacctgtaatcccagccccttgggaggctgagtcaggtggatcacttgaggtcaggagttcaaggccagcctggccaacatggtgaaaccccatcactactaaaaatacaaaaattagccaggcgtggtggcacacacctgtaaccccaggcaatcccaggcacttgggaggctgaggcaggagaatcgcttgagcctggaaggcagaggatgcagtgagccaagatcgtaccactgcactcccgtctgggcgacagagtgagaccctgtctcaagaaaaaaaaaaaaaaaaaaagaagaatctaatcaaaaatcttgccctaaacctaaaggtgaaaaaaacaaaagaaacatccaggattcaggtctgttccaacaactgggccccaaatttcagtacctttagctcagggtctaggatagtacagtggtgatggagatgttctgtgtctgtatctgcactgtccaatatggtagcactagccccatgtggctactgagttctcaaaatgcggctagtgcactgaggaaatatgttttattttaattgaatttaagtagcatatggttagtggtactaactgtacactacaagtctaagttaaaagcatccttggtggcctggcgcggtggctcacgcctgtaatcccagcactttgggaggccgaggcgggtggatcacgaggtcaggagatcaagaccatcctgtgtaacacagttaaacctcgtctctaataacaatacagaaaaattagccaggtgtggtggtgggcacctgtagtcccagctattcaggaggccaggaggctgaggcaggagaatggtgtgaacccaggaggcagagcttgcagtgagccaagatcgcgccactgcaccccagcctgggtgacagagcgagactcagtctcaaaaaaaaaaaaaaaaaaagcatccttgaccctggaagctttctctgacttttgcaagtcagaaccttagggatgggtaacattttccctatacactgaagatattatggcttactacgtgtcagaaaacaagcactacgaactaaaatctgcctggtggaaaggcactgcccctgacttagaagctaatggtaagaaatacatcctctgctattcaatgagaaagatacaaggaaatatcactacactgtttagaaaatatttaaaagcacgactacttacctggatcaattgtgcacacttgtccagtagttctgacaagcgttgggtagtctctatagtaatgatctacataaggccccaattttaagtccctaaaacagtaagggcatgtaaaaaagaaggtattacagcactttctcccaacagaattggaaggattgattagttgaatcttttaatttaaaaacttacatatgagaaagataaccaaatctagagtctctctattgtatttttggactttaaagtgcccagtgtgacaaatggaacccaatctctttttgctaaattttgtggaagtaaaactacagtaaaagcaccgtgatctagttcctcctctgctattagctgtgtgatcttccaaaagtcatgtctataaacctcagtattttcttctagaaaatggggcaataccagctcacttactctgaagttttaaagattaaataagataaaatatgtaaaaaaaaaaaaacctgataaaatgtaaaacatcatacacattacttttttcagagagccatgattatggtttggaaattacttaattacaaaagaattttcatgacagtaatgacatcctaagagatatttaccattgattaaaactgccatgtctcaggattgaatttcaagatctcaaaaaagacaacagaaattagaaaatgtactatgtcttaactcagaggttgacatttcaattcaaattcaacttctttatcaccaaaggtcataaaggtcaaacaacacacaagtatgaccctagaattctgagccatacaccaggtgcttcaaagctcttgaaaggtgttgaaacgtattattagaactatcttattgtggatctactatgagtgcctcaaagacagggacaacctcagactgcaacaaggacagcatagcaaaatgagtccacaactatcaaacactcgcatcccaggaaagacatttaggcaagtttcctcatcactaaaacaggaaacttaccttgtttgagactttacatgtaaactatgattttgtcaactataaagcactatttgaatgtggatattacaaaacagcagatgttattctagaactcccaccgcagtatagccagtcagtcatcctgtcaaaatgaaaatctgagcaggtcatctccattttttcgtgaccttccactaatctcaggacaaagactaaaaatccctgcatggctcacaggcccttacaaaaccagtatcttcaaacaactctgtggtttacagagatgccctagttttctgagaaggtagatttcagaaacttatttacaaggtccctatatgatacaaggttcctatatggaaaagacagtcatctcaggacttcctggcagtttctaacctacaaacaaatttaccttgccaactgaacgagaagttcaacaagtgaacaaattccttctcccattagagtattcaacttaagctcctcatacacaaggtgaagaacgaaaaaaattgcaggtatgtgagtaaagagaagtgtagaagaatccagactgagattctgtgaaaaatcctcatccttcatctgtgaagcttctgaaggactcagacataaagatctgttcaaaagatgagactcaacattctggtggtagtctgaatttagtaaatattcccagtcctgagaagaataaaaagaatattaatttttaaaaataatacctccttataatatcataagaaaattaattcacttaaaacaattcaagtttcattttcacattaagttgatctaagagtatgttaaaaaaaaaaaagacaatgctaagaatgaagtaactataaaatagcaagccagttataaacgttaaggcaagccacctttaaaaaccattaaaaaaaatattttcatgaccttttaggaaagacattgggagaagaattatactatttaggtagagattgagagagaaaatttaagattatctcaggctaggttttataggaaaagtagatggcaagttagtggccactacactgaactgtgttttggtaagaaggaaggtccacctgcattcagctggtgtattcatctttccacatgtataagatgccggggctagtaatataatctaataatcaactgatttttatattcagactgattggactacattttccaaatattcaagtctattttggttctacttgtgatttactgcatttggttcagagaatgtggtttatgctatttccagatcttggaatttactgatgtttttgtaaggcttaatacagtgtgttactctaaattaaaaattcttggactagatacagaaagaactaaccataaaagaaaaaactgggccgggtgcagtggctcatgcctgtaatcccagcactttgggaggccgaggcgggtggatcacaaggtcaggagatcacgaccttcctggctaacacggtggaaccccatcacttctaaaaaaatacaaaaaaattagccgggtgtggtggcgggcgcctgttagtcccagctattggggaggctgaggcaggagaatggcatgaacctgggaggcagagcttgcagtgagctgagatcatgccactgcactccagcctgggcaacagagcgagactccatctcaaaaataaaataaaataaaataaaaaactgataaattggataactaaaataaaaaattctgctcatcaaagacactgttaaagccacattctaagggaaaatatggtcaagaactcatgtctagaacatgtaagaacttcaacagcttacatattttttaaaatctaatttacaagtagataaagatttgaatagaaacttcacaaaaagatacataagcagctaatgagcacatgaaagagtgtttaacatcctccaacctcagcctccaagtagctaggactacaggttatgcgccatcatgcctggctaattttcaaatttttttggtagacaactggtcttactataatatgttgtccaggctggtctcaaactcttgggctgaagcagtcctcctgcccctacccctcaaagtgctgtgattacaggcgtgaattttcatttaaaagaaattaaattaaaagaaattaaaattacagatgtgaattttaatttaaaagaaattaaattaaattaaaagaaattaaaattcacacctgtaatcgcagcactttgagagataggggcaggaggactgcttgagcccaggagtttgagaccagcctgggcaacatattatagtaacaccttgtctctaccaaaaaaatttaaaaattagccaggcgtgatggagcataccggtagtcctagctacttggaggctgaggtaggaggatggcttgagcctaggagttcaagattacagtcaactacgatagcatcactgcagtccagcgtaggcaacagagtgacaccctgtctcttaaaaaaaaaaagaaaagaaatgaaaatgtatgtccacgggcccggcatggtggctcacacctgtaatctcagcactttgggaggccaacatgggcagattattgaggccaggagtttgagaccagactgaccaacatggcaaaatccagtctctactaaaaatacaaaaattagccaggcatggtggcacacacctgtaattctagctactggggaggctgaggcatgagaactgcctgaactcgggagtcagaggttgcagtgagccaagatcgtgccactgcactccagcctggatgacagagcaagactccgtctcaaaaaaaaaaaaagaaaatatatatccacaaagacttgccagtgaattttggcactagcttgctttattcataagactttaaaaaaaaaaaatggaaatagcctagatatctaccagcagaagaaggatagataaacaaaccatggtatattcacactactcagcaataaaaaagcacaaactactggtatctgtaacaatatgaattaatctcaaaagcattatgctgaataaatcttataccaaagattacatactatattattttatttacatcaagttctagaacaggtataactaagatatggtgacagaattcagatcagtgattgctagaagaagagaataaagctgattaaaaacagcaagaggggccgggcccagtggctcatgcctgtaatcccagaactttgggaggccgaggtgggcagatcacgaggtcacgagttcaagaccagcctgaccaacatggtgaaaccccatctctactaaaaatacaaaaattggccaggcgtggtggcgcatgcctataatcccagctattcaggaggttgaggcaggagaatagcttcaacccaggaggtggagagccgacatcgtgccactgcactccagcctgggcgataaggcgagactccgtctcaaaaaaaaaaaaaccacacaaggaaattttatggagttataaaaatattgtgtgtctttataggagtgtaggttacatgagtgtgcatatattaaaactgatcaaactaaacccaagctgtatttcatttttgtaaattacaccacaatttaaaaaaacatatttggaccactgaagaataataccatggaggccaggtgtggtggctcatgcctgtaatcccagcactttgggacaccaaggttaggaaggtcacttgacgtcaggagttcgagaccagcctggccaacatggtgaaaccctgtctccaccaaaactacaaaaattagctgggcatggtggcgggcgcctgtaatcccagctattcaggaggctgaggcaggagaactgcttgaacctgggaggcggagattgcagtgagctcagatcctgccactgcactccatcccgggcaacaagagtgatactccgtctcaaaaaaaaaaaggaatataccatggaacctgatacaattgagaaccttaatttaaaaaacactgcataaaaaaggtaaatgctgtcatttcaggtgatcagttgatactaaaatgtctacaaacccaaactgaaatcatgcagtaatacatgtattaatttttagataatcattaaagaccacagaaaatgtaacagatcctactcttcaaaataattgctattcagtattaaaataaataaagtgaaaggtgttggaaagatagaggaattgataggaataccacagaagtggaagaatagtatgaatatccataaattaatttatattagcaagaaataataatgcttacatcatcagatccagtctcggaaggccttgcttttttgggcgcaatgacaggagaaagtgatccttcaaagtcaaactgaaaagtaaccccaaaagaaaagataaaaatcgtaaatgcattcctgtcaactgatcaacttcaaggattcagaaatcagttctgccaattacgaaaactgagaaaagccatcaaaactcattttttgatctggaaaggcattatttaaatatctttcttccaggttactgtaaagatgaaatgaaatcatattaatatatgcaaacatctagaacagtgcctgggcttctaaggactgattttaatggtagtttccttccctctcctactcctgtaacaacatagattacatcacatctttggtagaaaaagaaactttaggcatatccacaatataccaagtctcaaaggatcaacccaatatcagtcaaatgttagaactaagcaaacatttatttacagtccacctacagtaaactatctaacaattctatggcagagacaagtagctactctggaaaatcttttttctcctctttctcctgaacccacagccagactacatacatacgtctgcctcctttgaagttaggtgtgaccctttgacagagttaattataaatggaagtcactgtcatcacttccaggaccagtccagtcctacccctgctcctccaggctctttgccccttccacctgactggaatgcagtcaaccaatggcaatctttgaaccaaagataaaagatcctccatcaacctgggttcctgaataactgtgtggcctgtttatctgctaagccctgttatgtaagcaagacagacatttttattgtgtttgagccattgtatcttttgaggcctttctattacaatagtgagcctatcttctaactaatacaactacataaaagcagttttctacaagttgctcttcttcaatttcccctggcataatctttgctgccccagctacttcacatgggcattgaccatcaactaataaactgtaactctataaatggcaatggctattttcctatgctgaaaaacttacatatttatcaactcactcacctaaacagagttgatttctatataaaaactaaacataggtagcaataaagtgatatttaaaactgaatgttattgagagagaagatctgcttgtgaagcgttcaaataaaaaacagcccaactcatatatattataaaaaacctggtagtaacagtgaaatcaaagcaacaaatataacagtaactatctaacctaaaacttcaaccaaaatgtaacacacacaaactcccacagtcaaaaagaatgtccctgctataattatcagattcataaggcctggagttatgagaaagtagaaactgcctgataaggatggctctttgtgccatacatggatctgtttaatcttcactctttcaatgtgtctcaggttagccaaccctgttatatgctcctatggacccttacccttcatctatcataacacatttatcaaatattatttatttgtttcccccaagacagtcaattccagaggaacaatctgttttgtctggggtatatgtgagaaacctggcatcatgcctggcccacagcagggattcaatatttatctaaggaaaaaaacagcagcccggaagccacaaaaagttaaccccaaatgcaactgttcctacaatgtacagtccagtgcactcatgtaacacatcagcaaattaaagaaagcacaaagaaatgccaaaaattgtgtaacgagtcattggcagaaattctgtactccaccacattacatatgtgaaaacaaaaagaataaatctgaacaaagcaaaatgaaaaccatttgccaatgaggaccattttatcctaagctttgactatgaggacaaaagataacaagggtttaaccatgcagtcctataaataaatagcaaagcaacttggcctcaagaattgatttccttattccttcctttataattatcatgcaataagtaagtcaaaaagccatgtccttctctgcaaaggaaaaaatgggtaggtgctcagtcctccccaaaacatggaaacgcgaaggggcataggttctctgccagagactaggacacaacaatctgtactcatcaacaagttacaaggacaatgatacacaaaactacagaaagctgacgcgttttttcataatgtagaaatccagtttctatgaggcttaatcttttcacatgtaataaagaacagaaaaattggggataatgtcactcggatacaattgtttaaaataagaaaagaaggccaggagccgtggttcacacctgtaatcctagcactttgggaggccaaggtgggaggatcacttgagctcaggagtttaaaaccatcatagccgacacggcaaaaccccgtctctactaaaaataaagaaattagccaggcgtggaggtacatgcctgtaatcccagctactcaggaggctgaggcacaagaatcgcttcaacttaggaggcagaggttgtagtgagccaggatagcgccactgcattccagcctagacgacagagcgaaaccccgtcttaaaaaaggaaagaaaagaaaattgtccctattttcccataagatttctctcaaggaaattgcagagagcaattccttcatgtgctgaaatagacacaaactcttaaaaacagtatctcactcagatggaaaatggcattcactcaacaaatgttcactgagtatccttctatgccaggcaataccacaggtcctggagagagagagtagtaaacaaaactaagcaaaaatctttgccttcctagaatttacattccagttgggggaggaaggacacaaaacaaaataagtaaaacatatagtatattatatttaattaagtgagaagaaaaaaaaacaggtaaatggcactaaaggtatggaggcaggtgtaattctatagagacaggacaggcagcactgaggtgacatctgaataaagacctaagcacgtcttgtcggagggaaagcattctccatagaggtaatggcaagtgcaaacactcagaggcagaaacatgctggcagtgctcagggaacagagctgaggccaatgtggctgggatgatgtgtgcaaagcattaagaaataagagcaggaaggtgagcaagggctaggtcacatggcatcttataagcctatggcctttactctgagtgacatgggaagtcactgggggattctacgcagaggcgtgacgaacgcaacctgacgttatcaaacaggattactgtggccactggactgagaagagactggaacatagacaaaggacatgaaatacgaatcaaaaaataagaactataaataactgatgaaattttgaaaaaaacattcccatttacttatagagaaataagataaaatttctcaggaagctggcaaaggttcaccacaccacaaataaacactgtggtgaaatgggcgcttttaaatgatgctagtaagaatgtcacctgggaacccctttccaaacattacttgacctcacagtttctcttttaagattcaatgcttgggaagtaactagagatgtggttaaagagtcgtgaaaaaggatgtttataaattacaataacgaaaacaacagattcacaaggtacaattattagctattggttaactatgataaaactacactatgaagaaatgatggagatattttagaaaaaatttttaatgatacgggaaattttcattggtatttttatatagaaggtaacatcaaaaatatttagagtggttatctctaagtagtataattattttcttaattcctccattttccacattttcctttcataattaagacaaaaaacaaattttaaaaatggatttgctggccaggcgcagtggctcacgcctgtaattccagcactttgggaggctgagacgggcagatcatgaggtcaggagatcaagaccatcctggctaacacggtgaaaccccgtctctactaaaaatacaaaaaatcagccaggcgtggtggcgggcgcctgtagtcctggctactcgggaggctgaggcaggaaaatggcgtgaacccaggaggcagagcctgtagtgagctgagattgcgccattgcactccagcctgggcgacagagcgacattctgtctcaaaaaaaaaaaaaaaaaaatggatttgctgtgcaaggctaaaacatatagaatggtacagctgagctacctggaaaaggggtaattataatctagagtgattttttttcagagtgacccaggcaaagttgtcctgggagtgatctccaaagctagaaggagatcaccaatactgaagacaccactctgctgattttgtaaataatctaataagggcctgtaaggatgttactgcaggaagagggtgagaggtaaggctttataccattaacagagtagatactcaggctaaagtactttaaatctccctcaaatcaaaccttcctcttcacatcccaagcaatatgtgtgtaaaaagacaatcttgtcttcagaaaacaatgttaaacaaggagtcagaagatgcagtctagtcatagttgttaaaaaaccacagatctgtgatttctttgtgatccagtttcttcatcaataaaaccaagactatcactaatcctagcataacttgcagtcattttacaaaggtgaaatgagaaatagtcatatatgctttaacattctaaagctcagtaattataatcactagtaaaatgttaatattaaatattaagtgagattttatttacaatatatagatacaataaaccttaatattattctattattttgaatatggtacgcctattatgtagtctcaatgttatattaccaattatgcaaccattacattaacagaataactcataaagaaaacaatagtatttacttacatttctagtccatgctaagcggtctgtgttataacccatcatgttcatgagacaagtcacaaataaattccactctgagtgataactgggtcctcctggagcactgtggacattgtaccacttgacaagcatctgaactgctatttcttttggcaggataaacttaattgcttgcaaacacgtttgtactattaaaagcaaagattaattttagtattcttactctgcatgcatttcttttcccctttcaatcaccaagttttttaacttctactatgtaaaggccaattattatgaaaagaaaactgtcattaaagagccaatgagatgcaaacattacctaaccaatcatctgaaactaaaaccaactactgaattcaacaaggcttgaaaggggtctgaagacagcttttttttttttttttttttttgagagggtgtctcgctctgttgcccaggctggagtgctgtggcacggtcttggcacactgcaacttctgcctcctgagttcaagcgattctcctacctcagccaccaagtagctgggattacaggcgtctgccactgccccaggctaatttttgtatttttagtagagaccatgtttcaccatgttggccaggctagtctcaaactcctgacctcatgatccacccgccttggcctcccaaagcactgggattacaggtgtgagccactgtgcccggccaaggacagctttttgatcattaattttgcatcagaaataaagtaatcaaatagcccagtttgccagagacagtcctgatttacatccattgcccagcaattactaactgctcgccttcactcttaaagatgttctagctcgggtgacaaattaaaagtcactatgggccaggcatggtgactcacgcctgtaatctaagcactttgcgaggtcaaggcgggtggatcacctgaggtcaggagttcgaaaccagcctgaccaacatggtgaaaccccatttctactaaaaatacaaaaattagttgggcattgtggcaggcacctgtaatcccagctactcaggaggctgaggcaggagaatcgcctgaacccgggaggcagaggttgcagtgagccaagatcacgccattgcatttcagcctggatgactagagcgaaactctgtctcaaaaaaaaaaaaaaaagtcactatgaaaaacatacaacttctatgtttatacatttatataaaatactgcctacatacttcagtaaatatataatattcaatatatgcatccacgaatagcaatgcttagctagcattacatgatgttctaaatgagttaacatgcctattaaccaaagctttataactttatttctgaggtcgttcagtttctaaaatgtttcacaggctctctgtcttaaaagggttaagagttaataccacataatttacaccattctttttttggtaaggggaaacagggtcttcctctgtccccaggctggagtgcagtggtgcaattatagctcactgtcacctccaactcctggactcaagtggtccaccagctcaagcttcccaagtagcaaggactacagatgcatgccagcatgcctggctaattttatttttctttttgtagagacagagtctcactatgttgtccaagctggtctcaaattcctggcctcaagcaaccccctcacctcagccttccaaagggaggggattacaagcatgagcccaccacacctggccttataccattctcaatggctccacatcaattatagcactacactgtcatacaatgatcccctcagagtggccagggctaccactgtgaagagacccaaatctgcttttagtagtaaataatcccaaactgcaatgtttgtgtactcacatatcctctcttccaggattcttttttccctttccactgtcatgccactgggcccaccctcatcaacatatcctctatcccatcagtttgcaatgtgcaaactcacacagcacaggttggaagcaaataatattaaaataccaaataaccaagtatgtcatagtggaatccaaaataagtgtaaacccaatgctgcatgagtgtgtgagaaccctctgcaggtaaagtacataaacttatgtgcataaactatggggcttctgtttggctataaaggggtaagattttttgttttcatttatttaatttattccattattatttgtttttatatattttgcttaggcttataatagttcgaggtacctggccttgtgattacgaaataccttttagagccgggcgcggtggctcacgcctgtaatcccagcactttgggaggccgaggcaggtgaatcacgaggtcaggagatcgagactatcctggctaacacagtgaaaccccgtctctactaaaaatacaaaaaaattagccgggcgtggtggcgggcacctgtagtcccagctactcgggaggctgaggcaggagaatggcatgaacccgggaggcggagcttgcagtgagccgagtttgcgccactgcactccagaacctgggcgacagagcgagactccgtctcaaaaaaaaaaaaaaaaaaaataccttttagaaggcaaggaatctctatatcaacttggaataccatttaccagcagtgaaaattcctaaaatgaaaaagtcattcttgtctacaatctgccaatgtcctgctttggcagttagatttgaaaccaagatatgtcatgaacttccttatatcatacaggcattcttttcttaacctacgtttgttggcaaatcccttcaattctaacattttgtttactatgctatgttcagaaatattctcctcaagcatttttgaaattgcatctcaggaataattcaagcagaatccaatatttattaagataattctgattgtattttgacaataatattaagttttattcaattaaggcaattaggttactttcacaatttatctgaaaattgagatatttattttaaaattaaaaacatcattaatacattacagaaaaaaaaacattaaatatgccaagaattatcttagttgcttaagcttccagtttcccagatgttcttgcaagaggcatgtccatatatatacatatacatatatatatatatatatatatatattttttttttttttttttttttttttttgagacagagtctcactctatcacctaggctggagtgcagtggcacgatctccactcactgcaacctccgcattctgggttcaagcgattctcctgcttcagactcccaagtagctgagattacagaagtgcgccaccacaccccgctgatttttgtatttttagtagagaaagggtttcaccatgttggccaggctagtctcaaactaccgacctcaagcgatccacccgcctcagtctcacaaagtgttgggattacaggtgtgagccaccatgcccagcaggcatgtccatatattattatactgcacaatattccccaacagaagaacctcagggaacagaactagcacatccttcacctgtactccagccttagagcgcacgtagagtggacatcacaaagcactccctagctctttaaagctcctctacaaagctaagaacttgatccagtggcttcaaaaatggcaaaataatgtttaaaaccccaattattaatgtaaatcacaattacttcatgtcttataaatgaaacttctcaatcgtacctaactcagaggtggcaatttcaggaatagtgatcctaaccatggagccattactcagttcctagatggaaacaaatgagaaagtagataaaatctgtgcattctaagtctttgaatgtcttaaaaatagctggtacaagactttgcccatcaaagcaataaaataaatgaaaaacaattttcaaacagaaatgaacacttccgaatttcagaaactttaaatgtaattatttgcaaaatgttttccaaaatgcttgttttaataaaaagtgtctaatctttatacagtgagtcaccatcatcaaaaggacatttacttttaatgagaagacaaaaaatcacatcaatatacaattcaactgactcaacaagcttttgttttcactaagtttttaataatacagaaactgtagaaaacaagcagaattactgtatagtaaaaagtaaaatcgtgccaaaaaatgacacaatagatttttttaaatcatgagaaatgtttgttgtcatttttcagacaaaattctgtattctgtcaaatttgaaatgccagcccacttcttggaaagctaccaaatgtttatacttaccagggtgactctgttatggacaggatctctgatagaatgaatgtaagttccaagctgttggaaagtacaatcctcattatagagagaatcatgaagttttgaagaatccctcagttctggaactggggacaacagaacaacctgtaaaaagttgtaaatacgatacaaatgaattgttttctgagaaattaaggacaaggaaatttaactgtttcttttttgcatatggtctaacaaacaataatatgtaatgattcaaaaacattctgctccaagccaagcatggtggtgcacacctgtatagtcccagctactcagaagactgagacaggagaatcacttaagcctaggaatttgaggctgtagtgagcctgtgaatagtcactgccctccagcctggatgacacggcaagacccaggctctttaaaacattttgttccagatacaatgaagtaccagcaaaccaaggtcctcacagaaaacaactagaaaaggtaggtaaaaggaaaacatctgattggtggctatggaaaagctgtggaagcaacctggacttgagggaccaagatctaggagagaaggcaactgcagggaaaggggccaacgttcttggagagccttgctttttctgctctggccatctgcaaattttggtggtaagaggaacatatggaaaggctgacaatatgcaaggaaagtcatagctaagagggagagaagccagcagcactgttagcaaccttacagggctaaagactaaactgtgagccggggcacgcggtggctcatgcctataatcccagcaccttgggaggctgaggcgggtggatcacttgaggtcaagagttcaagaccagcctggccaacatggtgaaaccccatctctactaaaaatacaaaaattagccaggtgtggtggcgggtgcctgtagtcccagctatttgggaggctgaggcagaagaatcgcttgaacccaggaggtggaggttgcagtacggtgagattgccccactgtactccagcctagatgacagggcaagactccatctcaaaaaaaaaaaaaagactaaactgtgatttgaggcagctgaggaactaagagcccaggaagaaaggacagtaatgaaaaagccaacaaatgagaccagtatttaatggtatttcccctataggcaattatttattcaaaaatacaggaacagtatttatttgcttaactgcagatatgcaaacaaaaaatttaaacgatcttagttactatctacatgcagatgcttccaatcttaaactctagtcatgaccactgatcctttttgattcctttaattcaatttatatatctctaagtgaatatcttgtcaacactgacaatcaagactaagatgtatttactctattccagattctactctaaaagtcaccaggaaaaattcagctccgctggtcctggctctaagtctactagcaaaatcttccagagaagtggaaaagccatcaatcagccaatgtgttaagactatcatttccatgactttacacctatcaaaaaggcactattaccaggcttatagaattctaaaaaagttggaaaccattttccattataaaagaaattcttccaaatcacacagaacactctgacacttctccagttccccctttgaatgttctgcaaatgtgctggtttgaaggaaaaaaaattcaatgtggcacatgtttaaaaatataatgaagacacagacattatcaaatacaactgatagcactaaccttccctttgaaccgtccctaaacatccacactcacatgtcctttaaatacaaaccacttttctccaggcttcctaacttggtaaatccaggtaccttcccaggtcattcagagaattcggagcctcgttccacatcacctttccccagcccagcagcacaaaaccaatcagctgacaaactcatttccacctctcaaggcctctcatattaatccctcctttccacacatatactgccctagctcagaccctcttcatacttcttaaactgacacagacaacctcacttggaggctaaccggtctccttatctttaatcccaaaatacacctatttacaacacagatccaaaacctcataactcctttctcaaaatcctgtaatgccctgtcaattgcattcagaataaaaccacctttttatcctttctgcctttaagagcacattagtaagagtgtaaatcccagttctaccacttattaggtttatttcatttgtaacttctatctcatttgtaaaaaaaagaatcatagtactatcttctcaataaagctattctaaggaaataattaatactaataaagcactgagaacaatgcctagcacatagaaaatgctcaaaaaaggttattattgttatccaaaccctatcctgcctcaccctacagactacttgtacttttataagtatttattctacagatttattgagtccttatgactaggagatgaagatacaaatatccactaaaaaatgttccacattatctggccttcctgcctgtgcctgtgtggtttctccttgccctgaatgctcctttctacctacagatatcctactcaaccccaaggtccaaacgaagactgacatgtctctcagtgaggctttgattttgccatgtcctcccattggatgttatcttcccatcggatgttatcttcccatcagtcaatcaacgatggtactctcttttccacattactgagtcatgagtctttcttaaattctaatttcttatgcagacagtacatcaactccacacaattgtgagatccctagatggaaaagaatgtatcatttccatctctccagcaccttcaaaaagtatcacatacatcacaagggaggtcagtgtatgttaactgaatcacttctgtttgaaaacatttattctgcaagtagaaactaaaattaagttaaccatggaaagaactaatgtttaaccaaacttctttaaaaaatgttaactttttggcaacacctagtccttttcttacctcgtccaatgatccaaggagtttactaagaggctttggagtactaacgccatctagtggagtactgggccgaggcattgtgttggacatcgtcagagagggagctggcagtccaggaataaaaacctttcccacctttaagcaataaaaacatgtggaaaaaaaaatattgcctttaatgcatcatatccttaaataaaatgttaaggaatataaacatatatttcttttgatatttctaagtttatactcaccaaacacagcaaagaaacaattcaaatgtcaataatctatccaattccactatccaactgcaaatatgttggtataattttttttttttttgagataagatctcactcttttcccgtgggtggagtacagtggcatgatctcagctcactgcagcctcaacctaccaggctcaagtgatcctcccacttcagcctcctgagtagctggaactataggcacatgccactatgcctggttaattttgtattttttggtagagacagggtttcaccatgttatccaggctggtcttgaacttctgggctgaagccatctgcccacctagacctctcacaccttggtataatttctcttggttggattccttctcttcattactgaagacttttttttgcaggcaaggagaggaatgttaatatagtcaacacattatataaaaatctgcacactatgtactcttctacctttttggtcataaagacagtaagaacagcggccgggcgcggtggctcacgcctgtaatcctaacactttgggaggccgaggcgggcggatcacaaggtcaggagttcaagagcatcctgcctaacacagtgaaaccccatctctactaaaaattaaaaaaaaaaaattagccgggcgtggtggcgggcgcctgtagtcccagctactctgaggctgaggcaggagaatggtgtgaacccggcaggcagaacttgcagtgagccgagatcgcgccactgcactccagcccaggcaacaagaacgaaactctgtctcaaaaaaaaaaaagaatgagttgacaatccgtgctaaccactccttattttggctatctgtagggtacttagcaaaaacagaaattcacatctgtacaagctgaaaacttgataagactaaaaaggagatgctcagaactaaaatgagatattaacaacgtacgtattcatgttaacacactactcaaaagctaacaaaataacagaagttgccccaataaaatccttaggcttaaaaaacaaaaataacagtgagaactaattatgcataattttttaaaagctatctcaaacccctaatttacgaaaagatggaataagcacataccatgctattccctcattaatcaccaaaaagaaaaaaaaactgaataaaatttataatgcaactaacagaagattctgaaaaagtgaagaaaagaagacaaactggctagtaacctgagacccaggaatgacctaatgatgaattccctaggtttctggtttgattccttacgtaaccaggccttaggctttcaaagtgcctataacacagacatgccaacgttcacagacaaaacacgccctaagaaaatcttactctttccagccaaagtgttgggaaaagaatgactgaccaggacagaaacttttcactatatctgccctactctttgcaaacaccaagaaaaaagtcatggccatcccttcctcctcatcaggaggcacagtgaaaattttgaatgtccctcgtctatttgaggaagtccccttctatttctagatgctgaggattttttttaatcatggatattttattttatcaaatgatttctctgcatctatttagatccttggtcagcaaaccatgttccatgaccaaatctggctcgtatcctgtttttgtacagtctgtgagctaagaataggttttacgtacttaaatggttaaggaaaaaaaaaacagaagacaaatatgtaacagagactgcatgtggcccatagaggctaagatacttgtctgaactcctacataaaaagtttgccaggcttgatgtggtggctcatgtctgtaatatcccagcactttgggaggctgaggtgggaggatcgcttgagtcaggaggtcatgggtgcagtgagctgtgatcccaccactgcactccagcctgagtaacagagagagatactgtatcaaaaaaaaagaagagaaaagaaattgccaaggatggagaggacatgaacaacattatcaaccaaatggaatgaactgacatttataaaatactcaagggtgccttcttggtgatttggccctttaaagtctctctttgttcctggtcatttttttttcccactttatagagactccagctatcttctgattactgtttgcataatatatcttctttccatcctttaacttacccatgtcattatatttgaagaacacttcttataaccaacatatatagttgggctgtattttctaatctcttccgctagtctctgttatttgtgttagaccattgtatttaattagtggcctagtgggatttaaatctgccatttaatatttgttttctgtatgttcccactttctttgctcatccagaagaagcaactcttcaagtttgatcataagattttggcaattctgttcaagtttggcaattctgttcaggtttaatcataagatcttggcaatttagtcacatcttcaggctctacttctaattctaattctcctgctatttccaccacatctgcagtgacttcctccactgaagttttgagcccctcaaagtcacccatgagggttggaatcaacttcttccaaattcctgtttatgttgatattttgtcctcctcccatggatcatgaatattcttaatggcatctagaaaggtgaatcctttccagaaggtttctttttttttttgagatggagtctccctctgtcgcccaggctggagtgcagtggcgtaatctcggctcactgcaagctccgcctcctgggttcacgccagtctcctgcctcagcctcccgagtagctggaactacaggcacccgccaccacgcccggctaattttttgtacttttagtagacacagggtttcaccgtgttagccaggatggtctcgatctcctgacctcatgatccacctgcctcggcctcccaaagtgctaggattacaggtgtgagctgccacgcccagcccagaaggttttcagtggactttgccagatctctcagaggaatcactatctatggcagctccagttaagtaatgtatttcatagtaagactttaaagtcaaaattactccttcacaggctgcagaacagatgtgtcagcaggcatgaaaacaacattcatctcctgtacatctccctcagagctcttagatgaccaggtgcactgtcaatgagcggtaatattttgaaaggaatcttttttctgagcaatacgtctcaacagtgggcttaacacattcagtaaaccatgctataaacaggtgtgctggcatccagtctttgttactccatttatagagcccaggcagagcagacttggcataattcttaagggccctaagatttttggaatggtaaatgagcacgggcttcaactttaagtcaccagctgcattagcccctaacaagagagtcagactgtcctttgaagccaggcactgacttctcctctcaggttatgaaagtcctagatggcatcttcttccaacagaaagctgtttcatccacactgaaaatctgtttagtgtagccacctgcatcaattatcttagcagcttctacatcagcacatgctgcttcaccttgcacttctgtgttatggggagggcttttttccttaaacctcaagaatcaacctctgttagcttacaacttttcgtctgcagcttcttcacctttcttggccgtcacagaattgaagagagttaaggccttgctgtggattcgacttcagcataagggaatgttatggctggtttgatcttctgtccagacactaaaactttcttcatatcagcgataaggctgtttcgctttatcagttgccatgttcactgaaatagcacttttaatttccttcgagagcttttcctctgcatgcacaagttggctcttgtgcacaggtggtctggctctcaacctatctcagctttcaacacgccttcctcactaagcttaatcatttctagtttttgatgtaaagtgagaaacctgtgattcttcccttcatttgaaaacttagaggccattagagggttactaattggtctaatttcaatattgttttgtctcaggatatagtgaggcaggaggagacagagagacaggaaaggggtcaaatgatcagacagaccacacaaaacatttatcaattaagttcctcatcttatatgggtacagttcgtggtgccccaaaagaattccaatagtaacatcaaagaccactgatcacaggtcaccataacagataaactaataacaaaaaggtttgaaatattgcaagaattatcaatatttgaaacagtgacacaaaatgagcacatgctgctggaaaaatggcaccaacagacttgctcaacacgaagttgccacaaaccttcaatctgtaaaaaaaaatgcagtatctgtgaagtacaataaagcaaagcacaaaatgaggtacgatggaatactattaaatatatacatcacactgaatgagtaaacaacacacgcatcaacacagacaaatctaaaacaaatataatgttgagcaaaataagtatatcagaggcgagtacatggtatctttttttatataaaaattcaaaaacaaggaaaactaaataatgcattctttagtgatacatacataactgtaaaaactagtaatacaaacaactgatttatcacaaaatcaggattctatctcgagggcaggggaagataggatgcaatcacaaaagaatgtaataaaaataaggatactggcaatattctatttcttaaccagagtactgggtagatgaatattcacttcattattattattcaaattgtatgtatttaaatttcataatttaaatttgtaaaatgtatattctctacgtacatttcacaaatgttaaaaaatacagctagcggctgggcgcggtggctcacgcctgtaatcccagcacgttaggaggccgaggtgggtggatcacgaggtcaggagatcgagaccaccctggctaacacggtgaaaccccgtctctactaaaaatacaaaaaattagccaggcgtggtggcaggcgcctatagtcccagctactcgggaggctgaggcaggagaatagtgtgaacccgggaggcggagcttgcagtaagccgagatcgtgccattgcactccaccctgggcaacagagcgagactccgtctcaaaaaaatacagctaacatataccacatttaatatagtgaaactttaccaaaactttagtacttaccaaaggtacccatgcttcaatttcaaaactttaactttaaaaaaaaaaaaaaatctacctatactcattgaaggtttcccatctgtgacaggtttagagtaccaatgcatttaacagcagtgagccatagccctccaaattaggacccacctaaataggaagcttcactgagaattattaacaaaattcttctgccaaattgtgcagacaggaacataacaaatttaaaatatcaatctaaagtaacattacaaatattcatgcaggcagcctgaagtcctactaaaggcatgaagtgctacttattgcttacccgaaccactcctgtgtatagcaccaggtttccactgccttccaagaccagcatggtgtctattttctaaaaaaacaaaaaagacaaaaaatttatttcccaatctgagcaaattaacagattttttgactgaaaaatctgttgaagcgtaattgtcaacttctcaaatgtgcctacattacctccactggtgctgcatcctttgctggtatgttggtcactgaaccaaagatgagctgggttttatcattactctcttgaaactttacacagctaaataataaaataaaaaagaaacttgatacatgcaacaacctgtatgggtattaaaagtattatactgaacagaaaaagacaatctcagaagtttacatactgtatgagcccatttatataacattcacaaatgccaaattatcaagatggagaattagtggttaccaggatcagtgggtaatggtgtatgtgactataaggagttaacgtaagacagataaagatgttttgtatcttgattgtggtggtatttacacacatctacatatgtgaaaaaactgcatagaaccatacatacacataaatgagtacatgtcaaattgatgaaatttgaaataaagtgtgtacatcatctatctcctggttatgataatgtattatagttatataagaggttacctgtgagggaaaaagaatgcaaggtacacaggacttgtttactcttttgtaacttcctttaatctatcgtatttcaaaatatgaaggtaaataaatgggcaaaagatctgaatagctattttacctaagaagataaatgaatggctaataacttcatgagatgatcaacatcagaatgcattagagaaaagcaaattaaagccacttcacaaccactagaaaatagctacaatcaaagagtgtgatgatatccaatcctgtcaaggataaagagacattaaccttcatattttgctggtgggaatataaaatgatacaggctatttggaaaacagtttggtgatttcttaaaaagttaaacatgaatttaccattcaacccaatgacccaatcctaggcatttactcaagaaaaataaaatcacatatgtccacatttttgctcaagacctttgttcaaatgttcatatggtcataattctcagtagtcaagaggtggaaataaaccaaaagtccgtcagctgatgaacagataagcaaaacatggtggtagatctatacaatggactattacatagcaataggtatgaaataatgatacatgttacaaaatggtggatcctaaaaacatcacgctaagtgaaagctaaacacaaaaaggtacactgtgtgtacatacattatatatatataaatgtccagaaaaattaatctataaaggcagaagcctagcatggttgcctgaggctggaaatgggaacaagactgactacaaacaagcacaaggaaatctttttatggtgatataaatcttgtaaaactgggtcatggtgatggttgtataacactgtaatttactaaaaatcatttaattatacagtaaaaacatgttaattttatgacatgtaaattatttctaaataaaactacttaagccaaaaaaaaaaggaaagaaaagaaaaagaaaaagcagtgctaagttatttatacagaaacaatgggaaagacatacacctaccgtaactggagctgggactctactaaaaagcacaggaacttttgcccacataggtcagatgtaataaacacttttgaggcttgtgaatttttctctctataatagatacattaataaagtaactgtcagcactggtccaagaatctaccacagtaactattaaaagtctttgaggccgggcgcggtggctcacacctgtaatcccaacactttgggaggccgaggcgggcagatcacgaggtcaggagatccagactatcctggctaacacggtgaaatcccgtctctactaaaaatacaaaataaattagccaggcatgatggcaggcgcctgtggtcgcagctactctggaggctgaggcgggagaatggcatgaacccaggaggcggggcttgcagtaagccaagatcacgccactgcactccagcctgggcgacagagccagactccgtctcaaaaagaaaaaaaaaaaaaaaaaaagtctttgaaaatattctgcaagaaatctaaaaactacttaggtcaagcaataatctcaaagacacaaacatttctaagaattaaacttcatgatctctaagatcctttcagttctttgattatgagctcgttacacagctttgttggggaaagctacaataaatttaacaattactgatgaacttttaaattacatactatgtaagctccctacttgtaaagtaatgcaaactaagccacctacttgtaaagtaatgcatgcaaacttgaattcctatcccgcaaagggccagatctttcataatgctatttctcctatctaccccctctccttctcagattaggcctcattcacatctctttttgaaatcgtatctctaattcccaaacccttccttctaaagtgctacagaaggccgggtgtggtggctcacgcctgtaatcccagcactttgggaggccgaggtgggcagatcacctgaggtcaggagttcaagaccagcctgaccaacatggagaaaccccgtctctactaaaaatacaaaattagccagtaatcctgtaatcccagctactcgggaggctgaggcaggataatcgattgaacctgggaggcagaggttgcggtgagccaagatcacgccattgcactccagcccgggcaacaagagcgaaactctatctcaataaataaataaataaataaataaatagtgctacagaagacccataaatctaaaaaataagaatctataatatattcaacttacaaataagttatttaaagaaaaatgatttataattgtaggatacttttgatatatgagaaacaaaccagacagactacttcaacattgtatccacatctttactttcttcagactacctattccccatttcattctctctaagattatgcatttgccttccatttcagataaaacgaggctctaaggcttgagctcaacctcctgccttacatatctgatcaaccttcacttctttatcccaatctcaccacttatgcacctttctggttacttgttccatcaatcatttcctctgttctgtattttcaatactttcccttgagtatagtccgtatagcctactacttcacattaaaagtcttaaaatacaaaatggactcaacattagagtatataaaagaccttctcaattcgactggatataaaacttgtattgtggttaggttagaaaatactgggggccaggcacagtggctcacacctgtaatcccattactttgggaggcagaggcaagcaggttgcttgagcccaggagtttgagaccagcctgggcatcacggcaaaatcctttctctgcaaaaattacaaaaaattagtcaggcgtggcggtgtgtgcttatagtcccagctatctgggaggctgaggttggggaatcacctgagcccagaaggccaaggctgcagtgagctgtgattgagtcactcactgtactccaacctgggtgacagagtgagaccctgtttcaaaaaaaaagaaaaagaaaatactggggcaagatgtcatgaaaactaattttattatagttcagcaaaaacaaaactctccttgaccaagactccctctaattttgtatcttcattcctattcaaaggcaaactccttaaagagtctgtatgcctatgttcatttcctcagtccccatttactttttctaccccactttcccccgccaccctcccagcttaaaatgctctggccaaggtcaccaaggaacccactgccacccaggtacctcctctctgggttcaactctcagggccacacttcaccagtacctggcaatactggcatctctgtattcttgaaatgttcttttttgtattctgtatttcctgctgcttctcccatctgacctcttttgctttgtctctctgtgccagctttgtctctttccattccccaaatcttaagtttccaggacttcagttcctagccctcttctcattctacaccactggattttaactatttggaggccacaaatccctttgagaatctaaggaatgttaaaaccctctccttgggaaaaggcctatatactacatgtacacacaattattgaatacaataattcttcaattctaatctaattctcttacctcaatcaccacctataagctgacaattccacatttattgttctgctctttcccaaacttccgacacacttataaagtgccttcttaccgctgtcatcaaacataccagaggcctaaagggcaatcagtaatctctcaagcctcctttttttctttttcagacagtctcactctgttgcccaagctggagtgcagtagtgtgctcttggctcactgcaacctccaactcccaggttcaaatgactctctcacctcagcctccagagtagctgggactacagatgcacgccatcatgcctggctaatttttgtatttgtagtagacatggggtttcaccattttgggcaggttggtcttgaactcctgagctcaagtgatccatctgcctcagcctcccaaagtgagtgattacaggtgtgagccactgcgcctaggaagcctcctcttcattagccttttccctcccctctgcaaaaaccagagtggaagtacttgtaattccctaaatacaccacgcactcaccagaacttttgttctgatcccagctgccgtctgtggtctttctcaacttccctgcctagcgaatacctattcgtctttcaaagccctaccagcaaaagtagtccctcctgtgtcaccatccttcagctatctgcctcttttgaggacagggacagtgacttattagactgttaactagcacacacattggcatataaattaacacgtgaattattaaagagaatataaaagaagaaaggtcacccagaacagagatctaagctatgtttcccaaaaagtaaagctggcactcaactaacatgaacataaaacttaggaaacgtgctaaaaccccacatttcctcacggatggaaattaactgtttctccccagaacaaaaaacacccgaaaaatgagagattattactataaaggaagaaatatcagatgacaaaataatatttttatgatgactttttttttttgagatagtctcactctgtcacccaggctggagtgcagtggcacgatctcagctcactgcaagctcagcctcctgggttcaagcaattctgcctcagccacctgagtagctgggattacaagtatgcaccaccacacccagttaatttttgtatttttagtagagacagggtttcacaatgttggccaggctggtctcgaactcctaggctcaagtgatctaccagcttcagcctcccaaagtgctgggattacaggcatgaaccaccacgtccagcctatgatcactttaatatcattaatatcctctactgaaactgaggtggccttaatacatatctctatatatttttacatatattaataactgatcacattaaaaggaaactttaaacaaaatgccatatatttcccaagactttcagcaacatttttctttgaatataataatatatataacaaaccttatattagtaatcgtttctgtccacaaatggtcaatacacagttcaggaacaattggctccgtttctggtgcaagaaaggagccattagaattactatttggagaatgagaaatactatgtctctttggagactgattatggcttgaaatgttgaacctttgcacccctgaaaaagagtgcactcctaacgcaggagaatgagcacgactgcaaaataaacagaggagagagtacatcacagttagcaaggcaggcttatatgacacacactccaatgacacttccaaaaattccacagacagaagagcattcatggcataatccaggtcagaaattaaaatttttcaaaaaggagtagctatttaaatggttcatgtcaatgtgctttactatattctaaagatttagaattattattagaagaactcatcttttacaactaaaacttagatcatcttctttttcggaaaatgaatgattattcaaaaagctctaaactatgtccctgtatagtcagacatatatatttatcaacaaaacaatgtccctgtagcaccagatatacatatctggtcatttaaatatatatctatatagagaaatagatacatttacatatcaaataacaagtaaaaaaaaaagaaaaactaacataaattaaggcaaaaataaaatagtgccacagtattttgggaattaatattcatcaaactgttgcccacatagtggtagaaatgaggcaactaaccttaggtcaagcataggcagcttcaaaatatgactcaggaaagaatgtgacatggtaaacttagaaatcttagtaaaagtggctcagggctgagcacggtggctcacgcctgtaatccccgcactttgggaggccaaggcaggcagatcacaaggtcaggagatcgagaccatcctggctaacacggtgaaaccccatctctactaaaaatacaaaaaaaaaaaaaactcagccaggcatggtggcaggcgcctgtagtcccagctggaggctgaggcaggagaatggcatgaacccgggaggcagagtttgcagtgagtcaagattgcgccactgcacaccagcctgggtgacacagcaagactccgtctcaaaaaaaaaaaaaaaaaaaaaggctcaattgggataatggctatttcccctaaaaaacatctcccctaaatatatttcccctaaaaacagctgtcaacagaaattctaaatccttcaaaacaaaacagaaagcttagaaagaaaaaccaggaaacccttataccttagagctgccatgttggaaatagaaggtgagcgagaatgtagactgggtgatgaggttgagcgactctggctgtgaatggaggagtaattctggaaaggtgaagtcacaggggaatctcctttggagaggcttctgagatgtgctgtgagggagctgctagtggccacattctgtggggttcccccctgttcagagaactttaaaacaacattctcttccttaagtc

SEQ ID NO: 354 - DNA, 30534 bp, Homo sapiens
tggaaggattgattagttgaatcttttaatttaaaaacttacatatgagaaagataaccaaatctagagtctctctattgtatttttggactttaaagtgcccagtgtgacaaatggaacccaatctctttttgctaaattttgtggaagtaaaactacagtaaaagcaccgtgatctagttcctcctctgctattagctgtgtgatcttccaaaagtcatgtctataaacctcagtattttcttctagaaaatggggcaataccagctcacttactctgaagttttaaagattaaataagataaaatatgtaaaaaaaaaaaaacctgataaaatgtaaaacatcatacacattacttttttcagagagccatgattatggtttggaaattacttaattacaaaagaattttcatgacagtaatgacatcctaagagatatttaccattgattaaaactgccatgtctcaggattgaatttcaagatctcaaaaaagacaacagaaattagaaaatgtactatgtcttaactcagaggttgacatttcaattcaaattcaacttctttatcaccaaaggtcataaaggtcaaacaacacacaagtatgaccctagaattctgagccatacaccaggtgcttcaaagctcttgaaaggtgttgaaacgtattattagaactatcttattgtggatctactatgagtgcctcaaagacagggacaacctcagactgcaacaaggacagcatagcaaaatgagtccacaactatcaaacactcgcatcccaggaaagacatttaggcaagtttcctcatcactaaaacaggaaacttaccttgtttgagactttacatgtaaactatgattttgtcaactataaagcactatttgaatgtggatattacaaaacagcagatgttattctagaactcccaccgcagtatagccagtcagtcatcctgtcaaaatgaaaatctgagcaggtcatctccattttttcgtgaccttccactaatctcaggacaaagactaaaaatccctgcatggctcacaggcccttacaaaaccagtatcttcaaacaactctgtggtttacagagatgccctagttttctgagaaggtagatttcagaaacttatttacaaggtccctatatgatacaaggttcctatatggaaaagacagtcatctcaggacttcctggcagtttctaacctacaaacaaatttaccttgccaactgaacgagaagttcaacaagtgaacaaattccttctcccattagagtattcaacttaagctcctcatacacaaggtgaagaacgaaaaaaattgcaggtatgtgagtaaagagaagtgtagaagaatccagactgagattctgtgaaaaatcctcatccttcatctgtgaagcttctgaaggactcagacataaagatctgttcaaaagatgagactcaacattctggtggtagtctgaatttagtaaatattcccagtcctgagaagaataaaaagaatattaatttttaaaaataatacctccttataatatcataagaaaattaattcacttaaaacaattcaagtttcattttcacattaagttgatctaagagtatgttaaaaaaaaaaaagacaatgctaagaatgaagtaactataaaatagcaagccagttataaacgttaaggcaagccacctttaaaaaccattaaaaaaaatattttcatgaccttttaggaaagacattgggagaagaattatactatttaggtagagattgagagagaaaatttaagattatctcaggctaggttttataggaaaagtagatggcaagttagtggccactacactgaactgtgttttggtaagaaggaaggtccacctgcattcagctggtgtattcatctttccacatgtataagatgccggggctagtaatataatctaataatcaactgatttttatattcagactgattggactacattttccaaatattcaagtctattttggttctacttgtgatttactgcatttggttcagagaatgtggtttatgctatttccagatcttggaatttactgatgtttttgtaaggcttaatacagtgtgttactctaaattaaaaattcttggactagatacagaaagaactaaccataaaagaaaaaactgggccgggtgcagtggctcatgcctgtaatcccagcactttgggaggccgaggcgggtggatcacaaggtcaggagatcacgaccttcctggctaacacggtggaaccccatcacttctaaaaaaatacaaaaaaattagccgggtgtggtggcgggcgcctgttagtcccagctattggggaggctgaggcaggagaatggcatgaacctgggaggcagagcttgcagtgagctgagatcatgccactgcactccagcctgggcaacagagcgagactccatctcaaaaataaaataaaataaaataaaaaactgataaattggataactaaaataaaaaattctgctcatcaaagacactgttaaagccacattctaagggaaaatatggtcaagaactcatgtctagaacatgtaagaacttcaacagcttacatattttttaaaatctaatttacaagtagataaagatttgaatagaaacttcacaaaaagatacataagcagctaatgagcacatgaaagagtgtttaacatcctccaacctcagcctccaagtagctaggactacaggttatgcgccatcatgcctggctaattttcaaatttttttggtagacaactggtcttactataatatgttgtccaggctggtctcaaactcttgggctgaagcagtcctcctgcccctacccctcaaagtgctgtgattacaggcgtgaattttcatttaaaagaaattaaattaaaagaaattaaaattacagatgtgaattttaatttaaaagaaattaaattaaattaaaagaaattaaaattcacacctgtaatcgcagcactttgagagataggggcaggaggactgcttgagcccaggagtttgagaccagcctgggcaacatattatagtaacaccttgtctctaccaaaaaaatttaaaaattagccaggcgtgatggagcataccggtagtcctagctacttggaggctgaggtaggaggatggcttgagcctaggagttcaagattacagtcaactacgatagcatcactgcagtccagcgtaggcaacagagtgacaccctgtctcttaaaaaaaaaaagaaaagaaatgaaaatgtatgtccacgggcccggcatggtggctcacacctgtaatctcagcactttgggaggccaacatgggcagattattgaggccaggagtttgagaccagactgaccaacatggcaaaatccagtctctactaaaaatacaaaaattagccaggcatggtggcacacacctgtaattctagctactggggaggctgaggcatgagaactgcctgaactcgggagtcagaggttgcagtgagccaagatcgtgccactgcactccagcctggatgacagagcaagactccgtctcaaaaaaaaaaaaagaaaatatatatccacaaagacttgccagtgaattttggcactagcttgctttattcataagactttaaaaaaaaaaaatggaaatagcctagatatctaccagcagaagaaggatagataaacaaaccatggtatattcacactactcagcaataaaaaagcacaaactactggtatctgtaacaatatgaattaatctcaaaagcattatgctgaataaatcttataccaaagattacatactatattattttatttacatcaagttctagaacaggtataactaagatatggtgacagaattcagatcagtgattgctagaagaagagaataaagctgattaaaaacagcaagaggggccgggcccagtggctcatgcctgtaatcccagaactttgggaggccgaggtgggcagatcacgaggtcacgagttcaagaccagcctgaccaacatggtgaaaccccatctctactaaaaatacaaaaattggccaggcgtggtggcgcatgcctataatcccagctattcaggaggttgaggcaggagaatagcttcaacccaggaggtggagagccgacatcgtgccactgcactccagcctgggcgataaggcgagactccgtctcaaaaaaaaaaaaaccacacaaggaaattttatggagttataaaaatattgtgtgtctttataggagtgtaggttacatgagtgtgcatatattaaaactgatcaaactaaacccaagctgtatttcatttttgtaaattacaccacaatttaaaaaaacatatttggaccactgaagaataataccatggaggccaggtgtggtggctcatgcctgtaatcccagcactttgggacaccaaggttaggaaggtcacttgacgtcaggagttcgagaccagcctggccaacatggtgaaaccctgtctccaccaaaactacaaaaattagctgggcatggtggcgggcgcctgtaatcccagctattcaggaggctgaggcaggagaactgcttgaacctgggaggcggagattgcagtgagctcagatcctgccactgcactccatcccgggcaacaagagtgatactccgtctcaaaaaaaaaaaggaatataccatggaacctgatacaattgagaaccttaatttaaaaaacactgcataaaaaaggtaaatgctgtcatttcaggtgatcagttgatactaaaatgtctacaaacccaaactgaaatcatgcagtaatacatgtattaatttttagataatcattaaagaccacagaaaatgtaacagatcctactcttcaaaataattgctattcagtattaaaataaataaagtgaaaggtgttggaaagatagaggaattgataggaataccacagaagtggaagaatagtatgaatatccataaattaatttatattagcaagaaataataatgcttacatcatcagatccagtctcggaaggccttgcttttttgggcgcaatgacaggagaaagtgatccttcaaagtcaaactgaaaagtaaccccaaaagaaaagataaaaatcgtaaatgcattcctgtcaactgatcaacttcaaggattcagaaatcagttctgccaattacgaaaactgagaaaagccatcaaaactcattttttgatctggaaaggcattatttaaatatctttcttccaggttactgtaaagatgaaatgaaatcatattaatatatgcaaacatctagaacagtgcctgggcttctaaggactgattttaatggtagtttccttccctctcctactcctgtaacaacatagattacatcacatctttggtagaaaaagaaactttaggcatatccacaatataccaagtctcaaaggatcaacccaatatcagtcaaatgttagaactaagcaaacatttatttacagtccacctacagtaaactatctaacaattctatggcagagacaagtagctactctggaaaatcttttttctcctctttctcctgaacccacagccagactacatacatacgtctgcctcctttgaagttaggtgtgaccctttgacagagttaattataaatggaagtcactgtcatcacttccaggaccagtccagtcctacccctgctcctccaggctctttgccccttccacctgactggaatgcagtcaaccaatggcaatctttgaaccaaagataaaagatcctccatcaacctgggttcctgaataactgtgtggcctgtttatctgctaagccctgttatgtaagcaagacagacatttttattgtgtttgagccattgtatcttttgaggcctttctattacaatagtgagcctatcttctaactaatacaactacataaaagcagttttctacaagttgctcttcttcaatttcccctggcataatctttgctgccccagctacttcacatgggcattgaccatcaactaataaactgtaactctataaatggcaatggctattttcctatgctgaaaaacttacatatttatcaactcactcacctaaacagagttgatttctatataaaaactaaacataggtagcaataaagtgatatttaaaactgaatgttattgagagagaagatctgcttgtgaagcgttcaaataaaaaacagcccaactcatatatattataaaaaacctggtagtaacagtgaaatcaaagcaacaaatataacagtaactatctaacctaaaacttcaaccaaaatgtaacacacacaaactcccacagtcaaaaagaatgtccctgctataattatcagattcataaggcctggagttatgagaaagtagaaactgcctgataaggatggctctttgtgccatacatggatctgtttaatcttcactctttcaatgtgtctcaggttagccaaccctgttatatgctcctatggacccttacccttcatctatcataacacatttatcaaatattatttatttgtttcccccaagacagtcaattccagaggaacaatctgttttgtctggggtatatgtgagaaacctggcatcatgcctggcccacagcagggattcaatatttatctaaggaaaaaaacagcagcccggaagccacaaaaagttaaccccaaatgcaactgttcctacaatgtacagtccagtgcactcatgtaacacatcagcaaattaaagaaagcacaaagaaatgccaaaaattgtgtaacgagtcattggcagaaattctgtactccaccacattacatatgtgaaaacaaaaagaataaatctgaacaaagcaaaatgaaaaccatttgccaatgaggaccattttatcctaagctttgactatgaggacaaaagataacaagggtttaaccatgcagtcctataaataaatagcaaagcaacttggcctcaagaattgatttccttattccttcctttataattatcatgcaataagtaagtcaaaaagccatgtccttctctgcaaaggaaaaaatgggtaggtgctcagtcctccccaaaacatggaaacgcgaaggggcataggttctctgccagagactaggacacaacaatctgtactcatcaacaagttacaaggacaatgatacacaaaactacagaaagctgacgcgttttttcataatgtagaaatccagtttctatgaggcttaatcttttcacatgtaataaagaacagaaaaattggggataatgtcactcggatacaattgtttaaaataagaaaagaaggccaggagccgtggttcacacctgtaatcctagcactttgggaggccaaggtgggaggatcacttgagctcaggagtttaaaaccatcatagccgacacggcaaaaccccgtctctactaaaaataaagaaattagccaggcgtggaggtacatgcctgtaatcccagctactcaggaggctgaggcacaagaatcgcttcaacttaggaggcagaggttgtagtgagccaggatagcgccactgcattccagcctagacgacagagcgaaaccccgtcttaaaaaaggaaagaaaagaaaattgtccctattttcccataagatttctctcaaggaaattgcagagagcaattccttcatgtgctgaaatagacacaaactcttaaaaacagtatctcactcagatggaaaatggcattcactcaacaaatgttcactgagtatccttctatgccaggcaataccacaggtcctggagagagagagtagtaaacaaaactaagcaaaaatctttgccttcctagaatttacattccagttgggggaggaaggacacaaaacaaaataagtaaaacatatagtatattatatttaattaagtgagaagaaaaaaaaacaggtaaatggcactaaaggtatggaggcaggtgtaattctatagagacaggacaggcagcactgaggtgacatctgaataaagacctaagcacgtcttgtcggagggaaagcattctccatagaggtaatggcaagtgcaaacactcagaggcagaaacatgctggcagtgctcagggaacagagctgaggccaatgtggctgggatgatgtgtgcaaagcattaagaaataagagcaggaaggtgagcaagggctaggtcacatggcatcttataagcctatggcctttactctgagtgacatgggaagtcactgggggattctacgcagaggcgtgacgaacgcaacctgacgttatcaaacaggattactgtggccactggactgagaagagactggaacatagacaaaggacatgaaatacgaatcaaaaaataagaactataaataactgatgaaattttgaaaaaaacattcccatttacttatagagaaataagataaaatttctcaggaagctggcaaaggttcaccacaccacaaataaacactgtggtgaaatgggcgcttttaaatgatgctagtaagaatgtcacctgggaacccctttccaaacattacttgacctcacagtttctcttttaagattcaatgcttgggaagtaactagagatgtggttaaagagtcgtgaaaaaggatgtttataaattacaataacgaaaacaacagattcacaaggtacaattattagctattggttaactatgataaaactacactatgaagaaatgatggagatattttagaaaaaatttttaatgatacgggaaattttcattggtatttttatatagaaggtaacatcaaaaatatttagagtggttatctctaagtagtataattattttcttaattcctccattttccacattttcctttcataattaagacaaaaaacaaattttaaaaatggatttgctggccaggcgcagtggctcacgcctgtaattccagcactttgggaggctgagacgggcagatcatgaggtcaggagatcaagaccatcctggctaacacggtgaaaccccgtctctactaaaaatacaaaaaatcagccaggcgtggtggcgggcgcctgtagtcctggctactcgggaggctgaggcaggaaaatggcgtgaacccaggaggcagagcctgtagtgagctgagattgcgccattgcactccagcctgggcgacagagcgacattctgtctcaaaaaaaaaaaaaaaaaaatggatttgctgtgcaaggctaaaacatatagaatggtacagctgagctacctggaaaaggggtaattataatctagagtgattttttttcagagtgacccaggcaaagttgtcctgggagtgatctccaaagctagaaggagatcaccaatactgaagacaccactctgctgattttgtaaataatctaataagggcctgtaaggatgttactgcaggaagagggtgagaggtaaggctttataccattaacagagtagatactcaggctaaagtactttaaatctccctcaaatcaaaccttcctcttcacatcccaagcaatatgtgtgtaaaaagacaatcttgtcttcagaaaacaatgttaaacaaggagtcagaagatgcagtctagtcatagttgttaaaaaaccacagatctgtgatttctttgtgatccagtttcttcatcaataaaaccaagactatcactaatcctagcataacttgcagtcattttacaaaggtgaaatgagaaatagtcatatatgctttaacattctaaagctcagtaattataatcactagtaaaatgttaatattaaatattaagtgagattttatttacaatatatagatacaataaaccttaatattattctattattttgaatatggtacgcctattatgtagtctcaatgttatattaccaattatgcaaccattacattaacagaataactcataaagaaaacaatagtatttacttacatttctagtccatgctaagcggtctgtgttataacccatcatgttcatgagacaagtcacaaataaattccactctgagtgataactgggtcctcctggagcactgtggacattgtaccacttgacaagcatctgaactgctatttcttttggcaggataaacttaattgcttgcaaacacgtttgtactattaaaagcaaagattaattttagtattcttactctgcatgcatttcttttcccctttcaatcaccaagttttttaacttctactatgtaaaggccaattattatgaaaagaaaactgtcattaaagagccaatgagatgcaaacattacctaaccaatcatctgaaactaaaaccaactactgaattcaacaaggcttgaaaggggtctgaagacagcttttttttttttttttttttttgagagggtgtctcgctctgttgcccaggctggagtgctgtggcacggtcttggcacactgcaacttctgcctcctgagttcaagcgattctcctacctcagccaccaagtagctgggattacaggcgtctgccactgccccaggctaatttttgtatttttagtagagaccatgtttcaccatgttggccaggctagtctcaaactcctgacctcatgatccacccgccttggcctcccaaagcactgggattacaggtgtgagccactgtgcccggccaaggacagctttttgatcattaattttgcatcagaaataaagtaatcaaatagcccagtttgccagagacagtcctgatttacatccattgcccagcaattactaactgctcgccttcactcttaaagatgttctagctcgggtgacaaattaaaagtcactatgggccaggcatggtgactcacgcctgtaatctaagcactttgcgaggtcaaggcgggtggatcacctgaggtcaggagttcgaaaccagcctgaccaacatggtgaaaccccatttctactaaaaatacaaaaattagttgggcattgtggcaggcacctgtaatcccagctactcaggaggctgaggcaggagaatcgcctgaacccgggaggcagaggttgcagtgagccaagatcacgccattgcatttcagcctggatgactagagcgaaactctgtctcaaaaaaaaaaaaaaaagtcactatgaaaaacatacaacttctatgtttatacatttatataaaatactgcctacatacttcagtaaatatataatattcaatatatgcatccacgaatagcaatgcttagctagcattacatgatgttctaaatgagttaacatgcctattaaccaaagctttataactttatttctgaggtcgttcagtttctaaaatgtttcacaggctctctgtcttaaaagggttaagagttaataccacataatttacaccattctttttttggtaaggggaaacagggtcttcctctgtccccaggctggagtgcagtggtgcaattatagctcactgtcacctccaactcctggactcaagtggtccaccagctcaagcttcccaagtagcaaggactacagatgcatgccagcatgcctggctaattttatttttctttttgtagagacagagtctcactatgttgtccaagctggtctcaaattcctggcctcaagcaaccccctcacctcagccttccaaagggaggggattacaagcatgagcccaccacacctggccttataccattctcaatggctccacatcaattatagcactacactgtcatacaatgatcccctcagagtggccagggctaccactgtgaagagacccaaatctgcttttagtagtaaataatcccaaactgcaatgtttgtgtactcacatatcctctcttccaggattcttttttccctttccactgtcatgccactgggcccaccctcatcaacatatcctctatcccatcagtttgcaatgtgcaaactcacacagcacaggttggaagcaaataatattaaaataccaaataaccaagtatgtcatagtggaatccaaaataagtgtaaacccaatgctgcatgagtgtgtgagaaccctctgcaggtaaagtacataaacttatgtgcataaactatggggcttctgtttggctataaaggggtaagattttttgttttcatttatttaatttattccattattatttgtttttatatattttgcttaggcttataatagttcgaggtacctggccttgtgattacgaaataccttttagagccgggcgcggtggctcacgcctgtaatcccagcactttgggaggccgaggcaggtgaatcacgaggtcaggagatcgagactatcctggctaacacagtgaaaccccgtctctactaaaaatacaaaaaaattagccgggcgtggtggcgggcacctgtagtcccagctactcgggaggctgaggcaggagaatggcatgaacccgggaggcggagcttgcagtgagccgagtttgcgccactgcactccagaacctgggcgacagagcgagactccgtctcaaaaaaaaaaaaaaaaaaaataccttttagaaggcaaggaatctctatatcaacttggaataccatttaccagcagtgaaaattcctaaaatgaaaaagtcattcttgtctacaatctgccaatgtcctgctttggcagttagatttgaaaccaagatatgtcatgaacttccttatatcatacaggcattcttttcttaacctacgtttgttggcaaatcccttcaattctaacattttgtttactatgctatgttcagaaatattctcctcaagcatttttgaaattgcatctcaggaataattcaagcagaatccaatatttattaagataattctgattgtattttgacaataatattaagttttattcaattaaggcaattaggttactttcacaatttatctgaaaattgagatatttattttaaaattaaaaacatcattaatacattacagaaaaaaaaacattaaatatgccaagaattatcttagttgcttaagcttccagtttcccagatgttcttgcaagaggcatgtccatatatatacatatacatatatatatatatatatatatatattttttttttttttttttttttttttttgagacagagtctcactctatcacctaggctggagtgcagtggcacgatctccactcactgcaacctccgcattctgggttcaagcgattctcctgcttcagactcccaagtagctgagattacagaagtgcgccaccacaccccgctgatttttgtatttttagtagagaaagggtttcaccatgttggccaggctagtctcaaactaccgacctcaagcgatccacccgcctcagtctcacaaagtgttgggattacaggtgtgagccaccatgcccagcaggcatgtccatatattattatactgcacaatattccccaacagaagaacctcagggaacagaactagcacatccttcacctgtactccagccttagagcgcacgtagagtggacatcacaaagcactccctagctctttaaagctcctctacaaagctaagaacttgatccagtggcttcaaaaatggcaaaataatgtttaaaaccccaattattaatgtaaatcacaattacttcatgtcttataaatgaaacttctcaatcgtacctaactcagaggtggcaatttcaggaatagtgatcctaaccatggagccattactcagttcctagatggaaacaaatgagaaagtagataaaatctgtgcattctaagtctttgaatgtcttaaaaatagctggtacaagactttgcccatcaaagcaataaaataaatgaaaaacaattttcaaacagaaatgaacacttccgaatttcagaaactttaaatgtaattatttgcaaaatgttttccaaaatgcttgttttaataaaaagtgtctaatctttatacagtgagtcaccatcatcaaaaggacatttacttttaatgagaagacaaaaaatcacatcaatatacaattcaactgactcaacaagcttttgttttcactaagtttttaataatacagaaactgtagaaaacaagcagaattactgtatagtaaaaagtaaaatcgtgccaaaaaatgacacaatagatttttttaaatcatgagaaatgtttgttgtcatttttcagacaaaattctgtattctgtcaaatttgaaatgccagcccacttcttggaaagctaccaaatgtttatacttaccagggtgactctgttatggacaggatctctgatagaatgaatgtaagttccaagctgttggaaagtacaatcctcattatagagagaatcatgaagttttgaagaatccctcagttctggaactggggacaacagaacaacctgtaaaaagttgtaaatacgatacaaatgaattgttttctgagaaattaaggacaaggaaatttaactgtttcttttttgcatatggtctaacaaacaataatatgtaatgattcaaaaacattctgctccaagccaagcatggtggtgcacacctgtatagtcccagctactcagaagactgagacaggagaatcacttaagcctaggaatttgaggctgtagtgagcctgtgaatagtcactgccctccagcctggatgacacggcaagacccaggctctttaaaacattttgttccagatacaatgaagtaccagcaaaccaaggtcctcacagaaaacaactagaaaaggtaggtaaaaggaaaacatctgattggtggctatggaaaagctgtggaagcaacctggacttgagggaccaagatctaggagagaaggcaactgcagggaaaggggccaacgttcttggagagccttgctttttctgctctggccatctgcaaattttggtggtaagaggaacatatggaaaggctgacaatatgcaaggaaagtcatagctaagagggagagaagccagcagcactgttagcaaccttacagggctaaagactaaactgtgagccggggcacgcggtggctcatgcctataatcccagcaccttgggaggctgaggcgggtggatcacttgaggtcaagagttcaagaccagcctggccaacatggtgaaaccccatctctactaaaaatacaaaaattagccaggtgtggtggcgggtgcctgtagtcccagctatttgggaggctgaggcagaagaatcgcttgaacccaggaggtggaggttgcagtacggtgagattgccccactgtactccagcctagatgacagggcaagactccatctcaaaaaaaaaaaaaagactaaactgtgatttgaggcagctgaggaactaagagcccaggaagaaaggacagtaatgaaaaagccaacaaatgagaccagtatttaatggtatttcccctataggcaattatttattcaaaaatacaggaacagtatttatttgcttaactgcagatatgcaaacaaaaaatttaaacgatcttagttactatctacatgcagatgcttccaatcttaaactctagtcatgaccactgatcctttttgattcctttaattcaatttatatatctctaagtgaatatcttgtcaacactgacaatcaagactaagatgtatttactctattccagattctactctaaaagtcaccaggaaaaattcagctccgctggtcctggctctaagtctactagcaaaatcttccagagaagtggaaaagccatcaatcagccaatgtgttaagactatcatttccatgactttacacctatcaaaaaggcactattaccaggcttatagaattctaaaaaagttggaaaccattttccattataaaagaaattcttccaaatcacacagaacactctgacacttctccagttccccctttgaatgttctgcaaatgtgctggtttgaaggaaaaaaaattcaatgtggcacatgtttaaaaatataatgaagacacagacattatcaaatacaactgatagcactaaccttccctttgaaccgtccctaaacatccacactcacatgtcctttaaatacaaaccacttttctccaggcttcctaacttggtaaatccaggtaccttcccaggtcattcagagaattcggagcctcgttccacatcacctttccccagcccagcagcacaaaaccaatcagctgacaaactcatttccacctctcaaggcctctcatattaatccctcctttccacacatatactgccctagctcagaccctcttcatacttcttaaactgacacagacaacctcacttggaggctaaccggtctccttatctttaatcccaaaatacacctatttacaacacagatccaaaacctcataactcctttctcaaaatcctgtaatgccctgtcaattgcattcagaataaaaccacctttttatcctttctgcctttaagagcacattagtaagagtgtaaatcccagttctaccacttattaggtttatttcatttgtaacttctatctcatttgtaaaaaaaagaatcatagtactatcttctcaataaagctattctaaggaaataattaatactaataaagcactgagaacaatgcctagcacatagaaaatgctcaaaaaaggttattattgttatccaaaccctatcctgcctcaccctacagactacttgtacttttataagtatttattctacagatttattgagtccttatgactaggagatgaagatacaaatatccactaaaaaatgttccacattatctggccttcctgcctgtgcctgtgtggtttctccttgccctgaatgctcctttctacctacagatatcctactcaaccccaaggtccaaacgaagactgacatgtctctcagtgaggctttgattttgccatgtcctcccattggatgttatcttcccatcggatgttatcttcccatcagtcaatcaacgatggtactctcttttccacattactgagtcatgagtctttcttaaattctaatttcttatgcagacagtacatcaactccacacaattgtgagatccctagatggaaaagaatgtatcatttccatctctccagcaccttcaaaaagtatcacatacatcacaagggaggtcagtgtatgttaactgaatcacttctgtttgaaaacatttattctgcaagtagaaactaaaattaagttaaccatggaaagaactaatgtttaaccaaacttctttaaaaaatgttaactttttggcaacacctagtccttttcttacctcgtccaatgatccaaggagtttactaagaggctttggagtactaacgccatctagtggagtactgggccgaggcattgtgttggacatcgtcagagagggagctggcagtccaggaataaaaacctttcccacctttaagcaataaaaacatgtggaaaaaaaaatattgcctttaatgcatcatatccttaaataaaatgttaaggaatataaacatatatttcttttgatatttctaagtttatactcaccaaacacagcaaagaaacaattcaaatgtcaataatctatccaattccactatccaactgcaaatatgttggtataattttttttttttttgagataagatctcactcttttcccgtgggtggagtacagtggcatgatctcagctcactgcagcctcaacctaccaggctcaagtgatcctcccacttcagcctcctgagtagctggaactataggcacatgccactatgcctggttaattttgtattttttggtagagacagggtttcaccatgttatccaggctggtcttgaacttctgggctgaagccatctgcccacctagacctctcacaccttggtataatttctcttggttggattccttctcttcattactgaagacttttttttgcaggcaaggagaggaatgttaatatagtcaacacattatataaaaatctgcacactatgtactcttctacctttttggtcataaagacagtaagaacagcggccgggcgcggtggctcacgcctgtaatcctaacactttgggaggccgaggcgggcggatcacaaggtcaggagttcaagagcatcctgcctaacacagtgaaaccccatctctactaaaaattaaaaaaaaaaaattagccgggcgtggtggcgggcgcctgtagtcccagctactctgaggctgaggcaggagaatggtgtgaacccggcaggcagaacttgcagtgagccgagatcgcgccactgcactccagcccaggcaacaagaacgaaactctgtctcaaaaaaaaaaaagaatgagttgacaatccgtgctaaccactccttattttggctatctgtagggtacttagcaaaaacagaaattcacatctgtacaagctgaaaacttgataagactaaaaaggagatgctcagaactaaaatgagatattaacaacgtacgtattcatgttaacacactactcaaaagctaacaaaataacagaagttgccccaataaaatccttaggcttaaaaaacaaaaataacagtgagaactaattatgcataattttttaaaagctatctcaaacccctaatttacgaaaagatggaataagcacataccatgctattccctcattaatcaccaaaaagaaaaaaaaactgaataaaatttataatgcaactaacagaagattctgaaaaagtgaagaaaagaagacaaactggctagtaacctgagacccaggaatgacctaatgatgaattccctaggtttctggtttgattccttacgtaaccaggccttaggctttcaaagtgcctataacacagacatgccaacgttcacagacaaaacacgccctaagaaaatcttactctttccagccaaagtgttgggaaaagaatgactgaccaggacagaaacttttcactatatctgccctactctttgcaaacaccaagaaaaaagtcatggccatcccttcctcctcatcaggaggcacagtgaaaattttgaatgtccctcgtctatttgaggaagtccccttctatttctagatgctgaggattttttttaatcatggatattttattttatcaaatgatttctctgcatctatttagatccttggtcagcaaaccatgttccatgaccaaatctggctcgtatcctgtttttgtacagtctgtgagctaagaataggttttacgtacttaaatggttaaggaaaaaaaaaacagaagacaaatatgtaacagagactgcatgtggcccatagaggctaagatacttgtctgaactcctacataaaaagtttgccaggcttgatgtggtggctcatgtctgtaatatcccagcactttgggaggctgaggtgggaggatcgcttgagtcaggaggtcatgggtgcagtgagctgtgatcccaccactgcactccagcctgagtaacagagagagatactgtatcaaaaaaaaagaagagaaaagaaattgccaaggatggagaggacatgaacaacattatcaaccaaatggaatgaactgacatttataaaatactcaagggtgccttcttggtgatttggccctttaaagtctctctttgttcctggtcatttttttttcccactttatagagactccagctatcttctgattactgtttgcataatatatcttctttccatcctttaacttacccatgtcattatatttgaagaacacttcttataaccaacatatatagttgggctgtattttctaatctcttccgctagtctctgttatttgtgttagaccattgtatttaattagtggcctagtgggatttaaatctgccatttaatatttgttttctgtatgttcccactttctttgctcatccagaagaagcaactcttcaagtttgatcataagattttggcaattctgttcaagtttggcaattctgttcaggtttaatcataagatcttggcaatttagtcacatcttcaggctctacttctaattctaattctcctgctatttccaccacatctgcagtgacttcctccactgaagttttgagcccctcaaagtcacccatgagggttggaatcaacttcttccaaattcctgtttatgttgatattttgtcctcctcccatggatcatgaatattcttaatggcatctagaaaggtgaatcctttccagaaggtttctttttttttttgagatggagtctccctctgtcgcccaggctggagtgcagtggcgtaatctcggctcactgcaagctccgcctcctgggttcacgccagtctcctgcctcagcctcccgagtagctggaactacaggcacccgccaccacgcccggctaattttttgtacttttagtagacacagggtttcaccgtgttagccaggatggtctcgatctcctgacctcatgatccacctgcctcggcctcccaaagtgctaggattacaggtgtgagctgccacgcccagcccagaaggttttcagtggactttgccagatctctcagaggaatcactatctatggcagctccagttaagtaatgtatttcatagtaagactttaaagtcaaaattactccttcacaggctgcagaacagatgtgtcagcaggcatgaaaacaacattcatctcctgtacatctccctcagagctcttagatgaccaggtgcactgtcaatgagcggtaatattttgaaaggaatcttttttctgagcaatacgtctcaacagtgggcttaacacattcagtaaaccatgctataaacaggtgtgctggcatccagtctttgttactccatttatagagcccaggcagagcagacttggcataattcttaagggccctaagatttttggaatggtaaatgagcacgggcttcaactttaagtcaccagctgcattagcccctaacaagagagtcagactgtcctttgaagccaggcactgacttctcctctcaggttatgaaagtcctagatggcatcttcttccaacagaaagctgtttcatccacactgaaaatctgtttagtgtagccacctgcatcaattatcttagcagcttctacatcagcacatgctgcttcaccttgcacttctgtgttatggggagggcttttttccttaaacctcaagaatcaacctctgttagcttacaacttttcgtctgcagcttcttcacctttcttggccgtcacagaattgaagagagttaaggccttgctgtggattcgacttcagcataagggaatgttatggctggtttgatcttctgtccagacactaaaactttcttcatatcagcgataaggctgtttcgctttatcagttgccatgttcactgaaatagcacttttaatttccttcgagagcttttcctctgcatgcacaagttggctcttgtgcacaggtggtctggctctcaacctatctcagctttcaacacgccttcctcactaagcttaatcatttctagtttttgatgtaaagtgagaaacctgtgattcttcccttcatttgaaaacttagaggccattagagggttactaattggtctaatttcaatattgttttgtctcaggatatagtgaggcaggaggagacagagagacaggaaaggggtcaaatgatcagacagaccacacaaaacatttatcaattaagttcctcatcttatatgggtacagttcgtggtgccccaaaagaattccaatagtaacatcaaagaccactgatcacaggtcaccataacagataaactaataacaaaaaggtttgaaatattgcaagaattatcaatatttgaaacagtgacacaaaatgagcacatgctgctggaaaaatggcaccaacagacttgctcaacacgaagttgccacaaaccttcaatctgtaaaaaaaaatgcagtatctgtgaagtacaataaagcaaagcacaaaatgaggtacgatggaatactattaaatatatacatcacactgaatgagtaaacaacacacgcatcaacacagacaaatctaaaacaaatataatgttgagcaaaataagtatatcagaggcgagtacatggtatctttttttatataaaaattcaaaaacaaggaaaactaaataatgcattctttagtgatacatacataactgtaaaaactagtaatacaaacaactgatttatcacaaaatcaggattctatctcgagggcaggggaagataggatgcaatcacaaaagaatgtaataaaaataaggatactggcaatattctatttcttaaccagagtactgggtagatgaatattcacttcattattattattcaaattgtatgtatttaaatttcataatttaaatttgtaaaatgtatattctctacgtacatttcacaaatgttaaaaaatacagctagcggctgggcgcggtggctcacgcctgtaatcccagcacgttaggaggccgaggtgggtggatcacgaggtcaggagatcgagaccaccctggctaacacggtgaaaccccgtctctactaaaaatacaaaaaattagccaggcgtggtggcaggcgcctatagtcccagctactcgggaggctgaggcaggagaatagtgtgaacccgggaggcggagcttgcagtaagccgagatcgtgccattgcactccaccctgggcaacagagcgagactccgtctcaaaaaaatacagctaacatataccacatttaatatagtgaaactttaccaaaactttagtacttaccaaaggtacccatgcttcaatttcaaaactttaactttaaaaaaaaaaaaaaatctacctatactcattgaaggtttcccatctgtgacaggtttagagtaccaatgcatttaacagcagtgagccatagccctccaaattaggacccacctaaataggaagcttcactgagaattattaacaaaattcttctgccaaattgtgcagacaggaacataacaaatttaaaatatcaatctaaagtaacattacaaatattcatgcaggcagcctgaagtcctactaaaggcatgaagtgctacttattgcttacccgaaccactcctgtgtatagcaccaggtttccactgccttccaagaccagcatggtgtctattttctaaaaaaacaaaaaagacaaaaaatttatttcccaatctgagcaaattaacagattttttgactgaaaaatctgttgaagcgtaattgtcaacttctcaaatgtgcctacattacctccactggtgctgcatcctttgctggtatgttggtcactgaaccaaagatgagctgggttttatcattactctcttgaaactttacacagctaaataataaaataaaaaagaaacttgatacatgcaacaacctgtatgggtattaaaagtattatactgaacagaaaaagacaatctcagaagtttacatactgtatgagcccatttatataacattcacaaatgccaaattatcaagatggagaattagtggttaccaggatcagtgggtaatggtgtatgtgactataaggagttaacgtaagacagataaagatgttttgtatcttgattgtggtggtatttacacacatctacatatgtgaaaaaactgcatagaaccatacatacacataaatgagtacatgtcaaattgatgaaatttgaaataaagtgtgtacatcatctatctcctggttatgataatgtattatagttatataagaggttacctgtgagggaaaaagaatgcaaggtacacaggacttgtttactcttttgtaacttcctttaatctatcgtatttcaaaatatgaaggtaaataaatgggcaaaagatctgaatagctattttacctaagaagataaatgaatggctaataacttcatgagatgatcaacatcagaatgcattagagaaaagcaaattaaagccacttcacaaccactagaaaatagctacaatcaaagagtgtgatgatatccaatcctgtcaaggataaagagacattaaccttcatattttgctggtgggaatataaaatgatacaggctatttggaaaacagtttggtgatttcttaaaaagttaaacatgaatttaccattcaacccaatgacccaatcctaggcatttactcaagaaaaataaaatcacatatgtccacatttttgctcaagacctttgttcaaatgttcatatggtcataattctcagtagtcaagaggtggaaataaaccaaaagtccgtcagctgatgaacagataagcaaaacatggtggtagatctatacaatggactattacatagcaataggtatgaaataatgatacatgttacaaaatggtggatcctaaaaacatcacgctaagtgaaagctaaacacaaaaaggtacactgtgtgtacatacattatatatatataaatgtccagaaaaattaatctataaaggcagaagcctagcatggttgcctgaggctggaaatgggaacaagactgactacaaacaagcacaaggaaatctttttatggtgatataaatcttgtaaaactgggtcatggtgatggttgtataacactgtaatttactaaaaatcatttaattatacagtaaaaacatgttaattttatgacatgtaaattatttctaaataaaactacttaagccaaaaaaaaaaggaaagaaaagaaaaagaaaaagcagtgctaagttatttatacagaaacaatgggaaagacatacacctaccgtaactggagctgggactctactaaaaagcacaggaacttttgcccacataggtcagatgtaataaacacttttgaggcttgtgaatttttctctctataatagatacattaataaagtaactgtcagcactggtccaagaatctaccacagtaactattaaaagtctttgaggccgggcgcggtggctcacacctgtaatcccaacactttgggaggccgaggcgggcagatcacgaggtcaggagatccagactatcctggctaacacggtgaaatcccgtctctactaaaaatacaaaataaattagccaggcatgatggcaggcgcctgtggtcgcagctactctggaggctgaggcgggagaatggcatgaacccaggaggcggggcttgcagtaagccaagatcacgccactgcactccagcctgggcgacagagccagactccgtctcaaaaagaaaaaaaaaaaaaaaaaaagtctttgaaaatattctgcaagaaatctaaaaactacttaggtcaagcaataatctcaaagacacaaacatttctaagaattaaacttcatgatctctaagatcctttcagttctttgattatgagctcgttacacagctttgttggggaaagctacaataaatttaacaattactgatgaacttttaaattacatactatgtaagctccctacttgtaaagtaatgcaaactaagccacctacttgtaaagtaatgcatgcaaacttgaattcctatcccgcaaagggccagatctttcataatgctatttctcctatctaccccctctccttctcagattaggcctcattcacatctctttttgaaatcgtatctctaattcccaaacccttccttctaaagtgctacagaaggccgggtgtggtggctcacgcctgtaatcccagcactttgggaggccgaggtgggcagatcacctgaggtcaggagttcaagaccagcctgaccaacatggagaaaccccgtctctactaaaaatacaaaattagccagtaatcctgtaatcccagctactcgggaggctgaggcaggataatcgattgaacctgggaggcagaggttgcggtgagccaagatcacgccattgcactccagcccgggcaacaagagcgaaactctatctcaataaataaataaataaataaataaatagtgctacagaagacccataaatctaaaaaataagaatctataatatattcaacttacaaataagttatttaaagaaaaatgatttataattgtaggatacttttgatatatgagaaacaaaccagacagactacttcaacattgtatccacatctttactttcttcagactacctattccccatttcattctctctaagattatgcatttgccttccatttcagataaaacgaggctctaaggcttgagctcaacctcctgccttacatatctgatcaaccttcacttctttatcccaatctcaccacttatgcacctttctggttacttgttccatcaatcatttcctctgttctgtattttcaatactttcccttgagtatagtccgtatagcctactacttcacattaaaagtcttaaaatacaaaatggactcaacattagagtatataaaagaccttctcaattcgactggatataaaacttgtattgtggttaggttagaaaatactgggggccaggcacagtggctcacacctgtaatcccattactttgggaggcagaggcaagcaggttgcttgagcccaggagtttgagaccagcctgggcatcacggcaaaatcctttctctgcaaaaattacaaaaaattagtcaggcgtggcggtgtgtgcttatagtcccagctatctgggaggctgaggttggggaatcacctgagcccagaaggccaaggctgcagtgagctgtgattgagtcactcactgtactccaacctgggtgacagagtgagaccctgtttcaaaaaaaaagaaaaagaaaatactggggcaagatgtcatgaaaactaattttattatagttcagcaaaaacaaaactctccttgaccaagactccctctaattttgtatcttcattcctattcaaaggcaaactccttaaagagtctgtatgcctatgttcatttcctcagtccccatttactttttctaccccactttcccccgccaccctcccagcttaaaatgctctggccaaggtcaccaaggaacccactgccacccaggtacctcctctctgggttcaactctcagggccacacttcaccagtacctggcaatactggcatctctgtattcttgaaatgttcttttttgtattctgtatttcctgctgcttctcccatctgacctcttttgctttgtctctctgtgccagctttgtctctttccattccccaaatcttaagtttccaggacttcagttcctagccctcttctcattctacaccactggattttaactatttggaggccacaaatccctttgagaatctaaggaatgttaaaaccctctccttgggaaaaggcctatatactacatgtacacacaattattgaatacaataattcttcaattctaatctaattctcttacctcaatcaccacctataagctgacaattccacatttattgttctgctctttcccaaacttccgacacacttataaagtgccttcttaccgctgtcatcaaacataccagaggcctaaagggcaatcagtaatctctcaagcctcctttttttctttttcagacagtctcactctgttgcccaagctggagtgcagtagtgtgctcttggctcactgcaacctccaactcccaggttcaaatgactctctcacctcagcctccagagtagctgggactacagatgcacgccatcatgcctggctaatttttgtatttgtagtagacatggggtttcaccattttgggcaggttggtcttgaactcctgagctcaagtgatccatctgcctcagcctcccaaagtgagtgattacaggtgtgagccactgcgcctaggaagcctcctcttcattagccttttccctcccctctgcaaaaaccagagtggaagtacttgtaattccctaaatacaccacgcactcaccagaacttttgttctgatcccagctgccgtctgtggtctttctcaacttccctgcctagcgaatacctattcgtctttcaaagccctaccagcaaaagtagtccctcctgtgtcaccatccttcagctatctgcctcttttgaggacagggacagtgacttattagactgttaactagcacacacattggcatataaattaacacgtgaattattaaagagaatataaaagaagaaaggtcacccagaacagagatctaagctatgtttcccaaaaagtaaagctggcactcaactaacatgaacataaaacttaggaaacgtgctaaaaccccacatttcctcacggatggaaattaactgtttctccccagaacaaaaaacacccgaaaaatgagagattattactataaaggaagaaatatcagatgacaaaataatatttttatgatgactttttttttttgagatagtctcactctgtcacccaggctggagtgcagtggcacgatctcagctcactgcaagctcagcctcctgggttcaagcaattctgcctcagccacctgagtagctgggattacaagtatgcaccaccacacccagttaatttttgtatttttagtagagacagggtttcacaatgttggccaggctggtctcgaactcctaggctcaagtgatctaccagcttcagcctcccaaagtgctgggattacaggcatgaaccaccacgtccagcctatgatcactttaatatcattaatatcctctactgaaactgaggtggccttaatacatatctctatatatttttacatatattaataactgatcacattaaaaggaaactttaaacaaaatgccatatatttcccaagactttcagcaacatttttctttgaatataataatatatataacaaaccttatattagtaatcgtttctgtccacaaatggtcaatacacagttcaggaacaattggctccgtttctggtgcaagaaaggagccattagaattactatttggagaatgagaaatactatgtctctttggagactgattatggcttgaaatgttgaacctttgcacccctgaaaaagagtgcactcctaacgcaggagaatgagcacgactgcaaaataaacagaggagagagtacatcacagttagcaaggcaggcttatatgacacacactccaatgacacttccaaaaattccacagacagaagagcattcatggcataatccaggtcagaaattaaaatttttcaaaaaggagtagctatttaaatggttcatgtcaatgtgctttactatattctaaagatttagaattattattagaagaactcatcttttacaactaaaacttagatcatcttctttttcggaaaatgaatgattattcaaaaagctctaaactatgtccctgtatagtcagacatatatatttatcaacaaaacaatgtccctgtagcaccagatatacatatctggtcatttaaatatatatctatatagagaaatagatacatttacatatcaaataacaagtaaaaaaaaaagaaaaactaacataaattaaggcaaaaataaaatagtgccacagtattttgggaattaatattcatcaaactgttgcccacatagtggtagaaatgaggcaactaaccttaggtcaagcataggcagcttcaaaatatgactcaggaaagaatgtgacatggtaaacttagaaatcttagtaaaagtggctcagggctgagcacggtggctcacgcctgtaatccccgcactttgggaggccaaggcaggcagatcacaaggtcaggagatcgagaccatcctggctaacacggtgaaaccccatctctactaaaaatacaaaaaaaaaaaaaactcagccaggcatggtggcaggcgcctgtagtcccagctggaggctgaggcaggagaatggcatgaacccgggaggcagagtttgcagtgagtcaagattgcgccactgcacaccagcctgggtgacacagcaagactccgtctcaaaaaaaaaaaaaaaaaaaaaggctcaattgggataatggctatttcccctaaaaaacatctcccctaaatatatttcccctaaaaacagctgtcaacagaaattctaaatccttcaaaacaaaacagaaagcttagaaagaaaaaccaggaaacccttataccttagagctgccatgttggaaatagaaggtgagcgagaatgtagactgggtgatgaggttgagcgactctggctgtgaatggaggagtaattctggaaaggtgaagtcacaggggaatctcctttggagaggcttctgagatgtgctgtgagggagctgctagtggccacattctgtggggttcccccctgttcagagaactttaaaacaacattctcttccttaagtc

SEQ ID NO: 355 - DNA, 29394 bp, Homo sapiens
atttacaaggtccctatatgatacaaggttcctatatggaaaagacagtcatctcaggacttcctggcagtttctaacctacaaacaaatttaccttgccaactgaacgagaagttcaacaagtgaacaaattccttctcccattagagtattcaacttaagctcctcatacacaaggtgaagaacgaaaaaaattgcaggtatgtgagtaaagagaagtgtagaagaatccagactgagattctgtgaaaaatcctcatccttcatctgtgaagcttctgaaggactcagacataaagatctgttcaaaagatgagactcaacattctggtggtagtctgaatttagtaaatattcccagtcctgagaagaataaaaagaatattaatttttaaaaataatacctccttataatatcataagaaaattaattcacttaaaacaattcaagtttcattttcacattaagttgatctaagagtatgttaaaaaaaaaaaagacaatgctaagaatgaagtaactataaaatagcaagccagttataaacgttaaggcaagccacctttaaaaaccattaaaaaaaatattttcatgaccttttaggaaagacattgggagaagaattatactatttaggtagagattgagagagaaaatttaagattatctcaggctaggttttataggaaaagtagatggcaagttagtggccactacactgaactgtgttttggtaagaaggaaggtccacctgcattcagctggtgtattcatctttccacatgtataagatgccggggctagtaatataatctaataatcaactgatttttatattcagactgattggactacattttccaaatattcaagtctattttggttctacttgtgatttactgcatttggttcagagaatgtggtttatgctatttccagatcttggaatttactgatgtttttgtaaggcttaatacagtgtgttactctaaattaaaaattcttggactagatacagaaagaactaaccataaaagaaaaaactgggccgggtgcagtggctcatgcctgtaatcccagcactttgggaggccgaggcgggtggatcacaaggtcaggagatcacgaccttcctggctaacacggtggaaccccatcacttctaaaaaaatacaaaaaaattagccgggtgtggtggcgggcgcctgttagtcccagctattggggaggctgaggcaggagaatggcatgaacctgggaggcagagcttgcagtgagctgagatcatgccactgcactccagcctgggcaacagagcgagactccatctcaaaaataaaataaaataaaataaaaaactgataaattggataactaaaataaaaaattctgctcatcaaagacactgttaaagccacattctaagggaaaatatggtcaagaactcatgtctagaacatgtaagaacttcaacagcttacatattttttaaaatctaatttacaagtagataaagatttgaatagaaacttcacaaaaagatacataagcagctaatgagcacatgaaagagtgtttaacatcctccaacctcagcctccaagtagctaggactacaggttatgcgccatcatgcctggctaattttcaaatttttttggtagacaactggtcttactataatatgttgtccaggctggtctcaaactcttgggctgaagcagtcctcctgcccctacccctcaaagtgctgtgattacaggcgtgaattttcatttaaaagaaattaaattaaaagaaattaaaattacagatgtgaattttaatttaaaagaaattaaattaaattaaaagaaattaaaattcacacctgtaatcgcagcactttgagagataggggcaggaggactgcttgagcccaggagtttgagaccagcctgggcaacatattatagtaacaccttgtctctaccaaaaaaatttaaaaattagccaggcgtgatggagcataccggtagtcctagctacttggaggctgaggtaggaggatggcttgagcctaggagttcaagattacagtcaactacgatagcatcactgcagtccagcgtaggcaacagagtgacaccctgtctcttaaaaaaaaaaagaaaagaaatgaaaatgtatgtccacgggcccggcatggtggctcacacctgtaatctcagcactttgggaggccaacatgggcagattattgaggccaggagtttgagaccagactgaccaacatggcaaaatccagtctctactaaaaatacaaaaattagccaggcatggtggcacacacctgtaattctagctactggggaggctgaggcatgagaactgcctgaactcgggagtcagaggttgcagtgagccaagatcgtgccactgcactccagcctggatgacagagcaagactccgtctcaaaaaaaaaaaaagaaaatatatatccacaaagacttgccagtgaattttggcactagcttgctttattcataagactttaaaaaaaaaaaatggaaatagcctagatatctaccagcagaagaaggatagataaacaaaccatggtatattcacactactcagcaataaaaaagcacaaactactggtatctgtaacaatatgaattaatctcaaaagcattatgctgaataaatcttataccaaagattacatactatattattttatttacatcaagttctagaacaggtataactaagatatggtgacagaattcagatcagtgattgctagaagaagagaataaagctgattaaaaacagcaagaggggccgggcccagtggctcatgcctgtaatcccagaactttgggaggccgaggtgggcagatcacgaggtcacgagttcaagaccagcctgaccaacatggtgaaaccccatctctactaaaaatacaaaaattggccaggcgtggtggcgcatgcctataatcccagctattcaggaggttgaggcaggagaatagcttcaacccaggaggtggagagccgacatcgtgccactgcactccagcctgggcgataaggcgagactccgtctcaaaaaaaaaaaaaccacacaaggaaattttatggagttataaaaatattgtgtgtctttataggagtgtaggttacatgagtgtgcatatattaaaactgatcaaactaaacccaagctgtatttcatttttgtaaattacaccacaatttaaaaaaacatatttggaccactgaagaataataccatggaggccaggtgtggtggctcatgcctgtaatcccagcactttgggacaccaaggttaggaaggtcacttgacgtcaggagttcgagaccagcctggccaacatggtgaaaccctgtctccaccaaaactacaaaaattagctgggcatggtggcgggcgcctgtaatcccagctattcaggaggctgaggcaggagaactgcttgaacctgggaggcggagattgcagtgagctcagatcctgccactgcactccatcccgggcaacaagagtgatactccgtctcaaaaaaaaaaaggaatataccatggaacctgatacaattgagaaccttaatttaaaaaacactgcataaaaaaggtaaatgctgtcatttcaggtgatcagttgatactaaaatgtctacaaacccaaactgaaatcatgcagtaatacatgtattaatttttagataatcattaaagaccacagaaaatgtaacagatcctactcttcaaaataattgctattcagtattaaaataaataaagtgaaaggtgttggaaagatagaggaattgataggaataccacagaagtggaagaatagtatgaatatccataaattaatttatattagcaagaaataataatgcttacatcatcagatccagtctcggaaggccttgcttttttgggcgcaatgacaggagaaagtgatccttcaaagtcaaactgaaaagtaaccccaaaagaaaagataaaaatcgtaaatgcattcctgtcaactgatcaacttcaaggattcagaaatcagttctgccaattacgaaaactgagaaaagccatcaaaactcattttttgatctggaaaggcattatttaaatatctttcttccaggttactgtaaagatgaaatgaaatcatattaatatatgcaaacatctagaacagtgcctgggcttctaaggactgattttaatggtagtttccttccctctcctactcctgtaacaacatagattacatcacatctttggtagaaaaagaaactttaggcatatccacaatataccaagtctcaaaggatcaacccaatatcagtcaaatgttagaactaagcaaacatttatttacagtccacctacagtaaactatctaacaattctatggcagagacaagtagctactctggaaaatcttttttctcctctttctcctgaacccacagccagactacatacatacgtctgcctcctttgaagttaggtgtgaccctttgacagagttaattataaatggaagtcactgtcatcacttccaggaccagtccagtcctacccctgctcctccaggctctttgccccttccacctgactggaatgcagtcaaccaatggcaatctttgaaccaaagataaaagatcctccatcaacctgggttcctgaataactgtgtggcctgtttatctgctaagccctgttatgtaagcaagacagacatttttattgtgtttgagccattgtatcttttgaggcctttctattacaatagtgagcctatcttctaactaatacaactacataaaagcagttttctacaagttgctcttcttcaatttcccctggcataatctttgctgccccagctacttcacatgggcattgaccatcaactaataaactgtaactctataaatggcaatggctattttcctatgctgaaaaacttacatatttatcaactcactcacctaaacagagttgatttctatataaaaactaaacataggtagcaataaagtgatatttaaaactgaatgttattgagagagaagatctgcttgtgaagcgttcaaataaaaaacagcccaactcatatatattataaaaaacctggtagtaacagtgaaatcaaagcaacaaatataacagtaactatctaacctaaaacttcaaccaaaatgtaacacacacaaactcccacagtcaaaaagaatgtccctgctataattatcagattcataaggcctggagttatgagaaagtagaaactgcctgataaggatggctctttgtgccatacatggatctgtttaatcttcactctttcaatgtgtctcaggttagccaaccctgttatatgctcctatggacccttacccttcatctatcataacacatttatcaaatattatttatttgtttcccccaagacagtcaattccagaggaacaatctgttttgtctggggtatatgtgagaaacctggcatcatgcctggcccacagcagggattcaatatttatctaaggaaaaaaacagcagcccggaagccacaaaaagttaaccccaaatgcaactgttcctacaatgtacagtccagtgcactcatgtaacacatcagcaaattaaagaaagcacaaagaaatgccaaaaattgtgtaacgagtcattggcagaaattctgtactccaccacattacatatgtgaaaacaaaaagaataaatctgaacaaagcaaaatgaaaaccatttgccaatgaggaccattttatcctaagctttgactatgaggacaaaagataacaagggtttaaccatgcagtcctataaataaatagcaaagcaacttggcctcaagaattgatttccttattccttcctttataattatcatgcaataagtaagtcaaaaagccatgtccttctctgcaaaggaaaaaatgggtaggtgctcagtcctccccaaaacatggaaacgcgaaggggcataggttctctgccagagactaggacacaacaatctgtactcatcaacaagttacaaggacaatgatacacaaaactacagaaagctgacgcgttttttcataatgtagaaatccagtttctatgaggcttaatcttttcacatgtaataaagaacagaaaaattggggataatgtcactcggatacaattgtttaaaataagaaaagaaggccaggagccgtggttcacacctgtaatcctagcactttgggaggccaaggtgggaggatcacttgagctcaggagtttaaaaccatcatagccgacacggcaaaaccccgtctctactaaaaataaagaaattagccaggcgtggaggtacatgcctgtaatcccagctactcaggaggctgaggcacaagaatcgcttcaacttaggaggcagaggttgtagtgagccaggatagcgccactgcattccagcctagacgacagagcgaaaccccgtcttaaaaaaggaaagaaaagaaaattgtccctattttcccataagatttctctcaaggaaattgcagagagcaattccttcatgtgctgaaatagacacaaactcttaaaaacagtatctcactcagatggaaaatggcattcactcaacaaatgttcactgagtatccttctatgccaggcaataccacaggtcctggagagagagagtagtaaacaaaactaagcaaaaatctttgccttcctagaatttacattccagttgggggaggaaggacacaaaacaaaataagtaaaacatatagtatattatatttaattaagtgagaagaaaaaaaaacaggtaaatggcactaaaggtatggaggcaggtgtaattctatagagacaggacaggcagcactgaggtgacatctgaataaagacctaagcacgtcttgtcggagggaaagcattctccatagaggtaatggcaagtgcaaacactcagaggcagaaacatgctggcagtgctcagggaacagagctgaggccaatgtggctgggatgatgtgtgcaaagcattaagaaataagagcaggaaggtgagcaagggctaggtcacatggcatcttataagcctatggcctttactctgagtgacatgggaagtcactgggggattctacgcagaggcgtgacgaacgcaacctgacgttatcaaacaggattactgtggccactggactgagaagagactggaacatagacaaaggacatgaaatacgaatcaaaaaataagaactataaataactgatgaaattttgaaaaaaacattcccatttacttatagagaaataagataaaatttctcaggaagctggcaaaggttcaccacaccacaaataaacactgtggtgaaatgggcgcttttaaatgatgctagtaagaatgtcacctgggaacccctttccaaacattacttgacctcacagtttctcttttaagattcaatgcttgggaagtaactagagatgtggttaaagagtcgtgaaaaaggatgtttataaattacaataacgaaaacaacagattcacaaggtacaattattagctattggttaactatgataaaactacactatgaagaaatgatggagatattttagaaaaaatttttaatgatacgggaaattttcattggtatttttatatagaaggtaacatcaaaaatatttagagtggttatctctaagtagtataattattttcttaattcctccattttccacattttcctttcataattaagacaaaaaacaaattttaaaaatggatttgctggccaggcgcagtggctcacgcctgtaattccagcactttgggaggctgagacgggcagatcatgaggtcaggagatcaagaccatcctggctaacacggtgaaaccccgtctctactaaaaatacaaaaaatcagccaggcgtggtggcgggcgcctgtagtcctggctactcgggaggctgaggcaggaaaatggcgtgaacccaggaggcagagcctgtagtgagctgagattgcgccattgcactccagcctgggcgacagagcgacattctgtctcaaaaaaaaaaaaaaaaaaatggatttgctgtgcaaggctaaaacatatagaatggtacagctgagctacctggaaaaggggtaattataatctagagtgattttttttcagagtgacccaggcaaagttgtcctgggagtgatctccaaagctagaaggagatcaccaatactgaagacaccactctgctgattttgtaaataatctaataagggcctgtaaggatgttactgcaggaagagggtgagaggtaaggctttataccattaacagagtagatactcaggctaaagtactttaaatctccctcaaatcaaaccttcctcttcacatcccaagcaatatgtgtgtaaaaagacaatcttgtcttcagaaaacaatgttaaacaaggagtcagaagatgcagtctagtcatagttgttaaaaaaccacagatctgtgatttctttgtgatccagtttcttcatcaataaaaccaagactatcactaatcctagcataacttgcagtcattttacaaaggtgaaatgagaaatagtcatatatgctttaacattctaaagctcagtaattataatcactagtaaaatgttaatattaaatattaagtgagattttatttacaatatatagatacaataaaccttaatattattctattattttgaatatggtacgcctattatgtagtctcaatgttatattaccaattatgcaaccattacattaacagaataactcataaagaaaacaatagtatttacttacatttctagtccatgctaagcggtctgtgttataacccatcatgttcatgagacaagtcacaaataaattccactctgagtgataactgggtcctcctggagcactgtggacattgtaccacttgacaagcatctgaactgctatttcttttggcaggataaacttaattgcttgcaaacacgtttgtactattaaaagcaaagattaattttagtattcttactctgcatgcatttcttttcccctttcaatcaccaagttttttaacttctactatgtaaaggccaattattatgaaaagaaaactgtcattaaagagccaatgagatgcaaacattacctaaccaatcatctgaaactaaaaccaactactgaattcaacaaggcttgaaaggggtctgaagacagcttttttttttttttttttttttgagagggtgtctcgctctgttgcccaggctggagtgctgtggcacggtcttggcacactgcaacttctgcctcctgagttcaagcgattctcctacctcagccaccaagtagctgggattacaggcgtctgccactgccccaggctaatttttgtatttttagtagagaccatgtttcaccatgttggccaggctagtctcaaactcctgacctcatgatccacccgccttggcctcccaaagcactgggattacaggtgtgagccactgtgcccggccaaggacagctttttgatcattaattttgcatcagaaataaagtaatcaaatagcccagtttgccagagacagtcctgatttacatccattgcccagcaattactaactgctcgccttcactcttaaagatgttctagctcgggtgacaaattaaaagtcactatgggccaggcatggtgactcacgcctgtaatctaagcactttgcgaggtcaaggcgggtggatcacctgaggtcaggagttcgaaaccagcctgaccaacatggtgaaaccccatttctactaaaaatacaaaaattagttgggcattgtggcaggcacctgtaatcccagctactcaggaggctgaggcaggagaatcgcctgaacccgggaggcagaggttgcagtgagccaagatcacgccattgcatttcagcctggatgactagagcgaaactctgtctcaaaaaaaaaaaaaaaagtcactatgaaaaacatacaacttctatgtttatacatttatataaaatactgcctacatacttcagtaaatatataatattcaatatatgcatccacgaatagcaatgcttagctagcattacatgatgttctaaatgagttaacatgcctattaaccaaagctttataactttatttctgaggtcgttcagtttctaaaatgtttcacaggctctctgtcttaaaagggttaagagttaataccacataatttacaccattctttttttggtaaggggaaacagggtcttcctctgtccccaggctggagtgcagtggtgcaattatagctcactgtcacctccaactcctggactcaagtggtccaccagctcaagcttcccaagtagcaaggactacagatgcatgccagcatgcctggctaattttatttttctttttgtagagacagagtctcactatgttgtccaagctggtctcaaattcctggcctcaagcaaccccctcacctcagccttccaaagggaggggattacaagcatgagcccaccacacctggccttataccattctcaatggctccacatcaattatagcactacactgtcatacaatgatcccctcagagtggccagggctaccactgtgaagagacccaaatctgcttttagtagtaaataatcccaaactgcaatgtttgtgtactcacatatcctctcttccaggattcttttttccctttccactgtcatgccactgggcccaccctcatcaacatatcctctatcccatcagtttgcaatgtgcaaactcacacagcacaggttggaagcaaataatattaaaataccaaataaccaagtatgtcatagtggaatccaaaataagtgtaaacccaatgctgcatgagtgtgtgagaaccctctgcaggtaaagtacataaacttatgtgcataaactatggggcttctgtttggctataaaggggtaagattttttgttttcatttatttaatttattccattattatttgtttttatatattttgcttaggcttataatagttcgaggtacctggccttgtgattacgaaataccttttagagccgggcgcggtggctcacgcctgtaatcccagcactttgggaggccgaggcaggtgaatcacgaggtcaggagatcgagactatcctggctaacacagtgaaaccccgtctctactaaaaatacaaaaaaattagccgggcgtggtggcgggcacctgtagtcccagctactcgggaggctgaggcaggagaatggcatgaacccgggaggcggagcttgcagtgagccgagtttgcgccactgcactccagaacctgggcgacagagcgagactccgtctcaaaaaaaaaaaaaaaaaaaataccttttagaaggcaaggaatctctatatcaacttggaataccatttaccagcagtgaaaattcctaaaatgaaaaagtcattcttgtctacaatctgccaatgtcctgctttggcagttagatttgaaaccaagatatgtcatgaacttccttatatcatacaggcattcttttcttaacctacgtttgttggcaaatcccttcaattctaacattttgtttactatgctatgttcagaaatattctcctcaagcatttttgaaattgcatctcaggaataattcaagcagaatccaatatttattaagataattctgattgtattttgacaataatattaagttttattcaattaaggcaattaggttactttcacaatttatctgaaaattgagatatttattttaaaattaaaaacatcattaatacattacagaaaaaaaaacattaaatatgccaagaattatcttagttgcttaagcttccagtttcccagatgttcttgcaagaggcatgtccatatatatacatatacatatatatatatatatatatatatattttttttttttttttttttttttttttgagacagagtctcactctatcacctaggctggagtgcagtggcacgatctccactcactgcaacctccgcattctgggttcaagcgattctcctgcttcagactcccaagtagctgagattacagaagtgcgccaccacaccccgctgatttttgtatttttagtagagaaagggtttcaccatgttggccaggctagtctcaaactaccgacctcaagcgatccacccgcctcagtctcacaaagtgttgggattacaggtgtgagccaccatgcccagcaggcatgtccatatattattatactgcacaatattccccaacagaagaacctcagggaacagaactagcacatccttcacctgtactccagccttagagcgcacgtagagtggacatcacaaagcactccctagctctttaaagctcctctacaaagctaagaacttgatccagtggcttcaaaaatggcaaaataatgtttaaaaccccaattattaatgtaaatcacaattacttcatgtcttataaatgaaacttctcaatcgtacctaactcagaggtggcaatttcaggaatagtgatcctaaccatggagccattactcagttcctagatggaaacaaatgagaaagtagataaaatctgtgcattctaagtctttgaatgtcttaaaaatagctggtacaagactttgcccatcaaagcaataaaataaatgaaaaacaattttcaaacagaaatgaacacttccgaatttcagaaactttaaatgtaattatttgcaaaatgttttccaaaatgcttgttttaataaaaagtgtctaatctttatacagtgagtcaccatcatcaaaaggacatttacttttaatgagaagacaaaaaatcacatcaatatacaattcaactgactcaacaagcttttgttttcactaagtttttaataatacagaaactgtagaaaacaagcagaattactgtatagtaaaaagtaaaatcgtgccaaaaaatgacacaatagatttttttaaatcatgagaaatgtttgttgtcatttttcagacaaaattctgtattctgtcaaatttgaaatgccagcccacttcttggaaagctaccaaatgtttatacttaccagggtgactctgttatggacaggatctctgatagaatgaatgtaagttccaagctgttggaaagtacaatcctcattatagagagaatcatgaagttttgaagaatccctcagttctggaactggggacaacagaacaacctgtaaaaagttgtaaatacgatacaaatgaattgttttctgagaaattaaggacaaggaaatttaactgtttcttttttgcatatggtctaacaaacaataatatgtaatgattcaaaaacattctgctccaagccaagcatggtggtgcacacctgtatagtcccagctactcagaagactgagacaggagaatcacttaagcctaggaatttgaggctgtagtgagcctgtgaatagtcactgccctccagcctggatgacacggcaagacccaggctctttaaaacattttgttccagatacaatgaagtaccagcaaaccaaggtcctcacagaaaacaactagaaaaggtaggtaaaaggaaaacatctgattggtggctatggaaaagctgtggaagcaacctggacttgagggaccaagatctaggagagaaggcaactgcagggaaaggggccaacgttcttggagagccttgctttttctgctctggccatctgcaaattttggtggtaagaggaacatatggaaaggctgacaatatgcaaggaaagtcatagctaagagggagagaagccagcagcactgttagcaaccttacagggctaaagactaaactgtgagccggggcacgcggtggctcatgcctataatcccagcaccttgggaggctgaggcgggtggatcacttgaggtcaagagttcaagaccagcctggccaacatggtgaaaccccatctctactaaaaatacaaaaattagccaggtgtggtggcgggtgcctgtagtcccagctatttgggaggctgaggcagaagaatcgcttgaacccaggaggtggaggttgcagtacggtgagattgccccactgtactccagcctagatgacagggcaagactccatctcaaaaaaaaaaaaaagactaaactgtgatttgaggcagctgaggaactaagagcccaggaagaaaggacagtaatgaaaaagccaacaaatgagaccagtatttaatggtatttcccctataggcaattatttattcaaaaatacaggaacagtatttatttgcttaactgcagatatgcaaacaaaaaatttaaacgatcttagttactatctacatgcagatgcttccaatcttaaactctagtcatgaccactgatcctttttgattcctttaattcaatttatatatctctaagtgaatatcttgtcaacactgacaatcaagactaagatgtatttactctattccagattctactctaaaagtcaccaggaaaaattcagctccgctggtcctggctctaagtctactagcaaaatcttccagagaagtggaaaagccatcaatcagccaatgtgttaagactatcatttccatgactttacacctatcaaaaaggcactattaccaggcttatagaattctaaaaaagttggaaaccattttccattataaaagaaattcttccaaatcacacagaacactctgacacttctccagttccccctttgaatgttctgcaaatgtgctggtttgaaggaaaaaaaattcaatgtggcacatgtttaaaaatataatgaagacacagacattatcaaatacaactgatagcactaaccttccctttgaaccgtccctaaacatccacactcacatgtcctttaaatacaaaccacttttctccaggcttcctaacttggtaaatccaggtaccttcccaggtcattcagagaattcggagcctcgttccacatcacctttccccagcccagcagcacaaaaccaatcagctgacaaactcatttccacctctcaaggcctctcatattaatccctcctttccacacatatactgccctagctcagaccctcttcatacttcttaaactgacacagacaacctcacttggaggctaaccggtctccttatctttaatcccaaaatacacctatttacaacacagatccaaaacctcataactcctttctcaaaatcctgtaatgccctgtcaattgcattcagaataaaaccacctttttatcctttctgcctttaagagcacattagtaagagtgtaaatcccagttctaccacttattaggtttatttcatttgtaacttctatctcatttgtaaaaaaaagaatcatagtactatcttctcaataaagctattctaaggaaataattaatactaataaagcactgagaacaatgcctagcacatagaaaatgctcaaaaaaggttattattgttatccaaaccctatcctgcctcaccctacagactacttgtacttttataagtatttattctacagatttattgagtccttatgactaggagatgaagatacaaatatccactaaaaaatgttccacattatctggccttcctgcctgtgcctgtgtggtttctccttgccctgaatgctcctttctacctacagatatcctactcaaccccaaggtccaaacgaagactgacatgtctctcagtgaggctttgattttgccatgtcctcccattggatgttatcttcccatcggatgttatcttcccatcagtcaatcaacgatggtactctcttttccacattactgagtcatgagtctttcttaaattctaatttcttatgcagacagtacatcaactccacacaattgtgagatccctagatggaaaagaatgtatcatttccatctctccagcaccttcaaaaagtatcacatacatcacaagggaggtcagtgtatgttaactgaatcacttctgtttgaaaacatttattctgcaagtagaaactaaaattaagttaaccatggaaagaactaatgtttaaccaaacttctttaaaaaatgttaactttttggcaacacctagtccttttcttacctcgtccaatgatccaaggagtttactaagaggctttggagtactaacgccatctagtggagtactgggccgaggcattgtgttggacatcgtcagagagggagctggcagtccaggaataaaaacctttcccacctttaagcaataaaaacatgtggaaaaaaaaatattgcctttaatgcatcatatccttaaataaaatgttaaggaatataaacatatatttcttttgatatttctaagtttatactcaccaaacacagcaaagaaacaattcaaatgtcaataatctatccaattccactatccaactgcaaatatgttggtataattttttttttttttgagataagatctcactcttttcccgtgggtggagtacagtggcatgatctcagctcactgcagcctcaacctaccaggctcaagtgatcctcccacttcagcctcctgagtagctggaactataggcacatgccactatgcctggttaattttgtattttttggtagagacagggtttcaccatgttatccaggctggtcttgaacttctgggctgaagccatctgcccacctagacctctcacaccttggtataatttctcttggttggattccttctcttcattactgaagacttttttttgcaggcaaggagaggaatgttaatatagtcaacacattatataaaaatctgcacactatgtactcttctacctttttggtcataaagacagtaagaacagcggccgggcgcggtggctcacgcctgtaatcctaacactttgggaggccgaggcgggcggatcacaaggtcaggagttcaagagcatcctgcctaacacagtgaaaccccatctctactaaaaattaaaaaaaaaaaattagccgggcgtggtggcgggcgcctgtagtcccagctactctgaggctgaggcaggagaatggtgtgaacccggcaggcagaacttgcagtgagccgagatcgcgccactgcactccagcccaggcaacaagaacgaaactctgtctcaaaaaaaaaaaagaatgagttgacaatccgtgctaaccactccttattttggctatctgtagggtacttagcaaaaacagaaattcacatctgtacaagctgaaaacttgataagactaaaaaggagatgctcagaactaaaatgagatattaacaacgtacgtattcatgttaacacactactcaaaagctaacaaaataacagaagttgccccaataaaatccttaggcttaaaaaacaaaaataacagtgagaactaattatgcataattttttaaaagctatctcaaacccctaatttacgaaaagatggaataagcacataccatgctattccctcattaatcaccaaaaagaaaaaaaaactgaataaaatttataatgcaactaacagaagattctgaaaaagtgaagaaaagaagacaaactggctagtaacctgagacccaggaatgacctaatgatgaattccctaggtttctggtttgattccttacgtaaccaggccttaggctttcaaagtgcctataacacagacatgccaacgttcacagacaaaacacgccctaagaaaatcttactctttccagccaaagtgttgggaaaagaatgactgaccaggacagaaacttttcactatatctgccctactctttgcaaacaccaagaaaaaagtcatggccatcccttcctcctcatcaggaggcacagtgaaaattttgaatgtccctcgtctatttgaggaagtccccttctatttctagatgctgaggattttttttaatcatggatattttattttatcaaatgatttctctgcatctatttagatccttggtcagcaaaccatgttccatgaccaaatctggctcgtatcctgtttttgtacagtctgtgagctaagaataggttttacgtacttaaatggttaaggaaaaaaaaaacagaagacaaatatgtaacagagactgcatgtggcccatagaggctaagatacttgtctgaactcctacataaaaagtttgccaggcttgatgtggtggctcatgtctgtaatatcccagcactttgggaggctgaggtgggaggatcgcttgagtcaggaggtcatgggtgcagtgagctgtgatcccaccactgcactccagcctgagtaacagagagagatactgtatcaaaaaaaaagaagagaaaagaaattgccaaggatggagaggacatgaacaacattatcaaccaaatggaatgaactgacatttataaaatactcaagggtgccttcttggtgatttggccctttaaagtctctctttgttcctggtcatttttttttcccactttatagagactccagctatcttctgattactgtttgcataatatatcttctttccatcctttaacttacccatgtcattatatttgaagaacacttcttataaccaacatatatagttgggctgtattttctaatctcttccgctagtctctgttatttgtgttagaccattgtatttaattagtggcctagtgggatttaaatctgccatttaatatttgttttctgtatgttcccactttctttgctcatccagaagaagcaactcttcaagtttgatcataagattttggcaattctgttcaagtttggcaattctgttcaggtttaatcataagatcttggcaatttagtcacatcttcaggctctacttctaattctaattctcctgctatttccaccacatctgcagtgacttcctccactgaagttttgagcccctcaaagtcacccatgagggttggaatcaacttcttccaaattcctgtttatgttgatattttgtcctcctcccatggatcatgaatattcttaatggcatctagaaaggtgaatcctttccagaaggtttctttttttttttgagatggagtctccctctgtcgcccaggctggagtgcagtggcgtaatctcggctcactgcaagctccgcctcctgggttcacgccagtctcctgcctcagcctcccgagtagctggaactacaggcacccgccaccacgcccggctaattttttgtacttttagtagacacagggtttcaccgtgttagccaggatggtctcgatctcctgacctcatgatccacctgcctcggcctcccaaagtgctaggattacaggtgtgagctgccacgcccagcccagaaggttttcagtggactttgccagatctctcagaggaatcactatctatggcagctccagttaagtaatgtatttcatagtaagactttaaagtcaaaattactccttcacaggctgcagaacagatgtgtcagcaggcatgaaaacaacattcatctcctgtacatctccctcagagctcttagatgaccaggtgcactgtcaatgagcggtaatattttgaaaggaatcttttttctgagcaatacgtctcaacagtgggcttaacacattcagtaaaccatgctataaacaggtgtgctggcatccagtctttgttactccatttatagagcccaggcagagcagacttggcataattcttaagggccctaagatttttggaatggtaaatgagcacgggcttcaactttaagtcaccagctgcattagcccctaacaagagagtcagactgtcctttgaagccaggcactgacttctcctctcaggttatgaaagtcctagatggcatcttcttccaacagaaagctgtttcatccacactgaaaatctgtttagtgtagccacctgcatcaattatcttagcagcttctacatcagcacatgctgcttcaccttgcacttctgtgttatggggagggcttttttccttaaacctcaagaatcaacctctgttagcttacaacttttcgtctgcagcttcttcacctttcttggccgtcacagaattgaagagagttaaggccttgctgtggattcgacttcagcataagggaatgttatggctggtttgatcttctgtccagacactaaaactttcttcatatcagcgataaggctgtttcgctttatcagttgccatgttcactgaaatagcacttttaatttccttcgagagcttttcctctgcatgcacaagttggctcttgtgcacaggtggtctggctctcaacctatctcagctttcaacacgccttcctcactaagcttaatcatttctagtttttgatgtaaagtgagaaacctgtgattcttcccttcatttgaaaacttagaggccattagagggttactaattggtctaatttcaatattgttttgtctcaggatatagtgaggcaggaggagacagagagacaggaaaggggtcaaatgatcagacagaccacacaaaacatttatcaattaagttcctcatcttatatgggtacagttcgtggtgccccaaaagaattccaatagtaacatcaaagaccactgatcacaggtcaccataacagataaactaataacaaaaaggtttgaaatattgcaagaattatcaatatttgaaacagtgacacaaaatgagcacatgctgctggaaaaatggcaccaacagacttgctcaacacgaagttgccacaaaccttcaatctgtaaaaaaaaatgcagtatctgtgaagtacaataaagcaaagcacaaaatgaggtacgatggaatactattaaatatatacatcacactgaatgagtaaacaacacacgcatcaacacagacaaatctaaaacaaatataatgttgagcaaaataagtatatcagaggcgagtacatggtatctttttttatataaaaattcaaaaacaaggaaaactaaataatgcattctttagtgatacatacataactgtaaaaactagtaatacaaacaactgatttatcacaaaatcaggattctatctcgagggcaggggaagataggatgcaatcacaaaagaatgtaataaaaataaggatactggcaatattctatttcttaaccagagtactgggtagatgaatattcacttcattattattattcaaattgtatgtatttaaatttcataatttaaatttgtaaaatgtatattctctacgtacatttcacaaatgttaaaaaatacagctagcggctgggcgcggtggctcacgcctgtaatcccagcacgttaggaggccgaggtgggtggatcacgaggtcaggagatcgagaccaccctggctaacacggtgaaaccccgtctctactaaaaatacaaaaaattagccaggcgtggtggcaggcgcctatagtcccagctactcgggaggctgaggcaggagaatagtgtgaacccgggaggcggagcttgcagtaagccgagatcgtgccattgcactccaccctgggcaacagagcgagactccgtctcaaaaaaatacagctaacatataccacatttaatatagtgaaactttaccaaaactttagtacttaccaaaggtacccatgcttcaatttcaaaactttaactttaaaaaaaaaaaaaaatctacctatactcattgaaggtttcccatctgtgacaggtttagagtaccaatgcatttaacagcagtgagccatagccctccaaattaggacccacctaaataggaagcttcactgagaattattaacaaaattcttctgccaaattgtgcagacaggaacataacaaatttaaaatatcaatctaaagtaacattacaaatattcatgcaggcagcctgaagtcctactaaaggcatgaagtgctacttattgcttacccgaaccactcctgtgtatagcaccaggtttccactgccttccaagaccagcatggtgtctattttctaaaaaaacaaaaaagacaaaaaatttatttcccaatctgagcaaattaacagattttttgactgaaaaatctgttgaagcgtaattgtcaacttctcaaatgtgcctacattacctccactggtgctgcatcctttgctggtatgttggtcactgaaccaaagatgagctgggttttatcattactctcttgaaactttacacagctaaataataaaataaaaaagaaacttgatacatgcaacaacctgtatgggtattaaaagtattatactgaacagaaaaagacaatctcagaagtttacatactgtatgagcccatttatataacattcacaaatgccaaattatcaagatggagaattagtggttaccaggatcagtgggtaatggtgtatgtgactataaggagttaacgtaagacagataaagatgttttgtatcttgattgtggtggtatttacacacatctacatatgtgaaaaaactgcatagaaccatacatacacataaatgagtacatgtcaaattgatgaaatttgaaataaagtgtgtacatcatctatctcctggttatgataatgtattatagttatataagaggttacctgtgagggaaaaagaatgcaaggtacacaggacttgtttactcttttgtaacttcctttaatctatcgtatttcaaaatatgaaggtaaataaatgggcaaaagatctgaatagctattttacctaagaagataaatgaatggctaataacttcatgagatgatcaacatcagaatgcattagagaaaagcaaattaaagccacttcacaaccactagaaaatagctacaatcaaagagtgtgatgatatccaatcctgtcaaggataaagagacattaaccttcatattttgctggtgggaatataaaatgatacaggctatttggaaaacagtttggtgatttcttaaaaagttaaacatgaatttaccattcaacccaatgacccaatcctaggcatttactcaagaaaaataaaatcacatatgtccacatttttgctcaagacctttgttcaaatgttcatatggtcataattctcagtagtcaagaggtggaaataaaccaaaagtccgtcagctgatgaacagataagcaaaacatggtggtagatctatacaatggactattacatagcaataggtatgaaataatgatacatgttacaaaatggtggatcctaaaaacatcacgctaagtgaaagctaaacacaaaaaggtacactgtgtgtacatacattatatatatataaatgtccagaaaaattaatctataaaggcagaagcctagcatggttgcctgaggctggaaatgggaacaagactgactacaaacaagcacaaggaaatctttttatggtgatataaatcttgtaaaactgggtcatggtgatggttgtataacactgtaatttactaaaaatcatttaattatacagtaaaaacatgttaattttatgacatgtaaattatttctaaataaaactacttaagccaaaaaaaaaaggaaagaaaagaaaaagaaaaagcagtgctaagttatttatacagaaacaatgggaaagacatacacctaccgtaactggagctgggactctactaaaaagcacaggaacttttgcccacataggtcagatgtaataaacacttttgaggcttgtgaatttttctctctataatagatacattaataaagtaactgtcagcactggtccaagaatctaccacagtaactattaaaagtctttgaggccgggcgcggtggctcacacctgtaatcccaacactttgggaggccgaggcgggcagatcacgaggtcaggagatccagactatcctggctaacacggtgaaatcccgtctctactaaaaatacaaaataaattagccaggcatgatggcaggcgcctgtggtcgcagctactctggaggctgaggcgggagaatggcatgaacccaggaggcggggcttgcagtaagccaagatcacgccactgcactccagcctgggcgacagagccagactccgtctcaaaaagaaaaaaaaaaaaaaaaaaagtctttgaaaatattctgcaagaaatctaaaaactacttaggtcaagcaataatctcaaagacacaaacatttctaagaattaaacttcatgatctctaagatcctttcagttctttgattatgagctcgttacacagctttgttggggaaagctacaataaatttaacaattactgatgaacttttaaattacatactatgtaagctccctacttgtaaagtaatgcaaactaagccacctacttgtaaagtaatgcatgcaaacttgaattcctatcccgcaaagggccagatctttcataatgctatttctcctatctaccccctctccttctcagattaggcctcattcacatctctttttgaaatcgtatctctaattcccaaacccttccttctaaagtgctacagaaggccgggtgtggtggctcacgcctgtaatcccagcactttgggaggccgaggtgggcagatcacctgaggtcaggagttcaagaccagcctgaccaacatggagaaaccccgtctctactaaaaatacaaaattagccagtaatcctgtaatcccagctactcgggaggctgaggcaggataatcgattgaacctgggaggcagaggttgcggtgagccaagatcacgccattgcactccagcccgggcaacaagagcgaaactctatctcaataaataaataaataaataaataaatagtgctacagaagacccataaatctaaaaaataagaatctataatatattcaacttacaaataagttatttaaagaaaaatgatttataattgtaggatacttttgatatatgagaaacaaaccagacagactacttcaacattgtatccacatctttactttcttcagactacctattccccatttcattctctctaagattatgcatttgccttccatttcagataaaacgaggctctaaggcttgagctcaacctcctgccttacatatctgatcaaccttcacttctttatcccaatctcaccacttatgcacctttctggttacttgttccatcaatcatttcctctgttctgtattttcaatactttcccttgagtatagtccgtatagcctactacttcacattaaaagtcttaaaatacaaaatggactcaacattagagtatataaaagaccttctcaattcgactggatataaaacttgtattgtggttaggttagaaaatactgggggccaggcacagtggctcacacctgtaatcccattactttgggaggcagaggcaagcaggttgcttgagcccaggagtttgagaccagcctgggcatcacggcaaaatcctttctctgcaaaaattacaaaaaattagtcaggcgtggcggtgtgtgcttatagtcccagctatctgggaggctgaggttggggaatcacctgagcccagaaggccaaggctgcagtgagctgtgattgagtcactcactgtactccaacctgggtgacagagtgagaccctgtttcaaaaaaaaagaaaaagaaaatactggggcaagatgtcatgaaaactaattttattatagttcagcaaaaacaaaactctccttgaccaagactccctctaattttgtatcttcattcctattcaaaggcaaactccttaaagagtctgtatgcctatgttcatttcctcagtccccatttactttttctaccccactttcccccgccaccctcccagcttaaaatgctctggccaaggtcaccaaggaacccactgccacccaggtacctcctctctgggttcaactctcagggccacacttcaccagtacctggcaatactggcatctctgtattcttgaaatgttcttttttgtattctgtatttcctgctgcttctcccatctgacctcttttgctttgtctctctgtgccagctttgtctctttccattccccaaatcttaagtttccaggacttcagttcctagccctcttctcattctacaccactggattttaactatttggaggccacaaatccctttgagaatctaaggaatgttaaaaccctctccttgggaaaaggcctatatactacatgtacacacaattattgaatacaataattcttcaattctaatctaattctcttacctcaatcaccacctataagctgacaattccacatttattgttctgctctttcccaaacttccgacacacttataaagtgccttcttaccgctgtcatcaaacataccagaggcctaaagggcaatcagtaatctctcaagcctcctttttttctttttcagacagtctcactctgttgcccaagctggagtgcagtagtgtgctcttggctcactgcaacctccaactcccaggttcaaatgactctctcacctcagcctccagagtagctgggactacagatgcacgccatcatgcctggctaatttttgtatttgtagtagacatggggtttcaccattttgggcaggttggtcttgaactcctgagctcaagtgatccatctgcctcagcctcccaaagtgagtgattacaggtgtgagccactgcgcctaggaagcctcctcttcattagccttttccctcccctctgcaaaaaccagagtggaagtacttgtaattccctaaatacaccacgcactcaccagaacttttgttctgatcccagctgccgtctgtggtctttctcaacttccctgcctagcgaatacctattcgtctttcaaagccctaccagcaaaagtagtccctcctgtgtcaccatccttcagctatctgcctcttttgaggacagggacagtgacttattagactgttaactagcacacacattggcatataaattaacacgtgaattattaaagagaatataaaagaagaaaggtcacccagaacagagatctaagctatgtttcccaaaaagtaaagctggcactcaactaacatgaacataaaacttaggaaacgtgctaaaaccccacatttcctcacggatggaaattaactgtttctccccagaacaaaaaacacccgaaaaatgagagattattactataaaggaagaaatatcagatgacaaaataatatttttatgatgactttttttttttgagatagtctcactctgtcacccaggctggagtgcagtggcacgatctcagctcactgcaagctcagcctcctgggttcaagcaattctgcctcagccacctgagtagctgggattacaagtatgcaccaccacacccagttaatttttgtatttttagtagagacagggtttcacaatgttggccaggctggtctcgaactcctaggctcaagtgatctaccagcttcagcctcccaaagtgctgggattacaggcatgaaccaccacgtccagcctatgatcactttaatatcattaatatcctctactgaaactgaggtggccttaatacatatctctatatatttttacatatattaataactgatcacattaaaaggaaactttaaacaaaatgccatatatttcccaagactttcagcaacatttttctttgaatataataatatatataacaaaccttatattagtaatcgtttctgtccacaaatggtcaatacacagttcaggaacaattggctccgtttctggtgcaagaaaggagccattagaattactatttggagaatgagaaatactatgtctctttggagactgattatggcttgaaatgttgaacctttgcacccctgaaaaagagtgcactcctaacgcaggagaatgagcacgactgcaaaataaacagaggagagagtacatcacagttagcaaggcaggcttatatgacacacactccaatgacacttccaaaaattccacagacagaagagcattcatggcataatccaggtcagaaattaaaatttttcaaaaaggagtagctatttaaatggttcatgtcaatgtgctttactatattctaaagatttagaattattattagaagaactcatcttttacaactaaaacttagatcatcttctttttcggaaaatgaatgattattcaaaaagctctaaactatgtccctgtatagtcagacatatatatttatcaacaaaacaatgtccctgtagcaccagatatacatatctggtcatttaaatatatatctatatagagaaatagatacatttacatatcaaataacaagtaaaaaaaaaagaaaaactaacataaattaaggcaaaaataaaatagtgccacagtattttgggaattaatattcatcaaactgttgcccacatagtggtagaaatgaggcaactaaccttaggtcaagcataggcagcttcaaaatatgactcaggaaagaatgtgacatggtaaacttagaaatcttagtaaaagtggctcagggctgagcacggtggctcacgcctgtaatccccgcactttgggaggccaaggcaggcagatcacaaggtcaggagatcgagaccatcctggctaacacggtgaaaccccatctctactaaaaatacaaaaaaaaaaaaaactcagccaggcatggtggcaggcgcctgtagtcccagctggaggctgaggcaggagaatggcatgaacccgggaggcagagtttgcagtgagtcaagattgcgccactgcacaccagcctgggtgacacagcaagactccgtctcaaaaaaaaaaaaaaaaaaaaaggctcaattgggataatggctatttcccctaaaaaacatctcccctaaatatatttcccctaaaaacagctgtcaacagaaattctaaatccttcaaaacaaaacagaaagcttagaaagaaaaaccaggaaacccttataccttagagctgccatgttggaaatagaaggtgagcgagaatgtagactgggtgatgaggttgagcgactctggctgtgaatggaggagtaattctggaaaggtgaagtcacaggggaatctcctttggagaggcttctgagatgtgctgtgagggagctgctagtggccacattctgtggggttcccccctgttcagagaactttaaaacaacattctcttccttaagtc

SEQ ID NO: 356 - DNA, 74694 bp, Homo sapiens
tgatacacttttaagataaagtttcatagacttttaaaaatattctcttggtaaagggtctattaaaattttccttaaattactttattgttgctcaaatttagtatagcaaacaggcaaattaatctaaagtcccagagtttttctaaaaaatattttgaaataaagatggtgtaggacatcacataaaaccacttctaaaactattgagtataaatacttttcttacacacaaacatgcacacacatatacccaaatctctttccctgtcttttaaaataattggagtattaaataaggacttataattcattatatatgcttatatatttaatggattagaaagaagagatttcaaaatttaagcaaagagatacatctattttggcatgtgcatggaataagccattttctttgtacccttttgataaaccaaaattcaaagataaatattaagatactaatgttagaaattttgggtagaaacataatggtgtagctatgctaagtttaaatgttgttacagagtatatatgaccatttaaaaaccaaaaatcactagaaaagcagtagcagaatggtagaaaaatcaattcgatacgaaagaagagcgaggagagtcatacagtttggaacaatgaaagatgggattaagagacacggagaggctcattttgaaaggaaaaaattttcaaaaatcatagaataaaataaataagaattttcatagtaatatttctttgaccattattaattctaaacaattaaagaaagacaattccacaaaacatgttgagaggaaatacacacctttctgatcaactttactttttgtacttctgaaaaggtgagttccaatggtaagctcagtcttaaagaagaggggaaaattagcctacacagacactgtagccattgatcaaggtcacacacactacagctaaatatatacaggggtataccatattcacagaatggaagacaatactgtaacagattctaatctccttaacacagacacatacaatcaaggcaattctgatcaatattttatcagattatttagtatggaacagattccaatatttatatgaaaatgcaaggagccaagagaaaaacacacttttgaagaagaaaaccgagtttgaaggatttactcaactggataacaagactcataagacaatggagtattggtgcaagtacagaaaaacagaccagcaaaacctaatagcccagaaataaacacaggtgtataggcacttaacttatataatagaggtggtactgcagagcagtggagaaggataaacttttcaatagcagcgggaaaaaaacatggagaaaaatccgtgccaggtagattttagattcaaatgtgaatggaaaagctaaaaacttctagaagataagataggagaatatctccttttctctgggtaagaaaatatttcataaacaacacaaagaagtaaaaactataaaagaagaacattaataattgtgtcatcaaaagacaccactgagagagagtgaaaaggcaaacaagccctagggtggcaaagatagctgcaacaaacaaagctgaccaagggcttaggacatagtttaaagaatccacagtaatcaatacaaagctaaaccaatgtggagcagtcaacctcatcaaaacagaaagtagaatggtggctgccagaggctggtgggaggggcaaacagggagttgttcaatggctatagaatgtcagttttgcaagatgaaaaatttctggagattggttgcacggcagtgtgaatataattaacactacttaattgcatacttaaaaattgataagttttatgttatgtgtattttaccacaaataaaaattttaaaatagataaatataaaaactgggtagcaagagatttggacatcacaaaagaggttttgcagttggctattaaaagtgtaaaatggtactcaagaacattattcagaaatacagaaattaaagccacaatgagatcctgttatatacctactagttggctaaaactaaaaagactactaaaaagactataccaataacaagggttgacaaggatatggaacaactggaacttcacatcctgcccatgagtatgtaaaatggtacaagtgcactgcagcactgatggtattattcactgaaagtgaatacacacgtacaacctatgacccaattccacacagttctatatacaacaaaatcgaagacatgtacaactttccctaacagcactgttcataacagccccaaactagaagcaagaagcatatccatcaatgggggagatcaataaaatgtggtagtcatacaatgaaagtgtaatacaacactgaaacttgaataatccattgctacatacaacatgaatcttacaaacataatgttgagcaaaagtaaagtgcaaaaggatacatcgtgtataattcaatttaaatgtcaaaaacaggcaaaatcaacgtaaggtgttagaagaccagatagggctatctttggggaaaggaagataatagtgattgagaggggtgcatggcagaagcagagacgggtgctgtgagttgaaagtgctatacagaatcttgatctacatgataacaaagagatttttctgtggtagatagctctttgacctgtgcacctatgatttatacacttttctgtacatggtttttggttcatctaaagccagggcagtcttataaaggatgtagtcaggaatggcacatgttggaaaaagatcaagaaagctgaaaactaagaaaatgtcacaggatctggtaaacgattttgtttgtgacctttctgagaaagtagcttagtggaatggtaaaatttttaaccaggtgggcacaagcagtgatgcactgaagaaccgagcacagactattctgagaaatacagtgatgctcagtgtgtcagagaggatggtaattctactgagtagaccataagttgacggttaaactacaaagaagcccatcaagtcgaataatgctgctagttaagctaagagctagtcagaatttaaatttttcatgttatcttcaagatcaacgtaagtcacccttatagatctcaccaatgagatcttttcattggaaaaatacatattcacttaccttcctcctcccaaaaatagaagtccaagggccatgtggtgggctaagtgaaaaccatagttcatttcaccacccgttttcatgtgtaagaagcgacaaagctgcaaaacctttaggtttcctgagccagccatgaccatggcgagagacagcagcaccacgctcagacaagtttctaggttatgaggacctgtctgtcaggtgaagagatgacatcactgtaactgttgtgttacatttctttattatcagaactagcttagccatcattagaagactacaaaagtttgtaacttaaaaaaaaatctgggctgggcactgtggctcacgcctgtaatcccagcactttgggaggccaaggcgggcggatcacgaggtcaggagatcgagaccatcccggctaacatggtgaaaccccgtctctactaaaaaatacaaaaagttagccgggcgtggtggcgggcgcctgtggtcccagctgctcgggaggctgaggcagaagaatggcgtgaacccggggtgcggagctcgcagtgagccgagatcgcgccactgcactccagcctgggagacagagcgagacgctgtctcagagaaaaaaaaaatctgtaaatacaaatattttccctgattatgaaatataagttcaacagagataatttcaaatattgaatatcaagacataacaatcacttggaatgtcacacccaaagataactggtgttaacgttttggctttttctctgaatttttcctttacctacacatattttttccaaatgaaatggagatgttactctacacaatatttttaaccttttaaatgacctattacaagcaagcttcactcacaaaaaaaagttgtttcttttttgttgttgttgttttttttggagacagggtctctcactctgtcacccaggctgaagtgcagtgatgcaacagcctcaacctcctggggtcaaaggatccacccacctcagcctcccaagttgctgggactacatgtgtgtgtcaccacacctggctaattttttattttttgtagagatggggtctccctatgttgcccaggctgatctcaacctcctgggctcaaatgatcctcctgcttcagtctcccaaagttgctaggattataggcatgagccactgcacccagccacaaaaaattcttgtataacgtgattttggtagctccactgtgtaagaatatataaataaaccataatcaaatttaattaactacttttagacttttttgatgtttctaacttttccatattataaatagtgttgcataaatccatgtagcttttaccaggaaataaaatctctcagtcttgtcatcagagaagcaatgcctcaaaagcaactgaatccttactaagtactaatattttttaaaaaggaaattcccaatatttaatactgagacagaattacatgaggtatgacaacccgtgaatattatggccttttttattctcttgtcacaagaactagatacctgtgcatccttccagggtaatcatattctcacctaagttaatatcgcaaaacaaaaataaaaagatgagctaatggttcttcagatctctcattctacatttaaaaaaacagcagagatatctgataacacataagtaactggatcatcagtaaatttttttcaagtttaattttattcccaaggagaatgataaaaagacttacaacagaagcattaggtgcggacaaataagtcataaaatctttggcaaatttatgctagaaaaacaaaagaaaaaattccaagttataagaagcatcttaaagctttgttaaaacaaacaaaaaaaaagaacacagtaaactaaaatacttcttaccaaacagttaaatgctgataagttttctgagccagcaaatcgaaaacccagagacaagcaggctcctgcaattatgtagacatgtgcttggctgaaaacaggtgacaagaaatttaataatcattattttactttaaaattaacttgaaataagtaacaataaatattccagttctctaagctagtttatatctttctgggaatgatgaagtgccctcagtcagcagatttctatgtatttttttttcagcagaagcatcgggtcaccttactcatgaagtttgccccttgcctacagtttcatatgcagcaaaaacaatttttaaaattgttgccaatttctttaatggaaaggataaaagacaaatacatacaagttaaatctccaatattgctttttgagggcaagagctctatacttcagagagctttaaccaacgtcatgaacatctgataaataatggttagaaatatgtgggattcataattacttaaatcaaggacaatattactcccacatggtatatttcaatttaattatctgatagacgctaggatagctaatttgcattatacatcacttacgacaaagtttccaaattcaaatcctctgagcacggcaattcgatttcactgagagagatactattttctcttataatctgtcaatatagaaagcaagaatacttagatatcaatgttctcattacaaatatttaataatctgaagaataacatactgcttatcatggctatatttatataaagtaagctttaccaaaccatttcactcaaaagcctatattttaatctcattgaatgtaatcaaatttcaaatctaagatgggctaagtaagaataataattaagggcaggcatggtggctcacgactgtaatcccagcactttggaaggccaaggcaggtggatcacgaggtcaggagttcgagaccagcctgaccaacatggtgaaaccccatctctattaaaaatacaaaaattagctgggcgtggtggcgcacgcctgtaatcccagctacttaggaggctgaggcagtagaatcacttgaatctgggaggtgcaggatgcagtgagccaagatcacgccactgcactccagcctgggtgatagagtgagactccatctcaaaaaaaaaaataataataataataattaaatagggctgaacaaatataaacaggaagacgtaagtatattctaaatcagtaacagggtcataatattgcataccagtcaactgaaatacaaagatgatggctttagaattggggcaggggtgaggggaagaagtgggaaaagagaaataggagacaactctaatcagacttcttctttacgggatgtttccagcattaatccaacatacctaccacaggtgaggttattcactaggctaagataagctaaactgtcaatatgtttatcagctatgttacaactattgtttagaaaagacatccttttccttttagtataggtaatgaacaatttaccgaaaaacatacacagaatatctagctgtaataaccaagaagacatttgatccttttctcctaaaagaaaaaagccaaaaaagataaagctaatgtttgctaaacatatgaatgtatttaagatttattcttttaatcttctgagaagatttcttagaagatttcttaacatttcaggatgttttcttcaataaaacaataaatattggccgaacacagtggcttacacgcctgtaatcccagcactttgggaggccaaggcaggcggatcacttgaagcctggagttcgagaccagcctggccaacatggtgaaacccgtatctactgaaaaacaaaaaattagctgggcctgtaatcccagctactcaggaggctgaggcacgagaatcacttgagcccgctaagtggaggttgcagtgagccaagatcgcaccactgcactccagcctgggcaacagggcaaaaccctgtctcagtctcaaaaataaaataaaataaaataaataaatattagaaggcacttataatacagtcttcttatgtactgaatatcaccaaatcaaagacttaaaatatctttcctctttttttttgccttgagacagggtctccctctgtcacccaggttggagtgcagtggtgcgatcacggctcattgcagccctacctcccggactcaagcaatcctcccatctcagcttcccaagtggctaggactacaggtgcacaccaccatgcttggctaatttttgtatttttctgtagagatgggatctcactatgatgcccaggctggtgttgaactcctgggcttaagcaatccaccctccttggcctcccaaagcgctaggattataggcgtgagtaaccgcaccctgtatgtaaagctttttatgaaagaaaaagtgctatgaagatgctagttgttattttacatatgccctaagttcaaacagacaagcagtttacaaagtgacctttaaaaaaaaaatcctccttttaacgctaggttgctcactacaaggaaccctgctccagaatcaatgtagctccagatgagaacccagagaaaagtggaagctgataggaaatatcaatcaggagaactgtgaaattgttatctctcctatttgcagtatccctgatgtaataaagaccaaatataacattataaagtctgaagtaaaaaagagagagatgttattctatactaaaagtccaaaaaccatattttcataaaaacaaaaaacgaccactgttttttgtgtttttttgtttgtttgtttgttttttgtagagacagggtttcaccacactggccaggctggtctcgaactctgacctcgagtgatgtgcccaccttggcttcccaaagtgctgggattacaggcacgagtcaccacaccaggccgcaaaaaagaccactctctgacatgaatttatactttccactttggaattacagttacttgtacacatgtttaatctcagtaagctgaacttagtgcatttaataaactaaagttttttgagaacactctatatgtctgatgtatctttaatgtattacagagtttagcacgtgccttgcatttacagaggattaatgagtatgtgctgaatgaaggagtgaaagaaaaagtatttcatcctacaatatacatttcaaagagcactttcaaaaaaactaaaatctctgacatctgaatatgctagagttaaaattatggtaacaaatgagcgagtcatttaaaacaattcttcctcacctctttcatatcagtgattaacaaaactggaagaactaaacaaataaaaacaaacctaggagttctacttcctcaaataatagatgaataaattcctatcagatcaactcatacaacaagtataaaccctagacaaaatataaaatccaaactatctatggcaggggtcggtaaactatttctaaaagggtcaaatagtaaataccagcaactactgatctatgcatttgtaacaaaaaacagctacagacaataagtaaacaaatgggcatggccatattccaataaaattttctttctaaaaatcaggtgggcttaattcaccaactcctgacctcaagacactggaggacaaaagcaagcagattctagaggggagagtcgatccatggaagagaggaacaccactagatacattttcctttctgcggtttctgctctgaaagcaggtctatctgcgccaagaaagatggcaaaagctacaattaaaagctcataaccttcttggccttaacaaccaggatacaggaaaataccacacccattgggaggtgaggacagaatatgacaaaggagagagccacagagacagggccccaagctctgtatataaattctgtgcaaatgtctgcctgatccatgaaccatgtgtgcacagggcagactccaacagcccacaggataaagacgtgcaccaagattagagctagcaaccaagaaagaatgacaatctgattccaagtaaattaaccggttgctttaaaacaaaatgtatatacctgtgtttaccgtgcttgaactacaaacaacgtggtttaggctaacacacattctcctgagaatctggaacttgggtacatacaaggcagagggtaccttacctacatgtcaggtcccaattaaaaacttgggtgctgagtctctgatgagcttccctggtagacaacctcaacatgtacctcatatcatatacaaaattactttgaaatgaattatgtaagtatacacaaaactaaaactttggaagcttttagagaaaagcagaaaagattatcttcatgatggggttagacaaatggtttttttcataggaatagagaataaccataagaaaaaactgacaaatcagacattatttaacattctaatatcttctgctcattaaaattattactaagaaaatgaatatgcaagccacagagtgggagggatatttgcaaaagaaatctgacaggccaggcgtggtggctcacgcctgtaatcccagcacttcgggaggccgaggcgggcagatcacgaggtcaggagatcgagaccatcttggctaacacagtgaaaccccgtctctactaaaaatacaaaaaattagcagggcatggtggcgggtgcctgtagtcccagctactcgggaggctgaggcaggagaatggcgtgaacctgggaggcggagcttgcagtgagccgagatcacaccactgcactccagcctgggcgacagagcaagactccatctcaaaaaaaaaaaaagaaatctgacaaagaacgggtttctagaatgcattaaaaaaactccagcaacgcagtaataaaaatacaaatttttttaaaaaataagcaaaagacatgcacagacacttcacaaaaaaagatagatggaggaccaataaaccaatgaaaaagttctcaacattaacagtcagcagagaaatgcaaatttaaacaacagtcagatatcattacgtattcatcagcagcactaaaacttaaaaaactaacaccattaattatcggttagatgggcaacagccaacactctcaaacactgttggtcaatgtgtcaaatggtacagctgctttgggaaaagatttatcatttctaataaaactaaatataccatctaccctatgcctcagtaattccagccctacctaataggattgcaaatggaatacacaagttgaggatccctaatccgaaaatccaaaatccaaaatgctcaaaatccaaacctttttgaacattaacatgatgcccaaaggaaatgctcattgaagtatttcagatgtcagagtttcagatgagggatgctcaaccagtaagtataatttcgagtattccaaaatccaaaaacgcttctggtcccaagcatttcagataagaaatactcaatctgtaccacctaataataaaaaggatgaactattaatatactcaatatcttgaaaacgctgaaagaagtcttatacaaaagggtatatgccatatgtggcttcattaatataaagttctacatctggaaattaacatattttgggagataaacaaaatacatattggttacctgggggtacaggtgaatgcacaaagagggaaggggcacaagggatagaggctggtttccacaggtctatgtgttagtcaaatcttatccaatagggtacttaacatttgtgcatttcacgatatataaattttatcttaaaaggaaaaaatgtaaataccaattccagttaatacatatggtacaattttgggatggagtgtattactgtttggaactaacattgaaattcatcaaaaaatgttggattagatagaggaatagataagtggatagataagtgatgaaacatgtttatacagtaaaatattattatagagtctattggtgatgtgggtgttcatattaacttctttcaatctttgagatttttcttctgaaaatactgaaagaaacaatctacataaagaaactgagaccactagacatggacagttgtctaagggcagtggctagttacaatattcggttttcagtttttaccaaaaaaatctgttcatttttaactagtatacttggcttatcgaataaatatgatataaagtaattaaaagttattaggagatctaaaattgtcacgaagtaaaatagcatcttagaaatgtgcacttaattatgacaaaaatatcaacacttttttagagtattctggcaaacatatttagttttttcctttcattttttaactcccacgcaacaccgatattcatatttaatttttaaaaactacaatttctagggacctgaggctaaaagagaaggcggtggtctgtgcagcacagaatcttaaaatggaagttcttaggtctttaagaggtatcctaatgatcaatattgccttcataagaaaaaatattttacagaattttgaaaaatcccataagaaatcataattttatgctactaaagatataatatttattatatgtacttacttgaggaacattgctgtcaacccacttggaatttggtaaaatatcatcccacaaaatcaggcatcgagcaagtgtcttaaaaatgcaacagagataaaattaattagagcaagtaaagttcatacattttataacaatgataataataaacagaacaatttaagaatcagttcccaactgttgagaattttgaaaaataagtatatgcaaatgcaggaaggttatgtactgataaacctattgtaagttgaaaataccttaagctgaaaatacacttaggccaggctcagtggctcatgtctataatcccagcactttgggagaccaaggcgggcagatcactgaagcccaggagtttgagaccagcctggccaacatggtgaaaccccatctctactaaaaatacaaaaattagccaggcatggtggcacacgcctgtagtcctagctactcaggaggctgaggaacaagaatagcttgaacccaggaggcaaaggttgcagtgagccaagatggtgtcactgcactccagcctgggccacagagtgagactccatctcataaaaaaaaaaaaaagaaaaagaaaatacatttaatacaccttgcctgccaaacaacacagcttggcctagcctaccttaaacatgctccaaacactcaaattagcctataattgagtgaaattctctgtcagcatagtaaactgtagagtatgggtcatttaccctcatgactgcatggctgactgggagctgcagcttgctgccattacccaacaccatgagagcatcatactgccaggagtacaagaaaaaaattaaaattaaaattggaagtagtttcttctgaatgagtaccgctttcacactatggttaagttaaaaatcctaagttgggaaccgtcttactcattaaactactcattaaaataaagatttaaattttaacaaagaaaaactaaaattgagttgaatatcaccaaagtttagagggcttgtgcgggtactttttaaaatgtactctggaaaagaaaaaaatcacaaaggaaagaatcatagctctatctacacataatttaaaagcttctatatgctaagtttaaacatcagaaaaaaaagaattagagggaaaattttagacaattaagtgaattgttactttctttagattcaaccttaacagtattatcacatccctgatagtaatccaaaaatgtaaaacaaagcagtaaaaaagtcctaatcacttgttgctttttaggaagttttgaataataatgtgagacagtgaaatgtcactccaagtattaaatatcaacgtggttacctttcttgggattcccaaagtcctatttgtgaaatttcaaatgaacactgccaattagatatgcatgacaaattaaaaataaaaggctctcttgtaaagacatttatgtttgccattcattcattcatggagaacagcctgtgttgcccaggctggtctcaaactcctggactcaagcaatcctcctgcctcaaccttctgaagtgctgggattacaggcgtaagccactgtgcccggcttacaagctaagtttaagaaccacaaatagacttctcatgttaacacaaatgaagacaaagcataccctaagcaagagaaattctggcttcacaaagtccaacaaatacatggtgtcaggggctcggagccaatctgcaatagatctggtggtggaggaaaacagtaaggcacactgttcaagtagagggcaagacaatcaagaatctcaagctctatttcaaaacatttcttcccgctccactacagctctacatatttttcacaatacttcacaccttctaatgtaatagttattatagatgtacatgtatgtcttactataacataaactccatgagggaagatatttttagttttgctcaatgaaatatccccagtgccaaggaagcactgccctacacattcatccaaatagtaaagtaataaatatctatttttaaacactttgttaattctgcacacatttactttttctaaagggagaaatgtggaacactgaaaactccttgaatcttagaatttgtttttaattaatagactaaagacatggcataacgtcttgtactcaacttattcctcatgcaaagtgtaagcataaatgccaaagatcttactttcaagcatcagcattaatatagcaagttaggaaggcagacggtttggtaattacaaaagctcctgaagtaggcaaaaaccattgttttacatggtaaccaagatcacactaaatgataagtatttctggcttaaccagtcctcacagcaatatgctaaattaatgaaaacaaacatgggcattgcttgggtgttactgacatcaactacaaaacagaaatgaacagaaattgaaaactatattgtcaaataccattaaaatagccaaatacattatttccaggtaaaatctttataacttcaaatactgcaagttttctttcaaaaacttacagtacttgaaagaacaaaaaatcagcttaatccagcacaggggaaagaaacacatgagataactgaattttacaaccaaggtcagggaggatatcacactatcaccgcgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaattattataaaattcctctgaataataactatgcttaaaattaacacatttaccaatgtcagtatgaacactagtattttccaattaacttcccagcttccagacttttgatctattactttgctgtgtacttactttgatttgataacttggtgatttatgtttctccctatgcattcctgtttgaaagcgcctatgtcctccaaccatgtactgatagagctgctcaggcacattgagatcagacatacctatcaaattgctgccatgctggaaaagacaataacagacgagtgaaaagaaattttatgaaggaagatccacaacacatacccataacaaatataaaaatgaactaacttcaaagcaggttattttgggttttgttttttttatttccaatttaaagcaaacattaatcatgagttaataaatattaataattctcataaaagttttaatacatgaatgttcaactttaagtactgtcttaaaatacataagagctttagagttagttacatttaacaataaagaaaaatattagttatataattgaaactggaactgtaaatacctgaatactgtcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcacagagggattaagcccaaggttatacagctattatagttaagtcgcagggctatatataaaacacggccatctggctcaacaatccatgaagctgattaagcaatacacaataatgtagttaaatgacttgaatcactagttaggaccagaattcaagttgcaattccctgtgtgattcttttctttttttttttttttttttgagacggagtctcgccttcttgcccaggctggagtgcagtggcacgatctcgactctctgcaagctccgcctcctgggttcacaccattctcctgcctcagcatcctgagtagctgggactacaagcacccaccaccatgcccagctaatttttttgtatttttagtagagatggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctcgattcaccacaacctccgcctcctgggttcaagcgattgtcctgcctcagcctcccgagtagctgggattacaggcatgcgccaccacacctggctaattttgtatttttagtagagatggggtttctccatgttggtcaggttggtcttgaacccccaatctcaggtgatccgatcacctcggccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatcagatactgcattttgtcacaaggaagatgctactgggacaacattctgggatacacagtgaacatcactacggcaaaagggggttagggtttgtttcaagcagctactatagactcttaaggctcccgatcatatacgttttcactattctctgttttcagtcatagtgggctgtcacttattcattctatgtcttgaacgctttaaaaaaaaaaaactttattcccttcagtttgttcatgaacactgcaagctggaggaaaagaaatcttaaagtcccactcttgaccacagtttctctcaatttgcaaatctggtactttgaaaaatatccaaaaagacaatagagctgggcagcagattaagtcatagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactctctgtcagtgcagtattccatttcaggaccaggaggccgtcctgtaaaaacaaaagcaacacagttcaaactagcttctcaaaatctcatctcataaaaatcttagagttaactttctagcaagttgcactggacatacgaatggaatataactccattcagaaagttatgacactataataaatggtgtccacaactgtaggtttacctaccaaaaaaaagggcccaaaatagttctttttaaattgccaatttaagtctttataagcaatgatattcaaatactgtgaaactttgagtcttaccaaaaaaattaccaagtagtagaaaaaaattttaaagggaaaaaggtaagagtattcaaaaaaaaagttttatttttttgttaaaacatctgggccgggtgtgctggctcatgcctgtaatcccagcattttgggaggccgaggcaggtggatcacttgacgtcaggagttggagaccagatggccaacatggtgaaaccctgtctctactaaaaatacaaaaactagccagggtgccaggtgcctgtaatatcagctactggggaggctgaggcaggaaaatcgcttgaacctgggaggcagaggttgcagtgagccaaaatcaggtcgctgcactccagcctgggtgacagagtgagacaccatctcagcaacaacaacaacgaaatatcttacattttgttttcattactttcaaatccacacatcacatgtggtgaaacatgttcgaatgatgataatgaataaggaggtcacttacttatgttgttaagctgttaaatattatgtttagacatttatttcgagtgtatataataatgagccctactatggtagaatttctgtgtactgatcctagaagtctgactggatacaaaattcatacttttaaaaggcaccctataactctaacactaccgtgttgaaaacgataaaatgtactatgtattaaaacccttccctctgaaaaaatgttcacattcctgaaattttatccctataggaaaaaaatgcaatttaaaaaaaaagaaaaaaggctggacgtgctggcccttgcctgtaatcccagcactttgggaggccaaggcaggaggatcacttgaggtcaacgagttcgagaccagcctgtccgacatggagaaatcccatctctactaaaactacaaaaattagccaggcatgctgacagacacccgtaatcccagctacttggtaggctgaggcaggagaattgcttgaacctgggaggcagaggctgcagtgaaccgagatcgccccactccactccagcctgggtgacagagcgagactctgtctctaaataaataaataaataataaaaattaaagaaaaaaatcacacaaaggtaatcagtgtaatgtttatatataacaacaaaggattattagaaacaatctaaaaagttctaaaagttaaaaaaaggcattttacagaccatcgactcaatgaatattacacaaaatttgttttaaaacccatttataacaatgatctataaaaacaatttttaggcggggcacagtggttcatgcctgcaatcccagcactttgggaggctgagacaggcggatcacaaggtcaggagatccagactatcctggctaacaccatgaaaccctgtctctactaaaaatacaaaataattagccaggcatagtggcgggcgcctgtagtcccagctactcgggaggctgaggcaggagaatggcgtgaacccgggaggcggagcttgcaatgagccaagattgcaccactgtactccaggctgggcaacagagcaagactctctcaaaaaaaaaaaaaatttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcttaggtttctatcaacaccacgagagaaacacaccctccagcctgggtcccagaatgaggcaggtgaggcagaacggcagcagaacagccggctacacatctacagcctaaagcagagctgcctgggccaatgctatgcctgtatgtatgtagcatcactgtggcaatagctatctgatacaattatactaaagaataatacatctttaacaatatattcacaaatccatatagaaaagatcttgaataggacatataagtatgtaactaaattgttgagcatattaataatgccaatagcatttccatttggcagaaaaagatgacaacacataaagatttccaaaaagtttggacccaataaaaaacagagacaatgttcactaaagtgagtgtgtggaccttaccatttccaggttcatcaccaacatacccaccagcatgtaaaggaggaaagcaggagtccattacttgacttctattggaagtgctgttatccaacacagtaaacactgtgatgtgtttagtttagtgtctctcagggaccaaaacaatctactctgagttttaagtgcaggccactggtagacactgctggtaaagcaggataaacagcatactcatagctgattaaaaccacaggtacctcattaaatgtgaccactggaattcagtaatgagctagcaaataaacatggaggttaataacctgcagttacattagccttggataacattacttagagttttgttgttttttttaattagtactagatcattctttgctcataaaagctaccattgtctttccttaatttttataattttactatcacttttaattgggttaatgtggagtggagagtacatgcctatgaagattcagcactattaatcccatacctatctcagccaacaggacttctgcagtatgtctgtgagctgtcccttgatatacaaggccaatgccaaccactgcagccacttggacattgtgaggaacatccagctctgtggacgttgggggtaagagagcaggaatgtgaatgctaagaagccgagtaatagacatatccatggtgcctagttttgcagcagaaacaccaagtagcagtccaatgcttgtcatttcatggccctaagatagaaacaaaacaaatacatagtttaaaataaaatactgcctgccactttcaagaagtacttttatgttgacaggcaaggtgagaggcactgagaatacagcagtaaactaaacaaacatggtccttgctctcatggacctaatgacttaataggaaaaaaagtgttaaattaaaaaacataaacaaatatattattaaaaagtagtacaataagaaagtacaaagtattatgaaagagtattttaaaatagcttaatttagattgggagggactagaggattattagggatgaaatctctaaagattatacaaagaaatttatattaggacctgaaggatgaaaacaaattagccaggaacagtggcaggaaagaggacactcaagtttagaaggtgaggaagactgtttcaggtgataaaacagcatgtaaataaatggctctgaggcgattcagaaataaaccctcacattaacatcaactgaccacaagggtgccaagacaattcaacaggtaaagggcagtcttcaaaaaacagtgctgggacaagtggaaggacacattcaaaagaatgaggctggactcaacacaatataacaagtgttggcaaaaatatggagagattggaactctcatgtattgctgatggggttgtataatggtgcagtcattatggaaaacagtttacagttcctcaaaaagtttaacagagttaccatataacccagcaattccactcctaagtatgtaccactacttaccattacttcattactcttgagtaatgaaaacatacatctgcacaaaaacatgtatacaaatgttcatagcagtattattcgtaatagctaaaaagtacaaataacccaaatattcatcaacttatgaataaaatgtacattcataaaataaaacatttattcaacaataaaaaggaatgtattgctgatagatggtacaacatggatgaaccctaaaattatcaggctaagtgaaagaagcccatcctaaaataccatattttatatgactccgttcacatgaaaggtccagaaaaggcaaacccatagacacggaaagtagattagtggttggcaggaagtgaagtgaaggtgggggggggtgaggtagaggaatggggagtcaccactagtgggtacaaggttcctttatggggtgaaaagatgttctaaaattaacagtggtgatggatgtacaactctgtgaatacactaaaaaccactgtaccacatactttaaacagtgaattgtatggtatgtgaattttatatatttatataaataaagattccttaaaaaaaaataacgctgtgaagtgaaagagtttagtttgccagagagctaaaatagccaatctgtatggttagagtgtgggggagcaagaagagtggggctgggtgcagaggctcacgcctataatcccagcactttgggaggctgaagcgggcagatcacctgagatcaggagttcaagaccagcctggccaacatggtgaaaccctgtttccatcaaaaatacaaaaattacgcaggtgtggtagtgtgcacctgtaatcccagctactcagaaggctgaggcaggagaattgcttgaacctgggaggtagaggttgcagtgagacgagatcacaccactgcactccagcctaggtgacagggtgagactccacatcaaaaaaaaaaaaaaaaaaaaaaagaacagtggtaccaactagggctggagaagtgaacaggatcacaccagctcctagaatgtatattaagagcaatggtcgatccccctttgccctctggtgttgggaatgttggccttgttctaaaccagtttcccttcacagaagttcggccatcatgtgggatcagaataaggtcctggggcaactaaaggtatctggccaagggtacatccgaaggaccctacaccggcccccagtccccaccagcctgttcaggtgtcggacaaagacttccaatctttcctatcatgtttttcctactgctcttctgagaaatgttacttagttatgtgtctctttgagaaattgcttcttttcagggcaggatgctgggttatgcttgatgaagctaaataaactgccagccagatgagaattatagacaaataatatgcagggaccccccctggattcatcttagtcttgagctcatatagaattcagagaaatcaaaggcagttgacaaggagggtcaaggctgagtgcaagtgaacgcaactactcctgctggcttgatccccccctggtcatgaatggtggctgcgcgcacatccacgaccaaggcaagcctgagagacgccttggactctagcacagcagagggaaagactaaggatgcctttttctcccctctctctttctaaatgggtagcctgcactcctctcaagtgcgagacattgggactcctttgatcctcagactctgaagaaaaaatacctggtatttatcagtaccaaggcttggcccagctagaagttggaagatggggagacctagtcagctggggaaaataacaactataatactatcctatagctagatctcttcaaccacagagaaggaaaatggtccaaaattccatatgtataggccttttttgccctgcagaataaccgcaagctctgtcagcaatgtataatagaccttgcacttatagcagtgatatccagccagacttaatccagacagaagggaaaaaacagtctgcctccttagaagaggagacagaggcccctgcaccagcccaggtcccagctcctcttggatcatctcgtcccccttatccaggcccccttttgaacctcatcctgttagaagagttcgacctggatgcgctccagcatcacttcttcctttacaggaaatgcatagtgaatatggtcctatcaaagtacaagtccccttttctttacaagatttgaggcagataaaaagaaatctaggacaattgtgtcgaccttgataggtatattgaagcctttcagaaccttaatcaaatgtctgagctttcatggaagggtatcatgttacttctcaactagactcttagagcttcagagaagcaggcagctttacaggtcactgagacatttggagatgaaatgtttatcttattatggcacctaccaaaagggggaagaaattagggagccctttctgacagccaagcaggcagcatccaccaataatcctcaatgagactcagacactgctctaggaaagtggccgagaaaacatttttagggatgcacagtggaagatctgaaaactagaggcaaatctctcaattacattaagttatcaaccataaaccaagggtctgaagagaacccttctgttttcctggaaaaaactgagagaggctttaattaaacacccatctctctcctgactctataaaaggatagttaattttgaaagacaagtttataacccaagcagccccaaatattggaagaatgctgcaaaaagttagctattgcaccagacagtactctaaagaaaatcctgaaagtcaccaccttggtcttttataatcgggaccatgaggaagcccaagaaaaagggagaaaaggaacgagaaaaaggcagaggcactaatagctgccatacaggcatataaacctctcaatcccagggagcttctcattctatgaccggctgttatcagtgtgggagcactaaaagagagtctgcccccgaaatcagaagcagcccccacggccctgtccaatctgtaagggagactactggaagacaaactgcctccagaaacatacgtcccaaggttcagagccggcttctcaaatggtccagcaggactgatgggtcccagggctctcctccccagctctgacagcccaggctgcattaccatccaggagtcccgggtgagtctggaggtcaaaggactcagaggacagacttcctactcaacaccagagcagccattcctgttctcctctccattctgggcctcccctcctcccttagcacaactgtgagggtcgtctcaggaaagcctctgactcgatatttttctcaatcccttagctgtacctagggagacctttcgtttacctatgcctttttaatcatacctgaaagcccgactcctctgaggtagggatattttagctcacatgggaaccaccatccttatggctccattatggctccaggacagactctttgcctccctctggtggagactgatattaatccagatgtttgggcaattcaggaaaatactggctgagctacaacagtctcaccagtccaaatccatctcagggatctcatctccttccctaattaaagacaatatcccctaaaaccagaagctaggaaacaactagaagccatcattaataacctaaggatgcagggccttgttaaaccctgcgacagtccttgtaatatcctaatattggaagtacagaaagaaacccaacagggaatggagactggtccaggatctccacctcctcaatgagtaactggtgtaattaaccaatttacccagtggttcccaatccctatactttgttaacttagatacctgaaggaactaaatggtttgcattcttggaattaaaagatgctttttttctgcataccattataccccaactcccaaaacttgtttgcattcagggatccctccaaccagactacccagctaacctggatggtgttaccacagggattccaagacagcctccacctgtttgggcaggcaatctcaaaagatctctctgagttctttcaaactcaagttagtcttaatatgtagattacactctactctgtgccccaactgaggaaatttctcagaaaagcaataaggctcttcttaattttctaactgacagaggacataaagtttcaaagtccaaggctcaactccgtcagacttcagtgaagtacctatgcctggtcttgtcagaagggaccaggacactgggcgaggagagaattggatccattttctccttccttctccccaagaccctcagctaactaaagggattatcaggcattactggattctgcagcctatggatcagaaatctaattaaaagcattgcaatgcctaattataacatatctaataatctagggggacatgcccatgacaaccctattttgcaaaatcctggaatagaacagtccattttcagaggttttcttcctgtcctttctaggtgtccctaatatatgggcatggattttcccccttttagttcctctttgtgttctcattgtaatactcatatttggtccatgtgtacttaacctccttgtaaaatttgttttttctcgcctagaggccatcaaactccaagtggtcatgcaaatggaacctcggttgatggctctcttttaccaggggacacttagataggcctctaagagagacctgactgctgtttcccaaaacaacaccctctgtcagcatgaagcagaacagtcatcacccctatccgaacagcagttagatatacctcttcagagcggggattgatggcggtaggaggcaggtaaattctcagatgaaactcaaccttcaagccaaggacagtcgaaagcctgaaaaccaagctacaagttctggataaatccatggactagagagctctcattcctgtttggcatgctctctcctgattggtccttatccttcacctaccttacatatacctgcccttccccagttggtcctctacactatcgtgcctatttctaaatggtgctttttcaagcatacccacagaccaatcagcatgtacctcccccatttcaagcccataaaaacctctagactcagcctcgtggctggcaacccaccttcgggtcccctctcgctgttgagagctttcttgtcactcattaaattctactctgccttactcaaggaaaaaaaaaaaaaaaaaaaagcaatgggagatcattaattaaatggctttgaccagggaagtgacatactctgatttatgctttagaaagattattccatgtactatgagacaaatggacttagaagtacaagaatgaagaaagaagagcaaatagagcaattaggagctactacaatagccagccaaggcacaaagccaggcactgggagcacaggtctcaccttggtcaagtagtcatggatattgagagtcgccagcttggtaaggtgcccattcaaacccagagccatgagaaagccagcatactcattggccaactcagcatgcttgggcttattgtaaacaatccaagctgagtcgatctgggaggcaggagctatcttcaggccagcagccacaccattatgaaagctggcccagcttgtcatgttgggaggcacatcgatgtttccactattaaggtctactgttgtgttccgaggaggggcacgccctatccagccaaacgaagaacattgagagaataaaaatccacaaaaccaagattgttaaatttagatctttgagactaagattacttacgttttctacattcaaaaccattaaccccataatgcctggaacgttaggtctctatgaccacttaaaacttttgtacatgtgagtcaaacttaatggaactggaaaaaccttcactgtctaaacagttcattgtcctttttgttaaaatgtatgaggctatataatgagataactgataccaatttaacattatacagagatgactgggataatcactcattttttctttcaaacagagagcttaaaaaccaaaatgaagactaacatcactgttaaactatacaagttataaatcccaacatctgatgacactgatgttaatttcaaatgttctatcctatattttcccctagacattaaggaaaaatgacatcttaagaaaagacaaaagccaggcctggtggtgcgtgcctgtcccagctacttgggaggctaaggcatgagaatcacttgaacctgggaggcagaggttgcagtgagccaagatcatgccattgcactcccacctgggcagcagacagagactgcatctcaaaaaagaaaaaaaaaaaaggaaacaagaaccttaataaatctgctacaggtcttacctatatatgcccccttctctctctttttttctctctctctctatatatacatacagatatagatatctaattatatgctatcgtttaaaatgcttagagatagttttgtaaaaagcatccttttatagacttgagtcacccagtgaacttcaaaagggcattcaccagattatacttttacggtccatttatttaagaacaatgtaaattatatgttcacaatgctatatgttccctacgaattttttcttgattcttttctttttgatctacattatacacagcaaacattgaatctttttaaatatattttgaatattgtcttaagtcacggataaaataattaacataaatattttaattactgcataaagttatccatttcactgcagctttaaaaataccatttttaaagagttctaagatgttatgtaaaataaattttaagtagatgcagtgtcttatttgtagcatgtacacatacacacacaaagcacaaagtaagacttatttgtctttactatatgctttttgtacctaaaagctaactcaactgctagtgttagcaccacaatgagtaataagttcataagttacacttgtactttctcaaaaaaggcagacatatcaatatgaaaaaactgagtgacctttctgaaacattcattcatcatatgcaagagacataatatttatacacgagagaaaataaaatgcaaagggtaaggtaaattttcttcaatgagaataacaacatacaaaagtacaacaggccacatcagtgtgggttaagcaactatttaagaaaatattctttcctaaattaagaggataacctttctttttggcctaccagaatgactaaaagaataaaatgttggattaatgtcataaacacattttaaatcatgcaaattcaattaaatgtattcagaaaaaaagatgcatgtatatattttttaaacccacccaagtatcacttgagtgctaaatcacccagattgaatacattttaacatttgccaattttgcattagattttctttttaatctgcacttattatatgaaatctttcatataaacagttggaaagactactaaaatgaacatctatataccatgccttccatcaagaatcaataattgttaaaattttgccataggtgctttacctctgagacaatttaaatattaaaagcaactctgctcactatgtccctcagtgagatcagggctcagaataagcatgatatggagatgggaatgtgttctttcacttagtcaatctcatttcctgcatgctgctcaaagcacaagcttttcacaaatctgagtggaactctggattttttaaagtatgcaatttaaaatactgtataattatgtttgcatatattatgtactatttatcatatattaaattatacattatatgctaccacatatactatacactcctacaacatacattatacattttgtataggtttcacaaaaccatatatactataatagagtttcagtgataatttcaactatgtaattgtcacctttagaacacattcaaatcagcattagggggacatgcactataaaattcattgtaatcaagactataactacagttatatatggcagaaataaaaacttgtgccagccagaaaggcaatttgacatgttccttaaaaccattcatcttgctgtcctaagagttctacttctaagcatttagcctaaatacacaggacgaatacgccccaacaatgtttataataccaaaaaactgtaatttccaacaataccaggctgcttctataaactatggtatatccgctgaatgaaatactctgaagcaaataaaaatgaatgtattgattaaaaacacgtgtatacaatacatacacataattataaacacatacatttatttgctagatataaaaggatgttcactgtaaatttttaaaaaaatctaaaatagatataaattttctgataattaaacaaatataaaattataaatatgtggaaataaacttagtaaacatatatactaaaatgttaaaaggagtgatgcagaagagtgggagtactgcaagcgaccattgtttctctttttgcttagtacatttcttgatttatacaatgatcatctgtttaaactatgacgtaagacattttaaaactaaatatttttacatattaaacttaagattatttaaaattcaagtctcatcgttatcaataatatctttctgaacttctccaagtgactttttagatcttaaaatcacctcattaaaaagcaaaaatgagtaatgaactatattctgcttctctcaaagtttagtttcacatggcatttgagctttgataaccactacagcagctattaggaaaattttaaatcactggggatagagggagcatttcttttgttttaactaatttaaagaactacacttaatgcatgtacttaatcattttcctttctcattgagcccagaatttaacataccagtcagattcaatttaggaataggcaatggctctgttggaacaggatggtacgaaaacaaggtaaacattcctcgtcctacaggaagagccatagttcgctgacacaattggagcaatctgtaattaaagtaaaaaccaacatatgaaaatgtttaaagcaaagagcaattgaaatatcatctgtaagtatttcaaaagaaggtgtactgtataagatgaagttgtctcaaagtaaattcatacacagatgtgagtgaactacccaaacatgattattttcattttaatattcttgttcctattacactcttagggagagacatatttcctctgttttgtttcatatttacattgaatgaaaaccacctggcctataaacccagccgactctctctaggcattcaaaaaaaaaaagaaatttaaaattccactccgatggatgctaaccttctcaaaggaaaatacagtacttttggggtttttatcactgtgttaatttcagtctagctgtcctcagtacatgtgggatcctcctcccatcccttttgccaatacagcctcagaagtaccatttctgtggcctgtacacaagaaaagaaacaaggtccttgtgttagaggtgaatggatttcatggtgtctccaagggaaatacagattggtttcacttacatgatggctagatttataggactaataccattatgtatcaggtatgttcaaggttaaaatggtttctgttggctctactgtgaaattaatacaccactcttcaacttcttcctatgttaaaatagcttaacattccatatagccacttaaaaaaaactaacagaaattttggaagtagggcatttataactaagaaacgcctatacaagctatatctgaagacacagaaatatcccttcagaggctgacaactgacaaacattttctctgcagacaaagctattcataagcatactccctccttaactggacacacataactgcttttctagctaactggaaagaaaaattttgctgtcttaaagattctctgggaacacaaccgcaacattaatttgggatcaggaaaattcaaagccaagaggctgttgcaacccatagaatttttttagaggaaatcttacacataattcacttcaactttgcgcaagtaacaaaattataatgagaacaatattatatcccctgaatataagatgccactgataagatgtatcattatttcatgagaaactaagaaagaaaaagcactgccaattaaactatgacacctgttcactgaaatacacaactgatttcagagatattaaaaagtgaaaaaacttgcatcttagaatcaatgaactctactactaataatggctgactgcactgagctttactatgtattgagcagtattctaagtgctatgtaaaaataattcacttgatacacagcaccatcccatgaagtatgcctacttttacaaatgaagcaactgaggcaacaagaggtaaagtaatttaaccaaagtcacccagcacagcatggccatgcctggctctagaggccatgctcataaatcctatgctctaaactcaacttctgtcactccatctttttattcacaggtgactaataactgggtacatgtggagaggaaacagttaatagggaaatcacaactaattcagatcttcagcagcctgtggctaagtgtgggtgatggttcccctcaaaacagtaccataaaaaaagtaaagagaactagaaaacagtggcagatgaatgatagatgatagagacaagcagataaaagaacaggagagaattttaaaacagaagtgtcccaagagaatagctctggaatgtcataggcatgtgagtcttataatgtatcaagggatgtatcctgtgcaggggagtggcagaagaaaggcttatctatttttatttggagtatcatctatcatatccaaaaaaaaaaaatactcatacaagtttaaactacactaaaaaccccactaacctcaaaatctattcctgatcaagacacagaaaaacaagtccagtgttttctttgtttgtaaattcttaaggtaactatcaggcaaaatagttttacattcaccttttctaaagagtaaagtgttatatgtatttcaagaggaggacgatatgaaatacaacaattacgtcctcaaaagccaaagacattttgctaacacacgtggtttgttgaagttggatgaaaacttaaaacacagggcatattttcacttgaaagtatcttttaaatctctttagggttttaaatgctaaaaacttgaaggaaaaacaaatatacacaagacacaaatgtaacaatgaaacatgacaagagatagtgcacgtgttttctttcacctgttttccttttcctcgatgaactcgtggtcactgagctctgggtactgcactacgttgacacggacaggatgcgcactctgaagaagccttcgcacatcctgcacccttaaatcttcactccatattaatgacatgacctcgtgattcatgtcattcatgccgtcatcttcctcctcagtttctgttcctgaaggaacatctgatgagagcacctgagtaacagactttattgtaataataatttcaaaagcagttaacatgcacttgctgaacatgaggatatataggctgatgtgtcttgactatactagcacagagaaaatatgttttccaaagcaggcatgggttggagccgcaatgtatactgggactctaatctacaaatctttctaaaaagtactatattgctggccgggtgtggtggctcacactctgtaatcccagcactttgggaggccgaggtgggcggatcacccgaggccaggggttccagaccagcctggccaacatggtgaggatgatttaaaaagataattggagagtaatgaaataatttaactttctacttgcaggattcctagaactcatttgaaaaaaaaaacagacttgatgattgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatatttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgctcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagggatcaggaaaatgcaaattaaagctactgagaaatataaatgtcaaagccaatcaatactaaatgttggcaactatgtagagcaataataattctttttattctttttttttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttttagtagagacagggtttcaccgtattagccaggatggtctcgatctcctgacctcgtgatccacccgcctcggcctcccaaagtgctggcattacaggcatgagccaccgcgcctggcccaagcaacaataatgcttatccatagccaatggtagtgtaaactggtacaaccactttggaaaacagttggtatgtataggtcaatccacccatttgatccatcaacagccatatagaaacttatacccatgtacaaagacacaggtataaaaatattcattagcaatactggtttgttatggaaaaaaaaaaagagatggagaaaggggtgagtccgattgtctatcatcaatagaatgggtaattaaattatgatatgttcaaacaaagtaatctctatatcagagaaaatgaatggcccgctgctactgctacatgagtcgacatggatgaatctttaaaaaacaaagttgagtgaagaaaaaggaacacatatttacatctatatattttcaaaactacataagacctagcaatttataaagatgtaaaactataaagaaaaacaagagtaaggtaacacaaatgtaggtagggcagtggttcactataacattggggtgtgtgacaggaggggaccatccaagaacagatatgtaagggccttctactatgcgggtaatattctatttctaggggtgggtgaccagtacatcaatactcactttagtaccattctctaaactaaacatatacgtttgacatattattttgtaagtataccatatttcatatttaaatttatcctcaggttaattaaatcatgtttttcttatgattttctaaatttcataatactatgcattatttataatataaaaagtcgattaactattgaggcaaaaaatgtttccttatatgagaataacacttattaaatattatgcaatatacaaatggatagaactaatccaatatttttcagcataggtatcctgtatgtatactatgcaacagttattgtcatttttaaggtaaaatgcaaaaaaaaaaaaaaaaaacctgtcagaaacttcatttagaacatactttagataagacttcaaaaacatcttttaatattcattaaaactttactttttaacatacatcccatataacatcctcatttttaaaatcatgtcttcgtggcagtaatttttgtttttcagttctttgtgaaaaaaaatttctttggtattttacttaatttaaaacctaggagcataggtttggggaatagggaatatagaactcttttccttcctcttcctcttcccagttcaatgttcatcttggtgcctgaaatcccttcaaaagtgcatttatccttcaaaagtataccctgaaatgtttatattattgcttttagactttgccaaaaccacccatttctgatatctgagtatcacaatgatttcaggtgtgtatgtaggtgattagagttctccattctcagagaccagcttacatagccacagcctcaaatgttccaattaaatggcaaataaagattccttatgcatcaagataaaaagctggtatcccaaatattattatatgaaagttgtgagattgtcgagaaaaaaagaatatggcttgatgaaccataatctcaatcttgtgaggccttttcacaaagccagagcccctctctcctcatgccttccacttctagctagtctggaggaagcacggcctagttaggaggtaacaaagaagctctcacctacattagtcatccagacaaccaatctttcagctagactagaaacagatgtagaatgcctgaaactaaacctataagagaataaaacataaagttattaagcagaacagtaaataatattgttttaagtgtttgacataaaagcacagtctaaataaaagtcacctgttttcctcttgttctacttgcaacttctggggggctaaaaggcaacaaaatgaaacttaattttgatagtcatcctggtaaagaaaacatgtaacatgtagaaaacatttgaaaataagaatcaattagcaaacaacatctaaaaaaaaataaaataagcaatactgtggcaggctgaaaagtacagtcaaggccctcagaatactcaggggattggttaggacaccccatgcgtacccaaatccgtgcatgctcaagtcctgcaactggccctgcagaacctgcatatgggtttcacatcagagaatactgcattttctatctgcatttggctgaaaagaatttcattgtaagtggacccacacaactcaaactcatgttgttcaagagtcaatggtacaataatttccttcaggctaaaatagtcctttttacccgcactgaaaatacaagatgtattagattttaagtaatcctgatacctgaaaattagttgtggacaaaagaccgcaacagaccagaacagtactaaaaaggtaagacatggccgccaaagcaaacaagaaaaattcaattcttttttcaattctgatactgacatttacaaaaatttgtttccagaggcaacattgcaccaacttacctatagttattctggttaaatactgtgaggattcatcagaaaccaagctctcatcaccaagtatgtacagtgcaatactctgcaaaggaagaaaattaacattatttttctcttttcagagacagcatctcactttgtcacccaggctggagtgcagtgacacaatcacagctcactgcagcctcaaactccttggctcaagcaatcttcctgcttcagtctccagagtagctaggactataggcacacaccaccatgcccagcttattattttatattatttttattttttgtaaagacggagtctcgctgtgttgcccaggctgggctcaaactcatgacctcgagcaatccttctgcctcagcctcccaaactgctgggattataggtatgagccaccacacctagctacataattgaagtataactagaaaataattataacatagaataattcatccattttaggtgtacagctctgtgagtttcgacaaatgttgtatcacataaccactaccacactcacaatatagtatactttcatcacaccaaaaagttcccttgttccttttgtagtcaatcctttcctcctacacccagcactggaaacaattcatctgttttcttgctctacagttttgtctatcctacaatatcatgtaaatcaatcatatgatatgtagtcttttttgtgctacttctttaacttagcataagtctttgagattcattcacgtctctccaaggatcactagtttcttccttttcatgctaagtagtattccattatacagacataccaaactttgtttacctactcaaaaactgatgaacatttggttccagtttgtggtcactatgaccaaagctgctttatttatttatttattttttttttttttgagacggagtctcactatgtcgccaggctggagcgcagtggcacaatctcggctcactgcaacctccgcctcctgggttcaagcgattctcccaccttagcctccagagtggctgggattacaggcatgcgccaccacgcccagctaatttttgtatttttagtagagacagggtttcaccatgttggccaggatggtctcgatctcctgacctcgtgatccgccctcctcggcctcccaaagtgctgagattatgccaccgcacctggccccaaagacattcacatacatgcgggtctttatgtaggcatatgttttcatttatcttaagtaaatacgaaagtgtatgtttaacttcacaagaaactgccagttttgcaaagtgccatgccacttttgcagtcccaccagtaatgtatgagagtttcgattgctccatatcctcaccaaaagttattttcagtcattccaacaggtatcgaatagtgctctctcactatctaagaagtatctagtagtacagagctgtagtgttatttgctttgaagaggaaaagaaaaagataacacaaaggaaaaagtctctcaaaagagttaaaatattcaacatataacacaaacacaaaagtacataagatctctctattaaatgagaaaacatacataaagttccttgaagacaacaggctcccaataaatgttatctcacttccttcctttccctcatttcaacaaatggtacacagacaatgccatctccgcatatacaagtgactcaatagaaaaagagccaccataagctagaaggttactacaaatgtctcattagctaaacatcacataaaaaaaatttatcacttgcggtcaggagttcaagaccagcctgggcaacatggcaaaaccccatctctactaaaaatacaaaaattagccgggtgtgatggtgtgcacctgtggtcccagctactcaggaggccgaggtggaaggactgcttgagccccgggaggttgaggctgcagtgagccatgattgcaccactgcactccagcctgggtgacagagtaagaccttgtctcaaataaaaaaaataaaaaataaaaaaagtccaataaaacttataatgaggaaaccaaaaacgtatcaacaagggcttctgttgatatttttcagaatatttttataaataaaaattaaattcatatttttataaatagatctctgagctaacaagttataaaggaatacgaagaggataaaactaagatgaaaggccagagaggtaaactgagcactcatgacagttttactgaaaagacattcacagaaaaacctatagaatgggagaaaatatttgcaaatcatgtatctgacacattaatatctagagcataaaaatgcctaaacttgaaaataaaaatccaattttcaaatacacaaaagatctgcatagatctttcttcaaagaagatacgtaaatggccaataaacacaagaaaatatgctcaatatcactaaattaaggaggcaaatcaaaacaatgagatatcacttcataaatactaggatggctataatttttaaaaaaacaaatagaaaataataatatgtgttggcaagaccgtagagaaattggaacccttcctcttgcattgctgataaggatgtaaaatggtatagccactatgaaaatgagtttagcagttcctcaaaaagttaaacatcgaactacctaccatatgacccaacaattccaccaccaggtatatattaaaaagaactgaaagcagagacttgaacagatatttgcatacccatggttcacagcagcactattcgcaacagtcaaaaggtggaaacaacccaaatgtccatcatcaggtgaaatgataaattgtggtatatccatacaatggaatactatatagaatactgcctttaaaacaatgtaattttgatacatgctacaatatggatgaacattgaaaacattatgctaagtgaaataagccagacacagagagataaatattgcttgattcccataacatgaggtacttacaagagacaaattcataagaaacagaacggaattaccagggcctgggaggaaggggaatggggagtcactatctaataggtacagagtttatgttggggatgatgaaaaagtcttgggtacggacagtggtgatggcaacataacaatgtgaacgtattcaacgccactggattgtacactcaaaaataatttcaggccgggcacagtggctcacgcctgtaacccctgcactttgggaggccaaggtgggcagatcacctgatgtcaggagttcaagaccagcctggccaacatggtgaaccccatctctactaaaaatacaaaaattagccagacttggtgactaacgcctgtaatcccagctactcgggaggctgaggcaggagaatcgcttgaacctaggtggcggaggttgcagtgagccgagattgtgccactgcactccagcctgggcaacagagtgactccgtctcaagaaacaataataataacaatttcaatgacaaatattatgttatatatattttgctatcattaaaaaaatcccgtgttttttaaacagaaacatcattctgtatgtctgttttggagccatgggggggactgtgaagcacttctcaccatgaagcagagcaaaatgtagagtaaagaaaaagaagggcagggggcaaagacatttacagtctgccaacatttgagagaagggacaaaagcatatggttctcctgcaagcctgggaagaccccacctggaaaggcccacaaggggcctatgagcaggctgctccaggatggggggactgaggaacaggtatgccaagaaacttaccttattcaccgttacagccctatggttctatatgaaggtttgatcttggacatgtattaaccagtaataacaaactaatttctaaaaataaataaatcatgagatttgcagctagaggtaaacaaaaaataataaaaataaataaagaagtgtttcttgaaaaaaatttcaacaggatttttctttgtagctatagacaagctgattataaaatcagtatgggacgggcacggtggctcacacctgtaatcccagcactttgggaggctgagccaggcggatcacttgaggttgaaagttcgagaccagcctggacaatatggtgaaaccccgtctctactaaaaatacaaaaaattagccgggcatggtgtgggatcctgtaatcccagctatttgggaggctgaggcaggagaatcgcctgaacccagaaggtggaggttgcagtgagctgagatcactccactgcactctagcctaggcgacagagtgagactctgtctcaaaaataaaaataaaaataaaatcagtatgaaaaggcaagaagagtaatgaagggaggagtaacgctaatcaattttaaagacttactataaagctacagtaattacagcgtagacagccacaaagatcaatgaaccagaatagaaagtccagaaacagacacacaagaatgtggccaaattaacttttgacaaaagtgcaaatgcaatagagaaaggatagtctttttaaaaaacagtgctgaaagaactggatatccaaatgaaataataaaaaccttgacttaaaacctgacatgttataaaagattaacaaaatggattagagatctaaatgtaaaacatgcaaagaaacccaggagaaaatcttcaaaacctgaagttaaacaaagaattattagacatgacactaaaagcaacatccattaaagaaaaatacagataaactagcttcatcaaaattaaacacttttgctctttgatgtattaagagaatgacgagacaagacaaggtagaaaccagaagaaaatatctgcaaaccacatatctgacaaaacctcatacctagaaccctgaaaacatcattagccattaggaaaatgcaaattaaaaccacaatgaggtataactacacatctctcagaaagacaaaaataaaaaagagtgacaataccaaacaccaacaagaatgcaggtaaatgatctcttaaatattggtggtaaaaatgtaaaatggaagagccactctggaaaacagatgacagtttctttaaaaacaaaatataaacttaactatatgacccatcaatcctactcccaggtacctgtcctagagaaagcaaaacttatgttcacataaaacgctaagcatgaatgctgacagcatctatatttacaattgctaaaaactgaaatcaacccaactatcttgaatgaaaaaccaactatggcacattcatgcaataaactactaattagccatagaatgcgatgaactgtcgatacaggaaacaacttggataagtctcgaaatcatgagagaaatttttgagggtgatgtaaatgttctatatcctcattgtagtaattacatgaatctatacacgtactgaaattcacagaactatacacagaaaaaaacttaatatcaggtgtactttttaaaactaaattttaaaagaaaaaggagataggtagtaacactccacatacataccaagactacaagtctgcttctttcacagattccagggaggtaaggataaggtggcattccttcacccttcagacaagaactcacccactgataaatacttggtggctcagacgtaaaaaatgatggatgatgcataaatcctgtttgacctttaaaattagataaatattcaaaaagacacgaaaatacattaagacaacattattttattttaaacggaagatgatcaacagttacttgtcattttgaaacaactagaataatatttttccagctgggtgcagtggctcacgcctgtaaccccagtactttgggaggcccaagcaggtggatcacgaggtcaggagttaaggacagcctggccaatatggtgaaaccccgtctctactaaaaatacaaaaaaaaattagctgggcctagtggtgcgcacccgtagtcccagctgcttgggagactgaggcagaagaatcacttgaacccaggaggtggaggttgcagtgagccgagatcacgcctaagagacagagcgagactctgtctcaaaaaaaaaaaaaaaaaaaagaataacgtttttccatattctccaaaatgcttcatgttttctgccacagtacataaggaactatgttattaaatgtagaatttaaatgacttctattttatcccaccctggatggaaatttagcaaattcttgttcccaaggcatacaaagaatctaaccaaaggctggatgtggtggctaacacctgtaatcccagccccttgggaggctgagtcaggtggatcacttgaggtcaggagttcaaggccagcctggccaacatggtgaaaccccatcactactaaaaatacaaaaattagccaggcgtggtggcacacacctgtaaccccaggcaatcccaggcacttgggaggctgaggcaggagaatcgcttgagcctggaaggcagaggatgcagtgagccaagatcgtaccactgcactcccgtctgggcgacagagtgagaccctgtctcaagaaaaaaaaaaaaaaaaaaagaagaatctaatcaaaaatcttgccctaaacctaaaggtgaaaaaaacaaaagaaacatccaggattcaggtctgttccaacaactgggccccaaatttcagtacctttagctcagggtctaggatagtacagtggtgatggagatgttctgtgtctgtatctgcactgtccaatatggtagcactagccccatgtggctactgagttctcaaaatgcggctagtgcactgaggaaatatgttttattttaattgaatttaagtagcatatggttagtggtactaactgtacactacaagtctaagttaaaagcatccttggtggcctggcgcggtggctcacgcctgtaatcccagcactttgggaggccgaggcgggtggatcacgaggtcaggagatcaagaccatcctgtgtaacacagttaaacctcgtctctaataacaatacagaaaaattagccaggtgtggtggtgggcacctgtagtcccagctattcaggaggccaggaggctgaggcaggagaatggtgtgaacccaggaggcagagcttgcagtgagccaagatcgcgccactgcaccccagcctgggtgacagagcgagactcagtctcaaaaaaaaaaaaaaaaaaagcatccttgaccctggaagctttctctgacttttgcaagtcagaaccttagggatgggtaacattttccctatacactgaagatattatggcttactacgtgtcagaaaacaagcactacgaactaaaatctgcctggtggaaaggcactgcccctgacttagaagctaatggtaagaaatacatcctctgctattcaatgagaaagatacaaggaaatatcactacactgtttagaaaatatttaaaagcacgactacttacctggatcaattgtgcacacttgtccagtagttctgacaagcgttgggtagtctctatagtaatgatctacataaggccccaattttaagtccctaaaacagtaagggcatgtaaaaaagaaggtattacagcactttctcccaacagaattggaaggattgattagttgaatcttttaatttaaaaacttacatatgagaaagataaccaaatctagagtctctctattgtatttttggactttaaagtgcccagtgtgacaaatggaacccaatctctttttgctaaattttgtggaagtaaaactacagtaaaagcaccgtgatctagttcctcctctgctattagctgtgtgatcttccaaaagtcatgtctataaacctcagtattttcttctagaaaatggggcaataccagctcacttactctgaagttttaaagattaaataagataaaatatgtaaaaaaaaaaaaacctgataaaatgtaaaacatcatacacattacttttttcagagagccatgattatggtttggaaattacttaattacaaaagaattttcatgacagtaatgacatcctaagagatatttaccattgattaaaactgccatgtctcaggattgaatttcaagatctcaaaaaagacaacagaaattagaaaatgtactatgtcttaactcagaggttgacatttcaattcaaattcaacttctttatcaccaaaggtcataaaggtcaaacaacacacaagtatgaccctagaattctgagccatacaccaggtgcttcaaagctcttgaaaggtgttgaaacgtattattagaactatcttattgtggatctactatgagtgcctcaaagacagggacaacctcagactgcaacaaggacagcatagcaaaatgagtccacaactatcaaacactcgcatcccaggaaagacatttaggcaagtttcctcatcactaaaacaggaaacttaccttgtttgagactttacatgtaaactatgattttgtcaactataaagcactatttgaatgtggatattacaaaacagcagatgttattctagaactcccaccgcagtatagccagtcagtcatcctgtcaaaatgaaaatctgagcaggtcatctccattttttcgtgaccttccactaatctcaggacaaagactaaaaatccctgcatggctcacaggcccttacaaaaccagtatcttcaaacaactctgtggtttacagagatgccctagttttctgagaaggtagatttcagaaacttatttacaaggtccctatatgatacaaggttcctatatggaaaagacagtcatctcaggacttcctggcagtttctaacctacaaacaaatttaccttgccaactgaacgagaagttcaacaagtgaacaaattccttctcccattagagtattcaacttaagctcctcatacacaaggtgaagaacgaaaaaaattgcaggtatgtgagtaaagagaagtgtagaagaatccagactgagattctgtgaaaaatcctcatccttcatctgtgaagcttctgaaggactcagacataaagatctgttcaaaagatgagactcaacattctggtggtagtctgaatttagtaaatattcccagtcctgagaagaataaaaagaatattaatttttaaaaataatacctccttataatatcataagaaaattaattcacttaaaacaattcaagtttcattttcacattaagttgatctaagagtatgttaaaaaaaaaaaagacaatgctaagaatgaagtaactataaaatagcaagccagttataaacgttaaggcaagccacctttaaaaaccattaaaaaaaatattttcatgaccttttaggaaagacattgggagaagaattatactatttaggtagagattgagagagaaaatttaagattatctcaggctaggttttataggaaaagtagatggcaagttagtggccactacactgaactgtgttttggtaagaaggaaggtccacctgcattcagctggtgtattcatctttccacatgtataagatgccggggctagtaatataatctaataatcaactgatttttatattcagactgattggactacattttccaaatattcaagtctattttggttctacttgtgatttactgcatttggttcagagaatgtggtttatgctatttccagatcttggaatttactgatgtttttgtaaggcttaatacagtgtgttactctaaattaaaaattcttggactagatacagaaagaactaaccataaaagaaaaaactgggccgggtgcagtggctcatgcctgtaatcccagcactttgggaggccgaggcgggtggatcacaaggtcaggagatcacgaccttcctggctaacacggtggaaccccatcacttctaaaaaaatacaaaaaaattagccgggtgtggtggcgggcgcctgttagtcccagctattggggaggctgaggcaggagaatggcatgaacctgggaggcagagcttgcagtgagctgagatcatgccactgcactccagcctgggcaacagagcgagactccatctcaaaaataaaataaaataaaataaaaaactgataaattggataactaaaataaaaaattctgctcatcaaagacactgttaaagccacattctaagggaaaatatggtcaagaactcatgtctagaacatgtaagaacttcaacagcttacatattttttaaaatctaatttacaagtagataaagatttgaatagaaacttcacaaaaagatacataagcagctaatgagcacatgaaagagtgtttaacatcctccaacctcagcctccaagtagctaggactacaggttatgcgccatcatgcctggctaattttcaaatttttttggtagacaactggtcttactataatatgttgtccaggctggtctcaaactcttgggctgaagcagtcctcctgcccctacccctcaaagtgctgtgattacaggcgtgaattttcatttaaaagaaattaaattaaaagaaattaaaattacagatgtgaattttaatttaaaagaaattaaattaaattaaaagaaattaaaattcacacctgtaatcgcagcactttgagagataggggcaggaggactgcttgagcccaggagtttgagaccagcctgggcaacatattatagtaacaccttgtctctaccaaaaaaatttaaaaattagccaggcgtgatggagcataccggtagtcctagctacttggaggctgaggtaggaggatggcttgagcctaggagttcaagattacagtcaactacgatagcatcactgcagtccagcgtaggcaacagagtgacaccctgtctcttaaaaaaaaaaagaaaagaaatgaaaatgtatgtccacgggcccggcatggtggctcacacctgtaatctcagcactttgggaggccaacatgggcagattattgaggccaggagtttgagaccagactgaccaacatggcaaaatccagtctctactaaaaatacaaaaattagccaggcatggtggcacacacctgtaattctagctactggggaggctgaggcatgagaactgcctgaactcgggagtcagaggttgcagtgagccaagatcgtgccactgcactccagcctggatgacagagcaagactccgtctcaaaaaaaaaaaaagaaaatatatatccacaaagacttgccagtgaattttggcactagcttgctttattcataagactttaaaaaaaaaaaatggaaatagcctagatatctaccagcagaagaaggatagataaacaaaccatggtatattcacactactcagcaataaaaaagcacaaactactggtatctgtaacaatatgaattaatctcaaaagcattatgctgaataaatcttataccaaagattacatactatattattttatttacatcaagttctagaacaggtataactaagatatggtgacagaattcagatcagtgattgctagaagaagagaataaagctgattaaaaacagcaagaggggccgggcccagtggctcatgcctgtaatcccagaactttgggaggccgaggtgggcagatcacgaggtcacgagttcaagaccagcctgaccaacatggtgaaaccccatctctactaaaaatacaaaaattggccaggcgtggtggcgcatgcctataatcccagctattcaggaggttgaggcaggagaatagcttcaacccaggaggtggagagccgacatcgtgccactgcactccagcctgggcgataaggcgagactccgtctcaaaaaaaaaaaaaccacacaaggaaattttatggagttataaaaatattgtgtgtctttataggagtgtaggttacatgagtgtgcatatattaaaactgatcaaactaaacccaagctgtatttcatttttgtaaattacaccacaatttaaaaaaacatatttggaccactgaagaataataccatggaggccaggtgtggtggctcatgcctgtaatcccagcactttgggacaccaaggttaggaaggtcacttgacgtcaggagttcgagaccagcctggccaacatggtgaaaccctgtctccaccaaaactacaaaaattagctgggcatggtggcgggcgcctgtaatcccagctattcaggaggctgaggcaggagaactgcttgaacctgggaggcggagattgcagtgagctcagatcctgccactgcactccatcccgggcaacaagagtgatactccgtctcaaaaaaaaaaaggaatataccatggaacctgatacaattgagaaccttaatttaaaaaacactgcataaaaaaggtaaatgctgtcatttcaggtgatcagttgatactaaaatgtctacaaacccaaactgaaatcatgcagtaatacatgtattaatttttagataatcattaaagaccacagaaaatgtaacagatcctactcttcaaaataattgctattcagtattaaaataaataaagtgaaaggtgttggaaagatagaggaattgataggaataccacagaagtggaagaatagtatgaatatccataaattaatttatattagcaagaaataataatgcttacatcatcagatccagtctcggaaggccttgcttttttgggcgcaatgacaggagaaagtgatccttcaaagtcaaactgaaaagtaaccccaaaagaaaagataaaaatcgtaaatgcattcctgtcaactgatcaacttcaaggattcagaaatcagttctgccaattacgaaaactgagaaaagccatcaaaactcattttttgatctggaaaggcattatttaaatatctttcttccaggttactgtaaagatgaaatgaaatcatattaatatatgcaaacatctagaacagtgcctgggcttctaaggactgattttaatggtagtttccttccctctcctactcctgtaacaacatagattacatcacatctttggtagaaaaagaaactttaggcatatccacaatataccaagtctcaaaggatcaacccaatatcagtcaaatgttagaactaagcaaacatttatttacagtccacctacagtaaactatctaacaattctatggcagagacaagtagctactctggaaaatcttttttctcctctttctcctgaacccacagccagactacatacatacgtctgcctcctttgaagttaggtgtgaccctttgacagagttaattataaatggaagtcactgtcatcacttccaggaccagtccagtcctacccctgctcctccaggctctttgccccttccacctgactggaatgcagtcaaccaatggcaatctttgaaccaaagataaaagatcctccatcaacctgggttcctgaataactgtgtggcctgtttatctgctaagccctgttatgtaagcaagacagacatttttattgtgtttgagccattgtatcttttgaggcctttctattacaatagtgagcctatcttctaactaatacaactacataaaagcagttttctacaagttgctcttcttcaatttcccctggcataatctttgctgccccagctacttcacatgggcattgaccatcaactaataaactgtaactctataaatggcaatggctattttcctatgctgaaaaacttacatatttatcaactcactcacctaaacagagttgatttctatataaaaactaaacataggtagcaataaagtgatatttaaaactgaatgttattgagagagaagatctgcttgtgaagcgttcaaataaaaaacagcccaactcatatatattataaaaaacctggtagtaacagtgaaatcaaagcaacaaatataacagtaactatctaacctaaaacttcaaccaaaatgtaacacacacaaactcccacagtcaaaaagaatgtccctgctataattatcagattcataaggcctggagttatgagaaagtagaaactgcctgataaggatggctctttgtgccatacatggatctgtttaatcttcactctttcaatgtgtctcaggttagccaaccctgttatatgctcctatggacccttacccttcatctatcataacacatttatcaaatattatttatttgtttcccccaagacagtcaattccagaggaacaatctgttttgtctggggtatatgtgagaaacctggcatcatgcctggcccacagcagggattcaatatttatctaaggaaaaaaacagcagcccggaagccacaaaaagttaaccccaaatgcaactgttcctacaatgtacagtccagtgcactcatgtaacacatcagcaaattaaagaaagcacaaagaaatgccaaaaattgtgtaacgagtcattggcagaaattctgtactccaccacattacatatgtgaaaacaaaaagaataaatctgaacaaagcaaaatgaaaaccatttgccaatgaggaccattttatcctaagctttgactatgaggacaaaagataacaagggtttaaccatgcagtcctataaataaatagcaaagcaacttggcctcaagaattgatttccttattccttcctttataattatcatgcaataagtaagtcaaaaagccatgtccttctctgcaaaggaaaaaatgggtaggtgctcagtcctccccaaaacatggaaacgcgaaggggcataggttctctgccagagactaggacacaacaatctgtactcatcaacaagttacaaggacaatgatacacaaaactacagaaagctgacgcgttttttcataatgtagaaatccagtttctatgaggcttaatcttttcacatgtaataaagaacagaaaaattggggataatgtcactcggatacaattgtttaaaataagaaaagaaggccaggagccgtggttcacacctgtaatcctagcactttgggaggccaaggtgggaggatcacttgagctcaggagtttaaaaccatcatagccgacacggcaaaaccccgtctctactaaaaataaagaaattagccaggcgtggaggtacatgcctgtaatcccagctactcaggaggctgaggcacaagaatcgcttcaacttaggaggcagaggttgtagtgagccaggatagcgccactgcattccagcctagacgacagagcgaaaccccgtcttaaaaaaggaaagaaaagaaaattgtccctattttcccataagatttctctcaaggaaattgcagagagcaattccttcatgtgctgaaatagacacaaactcttaaaaacagtatctcactcagatggaaaatggcattcactcaacaaatgttcactgagtatccttctatgccaggcaataccacaggtcctggagagagagagtagtaaacaaaactaagcaaaaatctttgccttcctagaatttacattccagttgggggaggaaggacacaaaacaaaataagtaaaacatatagtatattatatttaattaagtgagaagaaaaaaaaacaggtaaatggcactaaaggtatggaggcaggtgtaattctatagagacaggacaggcagcactgaggtgacatctgaataaagacctaagcacgtcttgtcggagggaaagcattctccatagaggtaatggcaagtgcaaacactcagaggcagaaacatgctggcagtgctcagggaacagagctgaggccaatgtggctgggatgatgtgtgcaaagcattaagaaataagagcaggaaggtgagcaagggctaggtcacatggcatcttataagcctatggcctttactctgagtgacatgggaagtcactgggggattctacgcagaggcgtgacgaacgcaacctgacgttatcaaacaggattactgtggccactggactgagaagagactggaacatagacaaaggacatgaaatacgaatcaaaaaataagaactataaataactgatgaaattttgaaaaaaacattcccatttacttatagagaaataagataaaatttctcaggaagctggcaaaggttcaccacaccacaaataaacactgtggtgaaatgggcgcttttaaatgatgctagtaagaatgtcacctgggaacccctttccaaacattacttgacctcacagtttctcttttaagattcaatgcttgggaagtaactagagatgtggttaaagagtcgtgaaaaaggatgtttataaattacaataacgaaaacaacagattcacaaggtacaattattagctattggttaactatgataaaactacactatgaagaaatgatggagatattttagaaaaaatttttaatgatacgggaaattttcattggtatttttatatagaaggtaacatcaaaaatatttagagtggttatctctaagtagtataattattttcttaattcctccattttccacattttcctttcataattaagacaaaaaacaaattttaaaaatggatttgctggccaggcgcagtggctcacgcctgtaattccagcactttgggaggctgagacgggcagatcatgaggtcaggagatcaagaccatcctggctaacacggtgaaaccccgtctctactaaaaatacaaaaaatcagccaggcgtggtggcgggcgcctgtagtcctggctactcgggaggctgaggcaggaaaatggcgtgaacccaggaggcagagcctgtagtgagctgagattgcgccattgcactccagcctgggcgacagagcgacattctgtctcaaaaaaaaaaaaaaaaaaatggatttgctgtgcaaggctaaaacatatagaatggtacagctgagctacctggaaaaggggtaattataatctagagtgattttttttcagagtgacccaggcaaagttgtcctgggagtgatctccaaagctagaaggagatcaccaatactgaagacaccactctgctgattttgtaaataatctaataagggcctgtaaggatgttactgcaggaagagggtgagaggtaaggctttataccattaacagagtagatactcaggctaaagtactttaaatctccctcaaatcaaaccttcctcttcacatcccaagcaatatgtgtgtaaaaagacaatcttgtcttcagaaaacaatgttaaacaaggagtcagaagatgcagtctagtcatagttgttaaaaaaccacagatctgtgatttctttgtgatccagtttcttcatcaataaaaccaagactatcactaatcctagcataacttgcagtcattttacaaaggtgaaatgagaaatagtcatatatgctttaacattctaaagctcagtaattataatcactagtaaaatgttaatattaaatattaagtgagattttatttacaatatatagatacaataaaccttaatattattctattattttgaatatggtacgcctattatgtagtctcaatgttatattaccaattatgcaaccattacattaacagaataactcataaagaaaacaatagtatttacttacatttctagtccatgctaagcggtctgtgttataacccatcatgttcatgagacaagtcacaaataaattccactctgagtgataactgggtcctcctggagcactgtggacattgtaccacttgacaagcatctgaactgctatttcttttggcaggataaacttaattgcttgcaaacacgtttgtactattaaaagcaaagattaattttagtattcttactctgcatgcatttcttttcccctttcaatcaccaagttttttaacttctactatgtaaaggccaattattatgaaaagaaaactgtcattaaagagccaatgagatgcaaacattacctaaccaatcatctgaaactaaaaccaactactgaattcaacaaggcttgaaaggggtctgaagacagcttttttttttttttttttttttgagagggtgtctcgctctgttgcccaggctggagtgctgtggcacggtcttggcacactgcaacttctgcctcctgagttcaagcgattctcctacctcagccaccaagtagctgggattacaggcgtctgccactgccccaggctaatttttgtatttttagtagagaccatgtttcaccatgttggccaggctagtctcaaactcctgacctcatgatccacccgccttggcctcccaaagcactgggattacaggtgtgagccactgtgcccggccaaggacagctttttgatcattaattttgcatcagaaataaagtaatcaaatagcccagtttgccagagacagtcctgatttacatccattgcccagcaattactaactgctcgccttcactcttaaagatgttctagctcgggtgacaaattaaaagtcactatgggccaggcatggtgactcacgcctgtaatctaagcactttgcgaggtcaaggcgggtggatcacctgaggtcaggagttcgaaaccagcctgaccaacatggtgaaaccccatttctactaaaaatacaaaaattagttgggcattgtggcaggcacctgtaatcccagctactcaggaggctgaggcaggagaatcgcctgaacccgggaggcagaggttgcagtgagccaagatcacgccattgcatttcagcctggatgactagagcgaaactctgtctcaaaaaaaaaaaaaaaagtcactatgaaaaacatacaacttctatgtttatacatttatataaaatactgcctacatacttcagtaaatatataatattcaatatatgcatccacgaatagcaatgcttagctagcattacatgatgttctaaatgagttaacatgcctattaaccaaagctttataactttatttctgaggtcgttcagtttctaaaatgtttcacaggctctctgtcttaaaagggttaagagttaataccacataatttacaccattctttttttggtaaggggaaacagggtcttcctctgtccccaggctggagtgcagtggtgcaattatagctcactgtcacctccaactcctggactcaagtggtccaccagctcaagcttcccaagtagcaaggactacagatgcatgccagcatgcctggctaattttatttttctttttgtagagacagagtctcactatgttgtccaagctggtctcaaattcctggcctcaagcaaccccctcacctcagccttccaaagggaggggattacaagcatgagcccaccacacctggccttataccattctcaatggctccacatcaattatagcactacactgtcatacaatgatcccctcagagtggccagggctaccactgtgaagagacccaaatctgcttttagtagtaaataatcccaaactgcaatgtttgtgtactcacatatcctctcttccaggattcttttttccctttccactgtcatgccactgggcccaccctcatcaacatatcctctatcccatcagtttgcaatgtgcaaactcacacagcacaggttggaagcaaataatattaaaataccaaataaccaagtatgtcatagtggaatccaaaataagtgtaaacccaatgctgcatgagtgtgtgagaaccctctgcaggtaaagtacataaacttatgtgcataaactatggggcttctgtttggctataaaggggtaagattttttgttttcatttatttaatttattccattattatttgtttttatatattttgcttaggcttataatagttcgaggtacctggccttgtgattacgaaataccttttagagccgggcgcggtggctcacgcctgtaatcccagcactttgggaggccgaggcaggtgaatcacgaggtcaggagatcgagactatcctggctaacacagtgaaaccccgtctctactaaaaatacaaaaaaattagccgggcgtggtggcgggcacctgtagtcccagctactcgggaggctgaggcaggagaatggcatgaacccgggaggcggagcttgcagtgagccgagtttgcgccactgcactccagaacctgggcgacagagcgagactccgtctcaaaaaaaaaaaaaaaaaaaataccttttagaaggcaaggaatctctatatcaacttggaataccatttaccagcagtgaaaattcctaaaatgaaaaagtcattcttgtctacaatctgccaatgtcctgctttggcagttagatttgaaaccaagatatgtcatgaacttccttatatcatacaggcattcttttcttaacctacgtttgttggcaaatcccttcaattctaacattttgtttactatgctatgttcagaaatattctcctcaagcatttttgaaattgcatctcaggaataattcaagcagaatccaatatttattaagataattctgattgtattttgacaataatattaagttttattcaattaaggcaattaggttactttcacaatttatctgaaaattgagatatttattttaaaattaaaaacatcattaatacattacagaaaaaaaaacattaaatatgccaagaattatcttagttgcttaagcttccagtttcccagatgttcttgcaagaggcatgtccatatatatacatatacatatatatatatatatatatatatattttttttttttttttttttttttttttgagacagagtctcactctatcacctaggctggagtgcagtggcacgatctccactcactgcaacctccgcattctgggttcaagcgattctcctgcttcagactcccaagtagctgagattacagaagtgcgccaccacaccccgctgatttttgtatttttagtagagaaagggtttcaccatgttggccaggctagtctcaaactaccgacctcaagcgatccacccgcctcagtctcacaaagtgttgggattacaggtgtgagccaccatgcccagcaggcatgtccatatattattatactgcacaatattccccaacagaagaacctcagggaacagaactagcacatccttcacctgtactccagccttagagcgcacgtagagtggacatcacaaagcactccctagctctttaaagctcctctacaaagctaagaacttgatccagtggcttcaaaaatggcaaaataatgtttaaaaccccaattattaatgtaaatcacaattacttcatgtcttataaatgaaacttctcaatcgtacctaactcagaggtggcaatttcaggaatagtgatcctaaccatggagccattactcagttcctagatggaaacaaatgagaaagtagataaaatctgtgcattctaagtctttgaatgtcttaaaaatagctggtacaagactttgcccatcaaagcaataaaataaatgaaaaacaattttcaaacagaaatgaacacttccgaatttcagaaactttaaatgtaattatttgcaaaatgttttccaaaatgcttgttttaataaaaagtgtctaatctttatacagtgagtcaccatcatcaaaaggacatttacttttaatgagaagacaaaaaatcacatcaatatacaattcaactgactcaacaagcttttgttttcactaagtttttaataatacagaaactgtagaaaacaagcagaattactgtatagtaaaaagtaaaatcgtgccaaaaaatgacacaatagatttttttaaatcatgagaaatgtttgttgtcatttttcagacaaaattctgtattctgtcaaatttgaaatgccagcccacttcttggaaagctaccaaatgtttatacttaccagggtgactctgttatggacaggatctctgatagaatgaatgtaagttccaagctgttggaaagtacaatcctcattatagagagaatcatgaagttttgaagaatccctcagttctggaactggggacaacagaacaacctgtaaaaagttgtaaatacgatacaaatgaattgttttctgagaaattaaggacaaggaaatttaactgtttcttttttgcatatggtctaacaaacaataatatgtaatgattcaaaaacattctgctccaagccaagcatggtggtgcacacctgtatagtcccagctactcagaagactgagacaggagaatcacttaagcctaggaatttgaggctgtagtgagcctgtgaatagtcactgccctccagcctggatgacacggcaagacccaggctctttaaaacattttgttccagatacaatgaagtaccagcaaaccaaggtcctcacagaaaacaactagaaaaggtaggtaaaaggaaaacatctgattggtggctatggaaaagctgtggaagcaacctggacttgagggaccaagatctaggagagaaggcaactgcagggaaaggggccaacgttcttggagagccttgctttttctgctctggccatctgcaaattttggtggtaagaggaacatatggaaaggctgacaatatgcaaggaaagtcatagctaagagggagagaagccagcagcactgttagcaaccttacagggctaaagactaaactgtgagccggggcacgcggtggctcatgcctataatcccagcaccttgggaggctgaggcgggtggatcacttgaggtcaagagttcaagaccagcctggccaacatggtgaaaccccatctctactaaaaatacaaaaattagccaggtgtggtggcgggtgcctgtagtcccagctatttgggaggctgaggcagaagaatcgcttgaacccaggaggtggaggttgcagtacggtgagattgccccactgtactccagcctagatgacagggcaagactccatctcaaaaaaaaaaaaaagactaaactgtgatttgaggcagctgaggaactaagagcccaggaagaaaggacagtaatgaaaaagccaacaaatgagaccagtatttaatggtatttcccctataggcaattatttattcaaaaatacaggaacagtatttatttgcttaactgcagatatgcaaacaaaaaatttaaacgatcttagttactatctacatgcagatgcttccaatcttaaactctagtcatgaccactgatcctttttgattcctttaattcaatttatatatctctaagtgaatatcttgtcaacactgacaatcaagactaagatgtatttactctattccagattctactctaaaagtcaccaggaaaaattcagctccgctggtcctggctctaagtctactagcaaaatcttccagagaagtggaaaagccatcaatcagccaatgtgttaagactatcatttccatgactttacacctatcaaaaaggcactattaccaggcttatagaattctaaaaaagttggaaaccattttccattataaaagaaattcttccaaatcacacagaacactctgacacttctccagttccccctttgaatgttctgcaaatgtgctggtttgaaggaaaaaaaattcaatgtggcacatgtttaaaaatataatgaagacacagacattatcaaatacaactgatagcactaaccttccctttgaaccgtccctaaacatccacactcacatgtcctttaaatacaaaccacttttctccaggcttcctaacttggtaaatccaggtaccttcccaggtcattcagagaattcggagcctcgttccacatcacctttccccagcccagcagcacaaaaccaatcagctgacaaactcatttccacctctcaaggcctctcatattaatccctcctttccacacatatactgccctagctcagaccctcttcatacttcttaaactgacacagacaacctcacttggaggctaaccggtctccttatctttaatcccaaaatacacctatttacaacacagatccaaaacctcataactcctttctcaaaatcctgtaatgccctgtcaattgcattcagaataaaaccacctttttatcctttctgcctttaagagcacattagtaagagtgtaaatcccagttctaccacttattaggtttatttcatttgtaacttctatctcatttgtaaaaaaaagaatcatagtactatcttctcaataaagctattctaaggaaataattaatactaataaagcactgagaacaatgcctagcacatagaaaatgctcaaaaaaggttattattgttatccaaaccctatcctgcctcaccctacagactacttgtacttttataagtatttattctacagatttattgagtccttatgactaggagatgaagatacaaatatccactaaaaaatgttccacattatctggccttcctgcctgtgcctgtgtggtttctccttgccctgaatgctcctttctacctacagatatcctactcaaccccaaggtccaaacgaagactgacatgtctctcagtgaggctttgattttgccatgtcctcccattggatgttatcttcccatcggatgttatcttcccatcagtcaatcaacgatggtactctcttttccacattactgagtcatgagtctttcttaaattctaatttcttatgcagacagtacatcaactccacacaattgtgagatccctagatggaaaagaatgtatcatttccatctctccagcaccttcaaaaagtatcacatacatcacaagggaggtcagtgtatgttaactgaatcacttctgtttgaaaacatttattctgcaagtagaaactaaaattaagttaaccatggaaagaactaatgtttaaccaaacttctttaaaaaatgttaactttttggcaacacctagtccttttcttacctcgtccaatgatccaaggagtttactaagaggctttggagtactaacgccatctagtggagtactgggccgaggcattgtgttggacatcgtcagagagggagctggcagtccaggaataaaaacctttcccacctttaagcaataaaaacatgtggaaaaaaaaatattgcctttaatgcatcatatccttaaataaaatgttaaggaatataaacatatatttcttttgatatttctaagtttatactcaccaaacacagcaaagaaacaattcaaatgtcaataatctatccaattccactatccaactgcaaatatgttggtataattttttttttttttgagataagatctcactcttttcccgtgggtggagtacagtggcatgatctcagctcactgcagcctcaacctaccaggctcaagtgatcctcccacttcagcctcctgagtagctggaactataggcacatgccactatgcctggttaattttgtattttttggtagagacagggtttcaccatgttatccaggctggtcttgaacttctgggctgaagccatctgcccacctagacctctcacaccttggtataatttctcttggttggattccttctcttcattactgaagacttttttttgcaggcaaggagaggaatgttaatatagtcaacacattatataaaaatctgcacactatgtactcttctacctttttggtcataaagacagtaagaacagcggccgggcgcggtggctcacgcctgtaatcctaacactttgggaggccgaggcgggcggatcacaaggtcaggagttcaagagcatcctgcctaacacagtgaaaccccatctctactaaaaattaaaaaaaaaaaattagccgggcgtggtggcgggcgcctgtagtcccagctactctgaggctgaggcaggagaatggtgtgaacccggcaggcagaacttgcagtgagccgagatcgcgccactgcactccagcccaggcaacaagaacgaaactctgtctcaaaaaaaaaaaagaatgagttgacaatccgtgctaaccactccttattttggctatctgtagggtacttagcaaaaacagaaattcacatctgtacaagctgaaaacttgataagactaaaaaggagatgctcagaactaaaatgagatattaacaacgtacgtattcatgttaacacactactcaaaagctaacaaaataacagaagttgccccaataaaatccttaggcttaaaaaacaaaaataacagtgagaactaattatgcataattttttaaaagctatctcaaacccctaatttacgaaaagatggaataagcacataccatgctattccctcattaatcaccaaaaagaaaaaaaaactgaataaaatttataatgcaactaacagaagattctgaaaaagtgaagaaaagaagacaaactggctagtaacctgagacccaggaatgacctaatgatgaattccctaggtttctggtttgattccttacgtaaccaggccttaggctttcaaagtgcctataacacagacatgccaacgttcacagacaaaacacgccctaagaaaatcttactctttccagccaaagtgttgggaaaagaatgactgaccaggacagaaacttttcactatatctgccctactctttgcaaacaccaagaaaaaagtcatggccatcccttcctcctcatcaggaggcacagtgaaaattttgaatgtccctcgtctatttgaggaagtccccttctatttctagatgctgaggattttttttaatcatggatattttattttatcaaatgatttctctgcatctatttagatccttggtcagcaaaccatgttccatgaccaaatctggctcgtatcctgtttttgtacagtctgtgagctaagaataggttttacgtacttaaatggttaaggaaaaaaaaaacagaagacaaatatgtaacagagactgcatgtggcccatagaggctaagatacttgtctgaactcctacataaaaagtttgccaggcttgatgtggtggctcatgtctgtaatatcccagcactttgggaggctgaggtgggaggatcgcttgagtcaggaggtcatgggtgcagtgagctgtgatcccaccactgcactccagcctgagtaacagagagagatactgtatcaaaaaaaaagaagagaaaagaaattgccaaggatggagaggacatgaacaacattatcaaccaaatggaatgaactgacatttataaaatactcaagggtgccttcttggtgatttggccctttaaagtctctctttgttcctggtcatttttttttcccactttatagagactccagctatcttctgattactgtttgcataatatatcttctttccatcctttaacttacccatgtcattatatttgaagaacacttcttataaccaacatatatagttgggctgtattttctaatctcttccgctagtctctgttatttgtgttagaccattgtatttaattagtggcctagtgggatttaaatctgccatttaatatttgttttctgtatgttcccactttctttgctcatccagaagaagcaactcttcaagtttgatcataagattttggcaattctgttcaagtttggcaattctgttcaggtttaatcataagatcttggcaatttagtcacatcttcaggctctacttctaattctaattctcctgctatttccaccacatctgcagtgacttcctccactgaagttttgagcccctcaaagtcacccatgagggttggaatcaacttcttccaaattcctgtttatgttgatattttgtcctcctcccatggatcatgaatattcttaatggcatctagaaaggtgaatcctttccagaaggtttctttttttttttgagatggagtctccctctgtcgcccaggctggagtgcagtggcgtaatctcggctcactgcaagctccgcctcctgggttcacgccagtctcctgcctcagcctcccgagtagctggaactacaggcacccgccaccacgcccggctaattttttgtacttttagtagacacagggtttcaccgtgttagccaggatggtctcgatctcctgacctcatgatccacctgcctcggcctcccaaagtgctaggattacaggtgtgagctgccacgcccagcccagaaggttttcagtggactttgccagatctctcagaggaatcactatctatggcagctccagttaagtaatgtatttcatagtaagactttaaagtcaaaattactccttcacaggctgcagaacagatgtgtcagcaggcatgaaaacaacattcatctcctgtacatctccctcagagctcttagatgaccaggtgcactgtcaatgagcggtaatattttgaaaggaatcttttttctgagcaatacgtctcaacagtgggcttaacacattcagtaaaccatgctataaacaggtgtgctggcatccagtctttgttactccatttatagagcccaggcagagcagacttggcataattcttaagggccctaagatttttggaatggtaaatgagcacgggcttcaactttaagtcaccagctgcattagcccctaacaagagagtcagactgtcctttgaagccaggcactgacttctcctctcaggttatgaaagtcctagatggcatcttcttccaacagaaagctgtttcatccacactgaaaatctgtttagtgtagccacctgcatcaattatcttagcagcttctacatcagcacatgctgcttcaccttgcacttctgtgttatggggagggcttttttccttaaacctcaagaatcaacctctgttagcttacaacttttcgtctgcagcttcttcacctttcttggccgtcacagaattgaagagagttaaggccttgctgtggattcgacttcagcataagggaatgttatggctggtttgatcttctgtccagacactaaaactttcttcatatcagcgataaggctgtttcgctttatcagttgccatgttcactgaaatagcacttttaatttccttcgagagcttttcctctgcatgcacaagttggctcttgtgcacaggtggtctggctctcaacctatctcagctttcaacacgccttcctcactaagcttaatcatttctagtttttgatgtaaagtgagaaacctgtgattcttcccttcatttgaaaacttagaggccattagagggttactaattggtctaatttcaatattgttttgtctcaggatatagtgaggcaggaggagacagagagacaggaaaggggtcaaatgatcagacagaccacacaaaacatttatcaattaagttcctcatcttatatgggtacagttcgtggtgccccaaaagaattccaatagtaacatcaaagaccactgatcacaggtcaccataacagataaactaataacaaaaaggtttgaaatattgcaagaattatcaatatttgaaacagtgacacaaaatgagcacatgctgctggaaaaatggcaccaacagacttgctcaacacgaagttgccacaaaccttcaatctgtaaaaaaaaatgcagtatctgtgaagtacaataaagcaaagcacaaaatgaggtacgatggaatactattaaatatatacatcacactgaatgagtaaacaacacacgcatcaacacagacaaatctaaaacaaatataatgttgagcaaaataagtatatcagaggcgagtacatggtatctttttttatataaaaattcaaaaacaaggaaaactaaataatgcattctttagtgatacatacataactgtaaaaactagtaatacaaacaactgatttatcacaaaatcaggattctatctcgagggcaggggaagataggatgcaatcacaaaagaatgtaataaaaataaggatactggcaatattctatttcttaaccagagtactgggtagatgaatattcacttcattattattattcaaattgtatgtatttaaatttcataatttaaatttgtaaaatgtatattctctacgtacatttcacaaatgttaaaaaatacagctagcggctgggcgcggtggctcacgcctgtaatcccagcacgttaggaggccgaggtgggtggatcacgaggtcaggagatcgagaccaccctggctaacacggtgaaaccccgtctctactaaaaatacaaaaaattagccaggcgtggtggcaggcgcctatagtcccagctactcgggaggctgaggcaggagaatagtgtgaacccgggaggcggagcttgcagtaagccgagatcgtgccattgcactccaccctgggcaacagagcgagactccgtctcaaaaaaatacagctaacatataccacatttaatatagtgaaactttaccaaaactttagtacttaccaaaggtacccatgcttcaatttcaaaactttaactttaaaaaaaaaaaaaaatctacctatactcattgaaggtttcccatctgtgacaggtttagagtaccaatgcatttaacagcagtgagccatagccctccaaattaggacccacctaaataggaagcttcactgagaattattaacaaaattcttctgccaaattgtgcagacaggaacataacaaatttaaaatatcaatctaaagtaacattacaaatattcatgcaggcagcctgaagtcctactaaaggcatgaagtgctacttattgcttacccgaaccactcctgtgtatagcaccaggtttccactgccttccaagaccagcatggtgtctattttctaaaaaaacaaaaaagacaaaaaatttatttcccaatctgagcaaattaacagattttttgactgaaaaatctgttgaagcgtaattgtcaacttctcaaatgtgcctacattacctccactggtgctgcatcctttgctggtatgttggtcactgaaccaaagatgagctgggttttatcattactctcttgaaactttacacagctaaataataaaataaaaaagaaacttgatacatgcaacaacctgtatgggtattaaaagtattatactgaacagaaaaagacaatctcagaagtttacatactgtatgagcccatttatataacattcacaaatgccaaattatcaagatggagaattagtggttaccaggatcagtgggtaatggtgtatgtgactataaggagttaacgtaagacagataaagatgttttgtatcttgattgtggtggtatttacacacatctacatatgtgaaaaaactgcatagaaccatacatacacataaatgagtacatgtcaaattgatgaaatttgaaataaagtgtgtacatcatctatctcctggttatgataatgtattatagttatataagaggttacctgtgagggaaaaagaatgcaaggtacacaggacttgtttactcttttgtaacttcctttaatctatcgtatttcaaaatatgaaggtaaataaatgggcaaaagatctgaatagctattttacctaagaagataaatgaatggctaataacttcatgagatgatcaacatcagaatgcattagagaaaagcaaattaaagccacttcacaaccactagaaaatagctacaatcaaagagtgtgatgatatccaatcctgtcaaggataaagagacattaaccttcatattttgctggtgggaatataaaatgatacaggctatttggaaaacagtttggtgatttcttaaaaagttaaacatgaatttaccattcaacccaatgacccaatcctaggcatttactcaagaaaaataaaatcacatatgtccacatttttgctcaagacctttgttcaaatgttcatatggtcataattctcagtagtcaagaggtggaaataaaccaaaagtccgtcagctgatgaacagataagcaaaacatggtggtagatctatacaatggactattacatagcaataggtatgaaataatgatacatgttacaaaatggtggatcctaaaaacatcacgctaagtgaaagctaaacacaaaaaggtacactgtgtgtacatacattatatatatataaatgtccagaaaaattaatctataaaggcagaagcctagcatggttgcctgaggctggaaatgggaacaagactgactacaaacaagcacaaggaaatctttttatggtgatataaatcttgtaaaactgggtcatggtgatggttgtataacactgtaatttactaaaaatcatttaattatacagtaaaaacatgttaattttatgacatgtaaattatttctaaataaaactacttaagccaaaaaaaaaaggaaagaaaagaaaaagaaaaagcagtgctaagttatttatacagaaacaatgggaaagacatacacctaccgtaactggagctgggactctactaaaaagcacaggaacttttgcccacataggtcagatgtaataaacacttttgaggcttgtgaatttttctctctataatagatacattaataaagtaactgtcagcactggtccaagaatctaccacagtaactattaaaagtctttgaggccgggcgcggtggctcacacctgtaatcccaacactttgggaggccgaggcgggcagatcacgaggtcaggagatccagactatcctggctaacacggtgaaatcccgtctctactaaaaatacaaaataaattagccaggcatgatggcaggcgcctgtggtcgcagctactctggaggctgaggcgggagaatggcatgaacccaggaggcggggcttgcagtaagccaagatcacgccactgcactccagcctgggcgacagagccagactccgtctcaaaaagaaaaaaaaaaaaaaaaaaagtctttgaaaatattctgcaagaaatctaaaaactacttaggtcaagcaataatctcaaagacacaaacatttctaagaattaaacttcatgatctctaagatcctttcagttctttgattatgagctcgttacacagctttgttggggaaagctacaataaatttaacaattactgatgaacttttaaattacatactatgtaagctccctacttgtaaagtaatgcaaactaagccacctacttgtaaagtaatgcatgcaaacttgaattcctatcccgcaaagggccagatctttcataatgctatttctcctatctaccccctctccttctcagattaggcctcattcacatctctttttgaaatcgtatctctaattcccaaacccttccttctaaagtgctacagaaggccgggtgtggtggctcacgcctgtaatcccagcactttgggaggccgaggtgggcagatcacctgaggtcaggagttcaagaccagcctgaccaacatggagaaaccccgtctctactaaaaatacaaaattagccagtaatcctgtaatcccagctactcgggaggctgaggcaggataatcgattgaacctgggaggcagaggttgcggtgagccaagatcacgccattgcactccagcccgggcaacaagagcgaaactctatctcaataaataaataaataaataaataaatagtgctacagaagacccataaatctaaaaaataagaatctataatatattcaacttacaaataagttatttaaagaaaaatgatttataattgtaggatacttttgatatatgagaaacaaaccagacagactacttcaacattgtatccacatctttactttcttcagactacctattccccatttcattctctctaagattatgcatttgccttccatttcagataaaacgaggctctaaggcttgagctcaacctcctgccttacatatctgatcaaccttcacttctttatcccaatctcaccacttatgcacctttctggttacttgttccatcaatcatttcctctgttctgtattttcaatactttcccttgagtatagtccgtatagcctactacttcacattaaaagtcttaaaatacaaaatggactcaacattagagtatataaaagaccttctcaattcgactggatataaaacttgtattgtggttaggttagaaaatactgggggccaggcacagtggctcacacctgtaatcccattactttgggaggcagaggcaagcaggttgcttgagcccaggagtttgagaccagcctgggcatcacggcaaaatcctttctctgcaaaaattacaaaaaattagtcaggcgtggcggtgtgtgcttatagtcccagctatctgggaggctgaggttggggaatcacctgagcccagaaggccaaggctgcagtgagctgtgattgagtcactcactgtactccaacctgggtgacagagtgagaccctgtttcaaaaaaaaagaaaaagaaaatactggggcaagatgtcatgaaaactaattttattatagttcagcaaaaacaaaactctccttgaccaagactccctctaattttgtatcttcattcctattcaaaggcaaactccttaaagagtctgtatgcctatgttcatttcctcagtccccatttactttttctaccccactttcccccgccaccctcccagcttaaaatgctctggccaaggtcaccaaggaacccactgccacccaggtacctcctctctgggttcaactctcagggccacacttcaccagtacctggcaatactggcatctctgtattcttgaaatgttcttttttgtattctgtatttcctgctgcttctcccatctgacctcttttgctttgtctctctgtgccagctttgtctctttccattccccaaatcttaagtttccaggacttcagttcctagccctcttctcattctacaccactggattttaactatttggaggccacaaatccctttgagaatctaaggaatgttaaaaccctctccttgggaaaaggcctatatactacatgtacacacaattattgaatacaataattcttcaattctaatctaattctcttacctcaatcaccacctataagctgacaattccacatttattgttctgctctttcccaaacttccgacacacttataaagtgccttcttaccgctgtcatcaaacataccagaggcctaaagggcaatcagtaatctctcaagcctcctttttttctttttcagacagtctcactctgttgcccaagctggagtgcagtagtgtgctcttggctcactgcaacctccaactcccaggttcaaatgactctctcacctcagcctccagagtagctgggactacagatgcacgccatcatgcctggctaatttttgtatttgtagtagacatggggtttcaccattttgggcaggttggtcttgaactcctgagctcaagtgatccatctgcctcagcctcccaaagtgagtgattacaggtgtgagccactgcgcctaggaagcctcctcttcattagccttttccctcccctctgcaaaaaccagagtggaagtacttgtaattccctaaatacaccacgcactcaccagaacttttgttctgatcccagctgccgtctgtggtctttctcaacttccctgcctagcgaatacctattcgtctttcaaagccctaccagcaaaagtagtccctcctgtgtcaccatccttcagctatctgcctcttttgaggacagggacagtgacttattagactgttaactagcacacacattggcatataaattaacacgtgaattattaaagagaatataaaagaagaaaggtcacccagaacagagatctaagctatgtttcccaaaaagtaaagctggcactcaactaacatgaacataaaacttaggaaacgtgctaaaaccccacatttcctcacggatggaaattaactgtttctccccagaacaaaaaacacccgaaaaatgagagattattactataaaggaagaaatatcagatgacaaaataatatttttatgatgactttttttttttgagatagtctcactctgtcacccaggctggagtgcagtggcacgatctcagctcactgcaagctcagcctcctgggttcaagcaattctgcctcagccacctgagtagctgggattacaagtatgcaccaccacacccagttaatttttgtatttttagtagagacagggtttcacaatgttggccaggctggtctcgaactcctaggctcaagtgatctaccagcttcagcctcccaaagtgctgggattacaggcatgaaccaccacgtccagcctatgatcactttaatatcattaatatcctctactgaaactgaggtggccttaatacatatctctatatatttttacatatattaataactgatcacattaaaaggaaactttaaacaaaatgccatatatttcccaagactttcagcaacatttttctttgaatataataatatatataacaaaccttatattagtaatcgtttctgtccacaaatggtcaatacacagttcaggaacaattggctccgtttctggtgcaagaaaggagccattagaattactatttggagaatgagaaatactatgtctctttggagactgattatggcttgaaatgttgaacctttgcacccctgaaaaagagtgcactcctaacgcaggagaatgagcacgactgcaaaataaacagaggagagagtacatcacagttagcaaggcaggcttatatgacacacactccaatgacacttccaaaaattccacagacagaagagcattcatggcataatccaggtcagaaattaaaatttttcaaaaaggagtagctatttaaatggttcatgtcaatgtgctttactatattctaaagatttagaattattattagaagaactcatcttttacaactaaaacttagatcatcttctttttcggaaaatgaatgattattcaaaaagctctaaactatgtccctgtatagtcagacatatatatttatcaacaaaacaatgtccctgtagcaccagatatacatatctggtcatttaaatatatatctatatagagaaatagatacatttacatatcaaataacaagtaaaaaaaaaagaaaaactaacataaattaaggcaaaaataaaatagtgccacagtattttgggaattaatattcatcaaactgttgcccacatagtggtagaaatgaggcaactaaccttaggtcaagcataggcagcttcaaaatatgactcaggaaagaatgtgacatggtaaacttagaaatcttagtaaaagtggctcagggctgagcacggtggctcacgcctgtaatccccgcactttgggaggccaaggcaggcagatcacaaggtcaggagatcgagaccatcctggctaacacggtgaaaccccatctctactaaaaatacaaaaaaaaaaaaaactcagccaggcatggtggcaggcgcctgtagtcccagctggaggctgaggcaggagaatggcatgaacccgggaggcagagtttgcagtgagtcaagattgcgccactgcacaccagcctgggtgacacagcaagactccgtctcaaaaaaaaaaaaaaaaaaaaaggctcaattgggataatggctatttcccctaaaaaacatctcccctaaatatatttcccctaaaaacagctgtcaacagaaattctaaatccttcaaaacaaaacagaaagcttagaaagaaaaaccaggaaacccttataccttagagctgccatgttggaaatagaaggtgagcgagaatgtagactgggtgatgaggttgagcgactctggctgtgaatggaggagtaattctggaaaggtgaagtcacaggggaatctcctttggagaggcttctgagatgtgctgtgagggagctgctagtggccacattctgtggggttcccccctgttcagagaactttaaaacaacattctcttccttaagtc

SEQ ID NO: 357 - DNA, 1638 bp, Homo sapiens
acactgagagcatctaaccttctccaattcacaatattttgtccaaatatgttttacaaatccagttgcctcagctgggatgcttccatttgatggtctgccttatcacttttatcctgaccactgttcaccataaagtcctgtctatcctcactacctttgcataccttcccagctgcctttttggaattggccttggtaataagtacattgccttctgaatttcagtgattagttttaaaagaagttcctccagtgagaggttcattaagaaatgtggatgaatattttttagaagaaaatagggaagtctccatttggcagcttcctcaaaaggtgctgacttcagggtagaggagactaaccagttgtgattcagtcagtttgatgagcatttatttgtttttaatttctgccttgaggaattttttacttggaacaagaggagaaaacacatctttttaaaagatctatggagaataattgttaagagcagaaaagccaaaacaataatctggtgcctgaaagcggagactgtagtaattactaattagggtaagtttaaaataattcagtttatctgcaactcaatttgtagttcatccttttcttgagtctattttctttcatcttgggctctttttttctttcgctttcaattttactgaactttgaagtataatgtacataccaaatagtaaatagcatgatggactttcacaaattgaatactccatgtaagcagcaccctgattaagaaatgaccagcatcttagaagctcctcgcatgcctgttttcagtcacttttcctaccaccaagggtcgctgttatagactgacttgtgtcctccccatttttccccctacctgctctcaaattcttatgttgaagtcttaacctttagtacctcagaatgagaccatatttggaaatagtttttagagaggtaattaagtgaggtcattcaggtgggccctgatccagtctgacaagcatccttataagaagagattggaacacagacaggaactgagggaagctgttgtgaagacacaaggaaaagactgcccaaaaagagaggcctcagaagaaaccagccttggccaacaccttgattttcaatttctagcctccaggactgtgagaaaacctttgtttaagcattcattcggtggttttttatggcaaccctggaaactaatatagttaccctcctaatttccagtagtgtaggttaattttgtcttactgggttctttgtagaagtggaatcatgcagtataactcttttgtatctgacttctttcactcaatattatgtgagattcatccatttcgttagatttagttgtaatccgttcattctcattgttatgggaacagatactataatttattcattctgtcgctaattgacatttttacagcgtgtttgtacaaatagttcttctatgcacgttctaggacttatcattcttgttggatgtatattgaggaatagaattttagcttcatagaatatgcataggtttacttttagtagtcctggcaaataattttgagaagtcatgatagtatatgaaaattgcactactggtagaagtgtagtattatttctcttttaaatttgatgaga

SEQ ID NO: 358 - DNA, 33 bp, Homo sapiens
acagagacctgcttatttggactttgaacatga

SEQ ID NO: 359 - DNA, 5276 bp, Homo sapiens
acagagacctgcttatttggactttgaacatgacgagttcatttagtctatgtaaatgattagtagaatgatctagacaccatcatgagtgattccagctttgtaggtagagtgggaagattccattgatttatgttcctatagactttattgaaagaagtcctaaaaagctatggggtggtcagttttccagaagtctgagtttaatgacctgtgttggaaaacatgcaaagctctgatctcattccttatcttgccttgccctttccttcatctattcaaaattataacaggtgccgctttctggggggaaaatagggatctttattgtgtgtttataacctgccttgtttccagaaagggcttcaggtaggacagaaatctttaaatttaggttttaaaggatgcaacaagaaatctacatcaatcaataattgaaaagcatcaaatatcactttgtttgaagcactaaacactgagcaggcttgaagggatattctcagataagtcactttagagacagaaagcagttatgttggctgacactgttcacagcagtctcagagtaaacaatattgaggacttgtcagctaatctcccttcaactttagttttagaggggagaaatgtctgtgtgctttgaagctctgaccttcttctgttctcagggaatttcctcagggagagagatgtttgaagagatctgtaacaggtatatttaatattctactagcttatactttggaaattatgtctaagattccttttaattgtgacatgaatattgagcagttttcattttcattcacttttcacatcatgaactaatgttcatacctccctgggaagctaatgtcagatttttaaacttccttttatgtgattaggttgcttttgtgaaaggtggaagaccaaagctcagttaactaggtcactggttactaccaggctagtttagcggctagcctgtggaacaagaactcaggtgggagctgacgcttttgtttccaatctcccaaggtatgaaaaaggtcagtccacaagagttaggttgcagatttacatagctgagaagtggggagatgtcttctgcatgcccctagaactaagattccttctttgtttcactaaaacttttttgtgtaaaatatcatacagtactaaaacccatatacaatttatttgttttaagagatgggatcttgctgtgttgcccaggctggagtgcagtggcatgatcatagttcactctaaacttgaactcctggactcaagcaatcctcctgtctcagcctcctgagtagctaggactacaggcttgcactaccatgcctggctaattttttttttttgagacgggggtctcactatgttacccaggctggtctcaaactcctatactcaagtaatcctcctgcctcagcctctcaaagtgttgggattacaggcatgagccattgtaccaagctacctggctaattaaaaaaaatttttttgtgtggagatagggtctcactgtgttgcccaggctggtctcaaactctgggcctcaagcaatcctcctgccttggcctcccaaagctctgatattatagatgtaagccactgtgcctggcctagaatttaaatcatgttcgaacaagtaaccatatgcagccactgaggttaagaaatagaacattaccaccattgtgaaagtcagtgtggtgattcctcagggatctagaactggaaataccatttgacccagccatcccattactgggtatatacccaaaggagtataaatcatgctactataaagacacatgcacacatatgtttattgcagcactattcacaatagcaaagacttggaaccaacccaaatgtccaacaatgatagactggattaagaaaatgtggcacatagacaccgtggaatactatgcagccataaaaaatgatgagttcatgtcctttgtagggacatggatgaagctgtaaatcatcattctcagtaaactatcgcaaggacaaaaaaccaaacaccacatgttctcactcataggtgggaattgaacagtgagaacacttggacacaggaaggggaacgtcacaacccggggcctgttgtggggtggggggagcggggagggatagcattaggagatatacctgatgtaaatgacgagttaatgggtgcagcacaccaacatggcacatgtatacatatgtaactaacctgcacgttgtgcacatgtaccctcaaacttaaagtataataataaaaaaataataataacattacccacaccccagaaaccatccttaaatgctctcttagacattatttttccaaattccccaaaggtcactactactatcctaacttctgctaaaatgattgattttgcctaattttatttttatgtaaataaaatcatacagaaaaaaaagtaaaaaagaaatagaacattaccatatttcagaggccccttgtagcctctgccctcttctgcagaggtaaccactatcctgtttttttatttgtttgtttgagacagagtttcgctcttgttgcccaggctggagtgcaatggcgtgatctcagctcaccacaacctctgcctcctggcttcaagcgattctcctgcctcagcctcctgagtagctgggattataggcatgcgccaccacgcccggtaattttgtatttgtagtggagatgggatttctccatgttggtcaggctggtctcatcgacctcgggtgacccgcctacctaggcctcccaaagtgctgggattataggcatcagccaccacgcccagctgcgttctgtattctataaagttcaaaattttccatatattgtttaccttgtctcattttgcaccttacagaatatggaatcacatgggatttccttctctgacttgcttcctccattcatcattgagtgttttttccatattgacataggtagctgttgttccataacttttaaagttttaccatattttattttatgaacgtaccataatttgccccttctaggttgatggcctcctgtattgccatcttttgaactgattaaattttcctgtttgtgtttctcattctctttcttctgtttgtttggaagctatgctgtattcttttagtagatctttagctgtcttaacatgcatacttagtctattatacaggctaaaattaaacagtatttttatcctgctcctaaacaaatacaaagacctcagaactctaaatcaggtaaaattcttcataatttatcgtattttcttgttgtttagtgttagctacttttccacctacaaattaggcattctagttgttttacatagtcaacaatttagctttactcacaacccacatagttgcctgatgtctttctttgctcattgttccttcttacacctcacacctatttttgtcaggaaatctttttcttcctcattcttgaaagataattatacaagttatagaattctaacttggcagttatttttgtctcagtgcatttgaaagtatcattcttctatcttactggtctccatggttgttgtcgatgttggcagtcaaaattgcagattgccattctttttttaaatttagctactttagctttaaaaattttttgtctttgtatacagcaacttcattatgatatgtctagctaaggttttctttttatttatccttgggtttggttgagattcttagatctaattactactctttcaacaaataatggaaaattatcagccattatctcataaaacattgggaatattgtctttcccattttatttcatctacttctaaaactctaattaaatgtgtgttagatccttagactctatcttccatgtcttttaaactgataattttcaactctgggttcctgggctgcattttagttatttatataacttcaattttattaattcttttttttagctgtttaatctatcattggattttgaatttcaattctcttacatttctagaaattcttgaacttttccagatctactgtgttctttatggcctacatagactcagacccaacccaaatgagagaatatgtggggctataaattgaaagggacatcttttcaccctccactcattgccaagattgagatactcaagttaatttgctgctccctctggacactgagttaatttcttgtccatcctcacattgaagggatggccttttaagatcccagctttacatgggtggtttcctgttagactttcaccttaaatgggccctttgctttgtctcccaccaccctgtacctagatgaaagcttgacaaaggatttgggtagatatttctccaaagatatacagacagccaataagcacatgaaaagttgctaaacatcattagtctttagagaaatacaatccaaaatcacaatgagataccatttcacacctataaggatgggtataattaaaaagacagtaacaagtattggcaagggtgtggagaaattggaacaaatgtgtgtgtgtgtgtgtgtgtgtgtgtgtgtgtacgtgcccaggctggtctcaaactcctgggctcaagtgatttgcccatctcagcctcctaaagtgctgggattacagatgtgagccactgtgcccagctaaaacatttttaaacatgttgctgagctggcatgaaaagaaagtatcccaagatatgtgtatgtatgtgtacacacacacacacacatatatatatacatacacacacatgctttctcaaggtcataaatgttcatcgcagcattattcataataggcaaaaggtagaaacaagtcaattgcccactaactgatgaatgaatggataaacagaatacccgtacaatggaaacttatttggcaataaaaagaaataaaatattgatacatgctatagtattgatgacccttgaaaacattatgctaagtgaaagaagtcagacacaaaaggccatgtattgtcaaattccatttatgggaaatgtccagaataggcacatgcatagaaacagcaagtaggtgagtgcgttagtgcgtgctgggagagggaggaatggagagctattgctgatagatatggagtttcttttggggatgataaaaatgttctgaaatcggatagttgtggtagttacatacctctttgaatagtctaaaaattactgaattctacactttaaacggtgaattttatgatgtatgcattatatcttgaagtggttttaaaaaaagctggaagc

SEQ ID NO: 360 - DNA, 1369 bp, Homo sapiens
tgagatctcccaaatactaaagagatagaaatttagatacattggagataaacttcaagtaagctattttttcactattgcataaatgggaagatattttcattgaaaataatgttcctttactcaatcacccaatatttattgagaaaccacctgggccagacattgttctgaattctgaagatcagagagtgaacaagaagcaactgactttgttttgtttacagttcagattgaacaaagcaatggcaacagagaaagaaagagaagccatttatggtttgtgataaatgctgtgaaggaaatattttctgatagagaatgaatggaaaacttcctttaggcaaagaggacaggaagggcctccttaggtgattgtgtctaaatgagtcaagcatgtcgagggttgaagaaagggtgctgcaggcagagagataagagtatgctaagagccggtgaggacactgaacttagctcttcctgggaagtggcagccccttgagttggtgcagtgaccagggtggacatgtgtagtataagcttcagggaagaggtgagtagaaaccagccagcccctcatgggtctggtataccactagagtgcgtttggaattaattgtaagcacaagagaaagctgttgaatgattcagtcttcaacaagggaacaacatgaacagattggtggttttattttggctgccatgtgaagaatggatgacacgacactcgcatagaagtggaagactagtctagagtttggaagatagcacttggacgtcctgctggatgcctgccattaccctctggatctgccctccaccctttcctcgcctgttgcctgcctcagaggctggcttacatggactacggcccagggctctctagcttccagttagtttggtcaatgggaaaccccagccagagatcagaagggaggagaaagaacttaggatattagtccctcagcaccctgtcacctccaagcagagtttctcacaggttggttgtatcccaccacccagggctgctggtccttcaggtggcctctgccaaggggcctgtcacacagctctccctcaggtcccaataaccttccctctcctatgcctctttcctcccctttacccttcaggagttgagtagcatcagaaaacgctgcagctagccccaaggtactgcactctgtcttgtagtttgaaaatgctacctttgttaaactctagtcaaattacccaatgtatggatgccatctgtttcctgtggggctgactgatacaggaagagagaagcaagatactattttgacacgttcagttactgtgatccttgagtaacattctgtttagcttgagttcatataactcaaaa

SEQ ID NO: 361 - DNA, 332021 bp, Homo sapiens
ccatcaacacttgaactttacaaatgatcctatttattctaccacctgctactaaatgatgaaaaataattatcaagtgagttgccgaggcttcctgctcttatttctcttaccatgttctcagatatctgactgctagctaatgtctctgcccgggaacaaaagaagccagagaaggagaaagaggaagctcaagttctcccatattctctcttttcaaaagttacgaagagtagaaaatagtttaacaaggaagtttagagattacatgaaaattgtaatgagtctgatgcaccagcttccaataccgtcatcacaaccagcccttccttggtggtagttatgtattggttgcacctgatacctaagcagtagtctgctctcttttgcaataaatcacatctgtctctatgatagactctgacctcagcctaccaacagcatgttttttaatgacactggcttgcaaatgcatctgatttgaaataaactttctttgtaccatttttaggttctgtacttttgaataaaggtgcaatcacagcaaatcaaattctcagaagactacaataagtaaacattaagcagtgttcctttttgaaagcaggagagagtatatgtttaggaatgttcaaggattagtctggttcttttttaagtttttatttattgattttatcttaacagcaaaatacaatgcctggctagagcctttaaatacagataaacaatccaaacaagctgcaacttacgtatatcaatcttctaagatcacctcagaaaagagaaggtggctcccaacttgtcccaagttaaatacatttaagagaagcaaatgggaatagcagctaaagctgacggacagggcaattcgaggcatcagatgctccctttcaggttgctgagatgcttccagatggttcctgtatctgcatggccaaagtggtataatttattttcttagctttttcaatctctctgcatattacatcacaattttagctcaagtttatttttgttgtgtgtatttgacaatcctttggtggtgtggaacttaaatcatcacttcccagagcaagaaaacaaaggctgacacttctgatatagaaggctgcaatctggaaaggacgatggttggaagggcaggtggatgattgggaccaccactaggtttattctttatttgttcaacatgttttcattaaattagggtacagaggtggacaagtcagaagcagtctctctcattatggagtttacactctaccagaggtgagaatggaggacttaaaggtagacaaaaatgcctaatgtgtcacctagagaacacaaccaaaaatgagttacccaacaacttcatacagctgctacctgcagttagtatgtacatgccaggtaagctaggaagaggcctacagcctctcctggaaaatcttgggagaccaaataggttttgatcttgaccattccctgaaaatcctcatctataatcttcaaatgcaagaaggaaccaggaggtgccattatgtttcaccacaagaactcattttttttaattactgtttttttcttttagtgagcataattttttcttttgttgttattgttgttattgttgtttttgagacagggtctcataatgtcacctaggctggaatgccgtggcgccatcttggctcactacaacttccgcctcctgggttcaagggatcctctcacctgagcctccatagtagctgggattacaggcatgtggcaccatgcccagctaatttttgtatttttttggtagaggtggtgttttgccatgttgcccaggctagtctccaactcctgggctcaattgatctgcccgcctgggcctcccaaagtgtttggattacaggcatgagccactgtgcccagccaattttttaattacgtaaattaaaggggtacaagtgcagttttgttatatggatataccgcatagtggtcaagtctgggcttttaatgtaatcaacacctaaatagtgtacattgtactacctcactcccctcccaccccatcatcattctgagtctccagtgactattattctatactctatgtctacatacacacattattcagctcccacgtgtgaggacatgtggtatttcactatgtttctgagttttttcacttaagataatgacctcctattccatccatgttgttgtaaaagacatgttttcattcattttctgtggctgaatagtattctattatgtatacatatatacacacacatatacataaataaaatgtgctgtatgtatatatgtgtatatgtatatacatgtggtgtgtgtgtatatatgtgtatacatatgtatatgtgtatgtgtgtgtgtatatatatacatatgtatacacttatatacacacacagagcacattttctttatttaatcatcttgatttttttggaagagtttcagtaggatgagtatcagttcttctttgcacattttgtagaatttggctatgaagccatccagtcctgggcattttagggggaaggttttaaaattattgattcaatcttactattcattattggtctgtttaagatttctatttctttctggttcaatcttgggcagtcatatgtttacaagaatttgtcaatttcctctacattatctagattgtgagtgtacacttcttcatagtagtctctgatcatcttttgtattcctatggtatcatttgtaatgtcttctttttcatttctgacttttatttggatcttttcttggttagtacagccagaggcttatcaattttgttcatcttttcaaaaaaccaactttttgtttaacttatccttggtattgttatcttggttttcattttcattttatttttatttttaacaaccaatttatatcattcaaacagatagaactgccttgtgcttgtttcagccttgttttctggttattaaaagaagacctgaaccagatacaaattcaccatattttccttcaaggacacttctcataaaagctactaatatgcatattttggcatacaaaatcacatttgctaaaacttttttctgcttaaatacaattcttttttcatttagcaactgcatgttattatagaggtcaattcattgggttataagagaaaagaaacacttattgaagattcacaacatacattccattatatatcgctgttcaatagaatgcaaaattagtaaatatcacccctacaattggaccatgtaactgatagattttcctgtaaggagttaccaaaatgtcatcaaaatctagagtttgacaatttccaggccttatcctgaccttctcaatgcaagttgcacaaatgaaatcagttatccaagagaaaaactgggatagaaataggggttaatagattatgatcctaagttgaaaaatacagagctctcagtttccaagatttaccattttcaagtgtccctaattttgtcccaagagtggctccagcctgggcatgacagctggctgtaatggggacagatagctctttctttctaagaacaagatttaccatttgttttgtctgctctctccacaagctcttcctgaaacatatcagtggcataataaatatcatctcgttttccatcttaaggactttagtactcaaaggtaactgttttgagtccttaaaaaaaaaaaacaagcaaaaaaaaaagtggtttgcaaacttttgtctgtgacataacaccaaagccgtagtaaagtcaatgataataataataataggtacttacttgggctagggactgtgctaggcttcttttcattcattatctcatttaatattcacagttcctacatggcttagtatttcttgcagaccctttaaatgcttacatatagaaatctgccctactatttcaagtataggcagaagttggcaatacaagaaaagacaaagggataagaatccgtccaactggacaaaacaacttcaatccttaaaaagtcctacccattttagaaacaggtcaatgaagctacctgttatgattgtagaagtcatgtctgcttactgcacctaatttgagaattacagaaaaacatttttaaaaatcacatattattctatcactcagagataaacattgatagtgtttttatagttcccagtcttatttatatatttgccttctttttttgctatttgtttaatttttaaaccaaattcggattacatagcaatgcaattttcccatattattagatataatttttgaaagattttaaaacactaccttatgttccataatttatttaacaatttcactgtttactgacagataatttagagtacttaattattctataaatactataataccaaagtataataatgaatttttgcctgcatctctatttctttaagaaagatttctataaatgagattactagatcaaaaaacattaaaaaattctttttctagggagaatatccccatgcccaattccactacatttgccaactagctgaaaatgatggggttttttttgcatgttttaaattgttatataatggtattagattgcattcttctgaaactcattttcaaaacatctttactcaacatatatttatagttattcttgttactatatgttgtttttactcattctttttttgcttttcgaaaatcgtctcttagttgaataataatatttatgtattagctattggtgaacatgtacgttttcctgaattatcaaaaagatactattgtaagtatgttgtgcacattccccttggcatgtgggccatgggagttgcatgtcttcaactattctggatgatgccacactatattccacagtggctgtaccagtttgctctgtgaatgataatcttcattgctttacaacctctccaacacctagaattgttagatttatttttccctttaattttgacaattggatagatgtaaaaagctatactgtgctgattttagaaggcatttcctgattacttttgcagttgtacattctttcattcattaattgtccatttctgttgcttctccaatttatgtttcttcagaccccttagttatttttctattgatttttatttctgattacttgtttgtattaactctttttatatttcatattaattttctactatgaaacattctgcaaatacaggcataacctgaatgatgttgcctcgattaacattttcatggtaaaatgactcttggtttttaaaatccaaatttcatcatctatttttttttttttgccaatgttcatgtagcaaaactttagatttataataccaaactctgcaaaactttcaataaaaggaaatataggaaaatcatcaagatattttcaaaacatattcagtagaacatcagaataatatatagatattttggaaagcaagctgagtgacaacacacgaaacacccatttcagaagttgctgatgctaaaaggccatcataccatcagtgtgagccacacttggccaccaggcactagagcacatttcccagtgccttccccattttactttttttgcttattgttgaaatccccaaattgttgagaaaacactgaagacaattgtagagaagaaaacaaaacaagtgagaatagctactacgtacaaagcaaacattttataacatgttaattgtagaagtcatcaaggatataatttttttaagtacaagtgatcgaggatataatttttttaagtacaggcataccttgttttactgcactttgtttcattgcacttcacagataatgtggttttacaagttgaaggtttgtggcaactttgcatctagcaagtctattggcaccatttttccaacagcacgtgttcatttcacgtctatgtatcacaatttggtaattctcccaatatttcaaactaattcattattattatgtctgttgtggtgatctgtgatcagtgatcttagatgttcctattgtaagtgttatggagcccaatataagatggtgaactttatcagtaaatgtttgtgtgttctgactgctgcactgactagccatttttccctctcctcaggcttccctattccctgagacacaacaaattgaaattagtccaactaataagcagacaacagcttctaagtgttcaagtgaaaggaagagtcccatgtctctccctgtagatcaaaaattagaaatgattaagcttggcgaggaaggcatgtcaaaagctgagctaggatgaaagctaggcctcttgcaccaaatagccaagttgtgaatgcaaaggaaaagttcttgaaggaaattaaaagtgctactccaatgaacatacaaatgataagaaagtgaaacaggcttgttgaggatatgggaaagtttgagtggtctggatagaagatcaaactagccacaacattcccttaacccaaggcttaaaccagagaaaggccctaactatattcaattctatgaaggctaaaagaggtaaagaagctgcagaagaaaagtttgaagatagcagaggctgattcatgaggttcaaggagagaagccatctccagaacataaaaggcaaagcaggaagtgcttatatagatgctgcagcaagttatccagaagatctagctaagataactaatgaaggtggctacactaaacagcagattttttttttttttttgaaacatagtctcactctgtcactagggctggagtgcaatggtgcgatctcagctcactgcaacctctgcctcccgggttcaagcaattctcctgcctcagcctcccaagtacctgggattacaggtgcccaccactacgccctgctaattttttgtatttttagtagagacatggtttccccatgttggctaggctggtctcgaactcctgacctcattatttgcctgcctcggcctcccacaatgctgggattacaggggtaagccaccacacccggccaaaggcagattttcaagagagatgaaacagccctctgttggaagaagatgccatctaggattttcctagctagagaggagaagtcgatacctggcttcaaatcttcaaagaacaggctgattcttttgttagctgctaacgcagctggtgactttaagttgaagccaatgctcattgaccattctgaaaatgctaaggcccttaagaatgatactacaccaactcttcatgttctctgaaaagaaacaggaaagcctagatgacagtacatctgtttatagtatggtttactgaatattttaagccctctcttgagacctattgctcagaaaaaagattcctttcaaaatattactgctcactgaaaatgtacctggtcacccaagagttctgatggagatgtaaaaggaaatgaatgttgttttcatgcctgccaacacagcatccattctgcagcccatgggtgaaggagtaattttgactttcaagtctcattatttaagaaatacatttgtaagactatacatagtgatttatcagattgatctgggcaaagtaaaatgaaaaccttctggaaaggattcaccatgctggatgtcattgagaacattcatgatttatgggaggacaacaaaatattaacatgaaaaggtgtttgggagaagttgattccaactctcatggatgactttgaggggttcaagacttcagtggaggaaggagctgaagatgtggaagaaatagcgacaactagaatcagaagtaaagcttgaagatgtgactgaattactgtaattttacaataaaacttgaatgagtgaggagttgcttcttacgggtaagcaaagaaaaggatttcttgaggtaaaatctactcctgaagaagatgttatgaacatcgttgaaatgacaacaaaagctttagaatattacataaacttagttgataaagaagggttggagaggattcactcattttgaaaggagttttattgtgggtaaaatgctggcaaacagtgctgtatgcaacagagaagtcattcgtgaaagcaagaagccactgatgttgaaaactttactgttttcttactttaacaaattgccacagccacttctgccctcaacaaccaccagtctgatcagtcggcagccataaatatcaaggcaagaccctccaccagcagaaagattatgacttactgaaggctcaaatgatcaccagtatttttagcaaaaaaaatttttaaattaagataacatatttttttataatgctattgcatactagactactatagactgtaaacacaacttttatattcactgggaaacaaaaaagtttgtgtgccttgttttattgcaatattcactttattgtgatggtctggaagtgaacatgcagtatctctgagatatagatatgcctgcattttaagtctcagtgtgacattattgttctactatggttattttactgtgttttacttacacttcaagaaattcactagagggttggtttgacatataacacattttttcccatttaagtaatggcaaactgtctcaaggaaatcatttttgggtaatacatctgatcatcaggaatcaattagtaacatcaaacaaggggtgtctatatttttttctcagcatgttccttatcttttctttgtttgcttgtttgtttgttttctattttacatgtctcatttaatcctggaaaaatgctataaagtagctagctgattctatcttacagatgagggcactgagattcagagaggtcagtagctggctttattatcttcttcactgtggctgcaataaaaaataaccacaaactttgtggctctcacagctctggaagccagaagcccaaaattaagatgtttaagagcaaagatccctccagaggctctaggagggattccattccttgccactttcagcttctggtggttggtgggactcttgtaatagcatttaggtctcccaaaataatccaggatgatttcctcatctcaagatcctcaatttaatcatatctgcaaggaccattttttttgcaaacaaggtcacattcacaagctctagaaatttgatgtggatacgtttgcagagccaatattcaacttggcacactcaccgaaggccacatagcagaatacggtgtcaagtccagatataggagttccagactccagagttcatgttctttccactccatgtgcggttttccatcacattgtgtgacctgtcgtctccatccctcctcacacctcagattcccttagtcttcccaacctcagagtgaggttaatactctgttctctccgtgccagggtctcttccaaggagagtattcaagagctgtgccacccctttacaaattccattgcgcatccgtgacttcctttccaatacccagacagtttcctgagtctagttcacagactagatcaccaaagcaaccttcctgggagtaaatattacatctttcccattcatattagtttctcaaaagtgctcaagagcctgaagaatgacagaagagaaatgctaaagattgaaggagttcagaacacaatactccaaaatatgttgctctagtatattgactattttgagcttaaagacacttggaaaaacagcagatacaaaaaatatactctgagctttcttcttttccttagaaacaggagataacttgtcctccctacgccagagggaaagtagcgttcttatcatcaaagacgagaagttgatgctgagagaaatctgaacaaacacaccttattaaagtaacccttatcttcctagttacttctctacccaattaacctccctagcccaagcccgttggctttgtcacatactcacaattttctattcctttcccaattcagtacataggtgttcaactttcaactctgtctttgggtttcatttccttaagagggctcttgtgctcacataaaaattgaatgaattaaatttgtatgcttttctcccgctgatctgccttatgtcaattcaatcctcaggcccagctaaaaaaccctaagagagaaaatttggcctcccctacaatgtcatcctctttcttttttctggaccttctatctgctggtacttaagatactaaaatggacgggagaaagaaagcaaaccatgttatgtcttctgcattggcctggtacactccgtttgaaggttactcgaagccagcttgctttttgtcaagagattgcttgatctggagccatatagaaaatggtgacatctccaccccgtgacatatgggccagtaagggcttgcaaagttccattctgcacacttctcttcattctaagaacgagtattcattccatttaaacacatattaccaggaattcaatccaacctctctttttacagtctacctagaattactattatactatttacatacaatatggaaacctcacacatgtatgaatctatttacaaactccctctaaattcaagttgtcattgaaattacatctacctgtattataaatcccataaaaatgatgctatagtttttacttaaacaaacatacatattcttaaaacattaggaggaaaaaattgatttttatatttatcttactatttatgatttctttatttttacataaggatctgagttttcatctattttttcttgtcatcccaaagaacaaagcattttttacagtgtaagttggtctgctggcaataaatattctgtttttgtttttctgaatgcaactttattttgactccgttcctgaagtatgagtatctttggatatggacttcgggattggatagtcatatctccttacagcacattgaagatattgtttcattgtcttcttgctttcatagtttttgaaggtaggttggcagtatttagcagtgcagtttcatgtatatagtgtgttgtttttctccggctattttcaagatagtgtcttgggttttcagcagtttgattacaatgtgcctcagcatcttgaacgtgtacatttatctctcaccaattttgggaagtgtgtggggccactgtttcttcaaatattaggttggcacaaaagtaattgtgggttttgtaatgaaaagtaattgcaaaaccacgattacttttgcaccaacctaatatttttatgacccattctctatcacctttccttctggggaaccaattactcatatgttaaaagaattatcccataggaacctgaggctctggttgctttttttttaatcctttttaaaaatacaatctctgttcttcatagagaaaatctatattgatattatcaaattcactgactgctttggtctgcctgtgtatgtatattccaaaggtcagccagagatttgagcagaatttacaccaaaaatttgtaatgctccttttctggccctctttttaatgacattcctcccttactttccagtagctggggttgctccaaactctgtcccctggttcataaggccagaaagactgagcttcctacaggagtttcagccactctgtgtggccctacctgtggcttgacctcaggataatagtcataagaaatttaacctatactacttccaggtgtcttcaacccccttcgagaatcttgctgcctttgttcattcttcagatccctcagagagttttgttgttgctgctgtttgtgttttgtgagggtttacagactacatgggaagcagaaattgttctttgggatttaacttttacaaaaatcacaagcactcatctcatttgtggcagtgaaagtaatatttacaatgttaacgttaaataacataccttgctacaggtttccagtaaatatcttgtattatgctgcgtaagctcctcctatttctagctcattaaataaatattatttgcttgttggtcttatttaacagaaaaaaaaggagtctctatttattaattcattagttttattttccacagattgattttgttactctcctttaataatgaaagttctcagggctattaattttctgctaaatacagctttagccatttaaaatattgatacatagagttcttactctcctaacagtttattatatagtttcctttcctgtttgaatctggagtttttagaaaaaaatttggtttttgttatcattatttctcttttccaagctactgatttttgcatttaaacttttgctattaatgtctagctctatttcagtgtaggcagaacatggaggctgttaacactttatatttcataatttaatatggtttctttgagatataatatatgatcaatttttttctaaatgcttcatggctccttaaaaaagtgtattgcttatttctagagaacaaaatttaataaatatttattaaatcatctttgttagattattaaaatattctatcaattctgtgtttatttgacccatgaaagatcaataaaagtgtattaaagtgtcatacaacaattctacttccatcaatttttccttatatttctaacagcctttgtttcatgtattttgaggctgttaccaagtcaataaaaattcagaactgccttatcttcattgtgaagtctatcttaaagaaaatataaccttcttgattgcatttaatatttttatagcctttgattctatttcatctaaatattgccaagattacttttttttttaatttcgcttctgcctaataaatcttgtccattctattgttctttcttttttaatctaatgagttactttgttttaggtatatttcttctcagtaccctacagttagattttgctttttagctgaaatatacagttgttgtattttaatagactagtttaataaacatttcacaatgagattcagctttacacaatgctttcacatttatatttcctcttttcaacatatcaggtacaggggaaatgtcattcctatgttatgcataaggaaattcaaagccagataggttagatgcatttcccaaggtcattcaggtaatatatggcagtggcaagacttaaccaaaggatgataatactaagaaaatggctttttacaaacatatactatccccttgctgaacatcaatattcagatagactatttggtcaaattatgttttgtgtttttttttttgtttttttttttagacagagtttcgctcttactgccccagctggaatgcaatggtgcaatctcagctcactgcacccttcacctcctgggttcaagtgattctcccgcctcagcctcttgagtagctgggattacaggcactcaccacaaggccaggctaatttttgtatttttagtagagttggggtttctccatattggccaggctggtctcaaactcctggccccaggtgatccacccacctcagcctcccaaagtgctgggattacaggtgtaagcccctgtgtccggccatggtcaaattatctaatttttcttccactgggggactttatactatttatttttattgccgtaaatgatatgtttgtaacactgtaatcttatttcatgctttgtgtagtttatgctttactcttttttctttgttttatatactattggccctccttgtctgtgggttccacatctgtggattcaaccaatcatggattgaaaatgctcagtgatatggtgtggctctgtgtccccacccaaatctcatcttgtagctcccataattcccttgtgttgtaggagggacttggtggaagacaattgaatcatggggggtgggtctttctcatgctgttctcctgatagtgaataagtctcacaagatctgatggttttaaaaacaggagtttccctgcacaagctctctctttttgcctgctgccatccacataagatgtgacttgctcctccttgcctttcaccttctgccatgattgtgaggcctccccagccacgtggaactgcaagtcaaataaacgtctttgtttgtgaattgcccagtctcaggtatgtctttatcagcagcagtaaaaaggactaatacactcaggaaaaaaaaatggcatctatactgaatatgtacagacattttattgtcattattccctaaacaatacaactatttatatagcatttacactgcattaggtattataagtagtctagagataatttaaagtagtctgtaggttacatgcaaatattatgccattttattccagggacttgagcatccacaaattttggtatctggaagcaatccttcacagataccaagggacgacagtacttggtgatttagatcaggctgcacattcttttctctctccattggtttggaagtcatgcatcctacttttgtttctaatagtggcacctggtatatcaaaaagaatattaatatttgttgaacgaatacattttaaaactttcaaatatttagaatatttgagtctacccctagaaaaatgagaatttgtcacaaatttatttctggaccttgtaaatatgatcctgggtttcttattgcttagtgttaaatattaaggtattaaatatttaatgcttattaaagcattattttgtgtgacatattttctctttcaaaagcatagttttacatttgcattcagtattataattaaagttacaatcacttaaatctcactttttgttaacttggtttaattattaacaaccagccacttctctgttactgaattcttttgttgttgttgtggttgttatttagtttttatttcataatcataaacttaactctgcaatccagctaggcatggaagggaacaaggaaaacatggaacccaaagggaactgcagtgaaagcacaaagattctaggatactgcgagcaaatggggtggaggggtgctcccctgagcaacagaagaaatggtctggtggttaagataaaacacaagtcaaacttattagagctgtccacagtcagcaatagtgaccttcttgctagtcttgccattcctgaacacaaagcgctccatggcctccacaatatccatgccttctttcaccctgccaaagaccacttgcttgccatccaaccacttggtcttggcagggcacatgaaaaactgggaaccatttgcgttgggtccagcatttgccatggacaggatgccaggacctgtatgcttcaggatgaagttctcgtcatcaaatttctccctgtagatggacttgctaccagtgccattatggcatgtgaagtcaccaccctgacatacaaaccctggaataattctgtgaaagcagtaaccctcataatcaaatcctttttctccagtgctcagagcatgaaaattttctgctgtctttggaagcttgtctgcaaacagctcgaaggagacgcagcccaagggctcgctattgacagcaatgtcgaagaaaacagtggggttgaccatagctggtaatacggggctcccagtggcagcaccatctgtgaagtctctgttactgaattcttaacttcaatttctctctcagttacctgggcagtgcttcctaaatgttagtatgtttaagaatctcctagagagactgttaatgcacagattgctacagttcatccagagtcctaactgttctaagcagtaggttttatagcaatattttgtaccatatagtgtggccaaaaaaaaaatatctgattttttgctcctttataaggctaactgttttgtttgcctgtgtgtgtgaaggattttttttactttattctttaaaaaattaccaagttgaaatgatataaaacccttttcattaatgttgcctggagtacggaaagtcccttcaatttttgttttttggtatcgggttttgtttttgtttgttcgttgtgctccgaagagcttttattaatctttcactactatttgtgttctaattgcttctgcctcaagaacatctgtgattcttactttggttctgggtgttcaaatctatgatctctattttctatatttttaatcatctcttttgttattttaatttttattgcacctgttcatttcaacagaaattatcaatttttttcccctcttgattttttctttttcttctttttttttttcttgagacagggtctctgtcatccaggctggagggcaatggcacagccacagctcactgtagcctccacctccccaggctcaggtgatctacccacctcagcctcctaagtagctgggactgcaggtgtgtgccaccacacctggctaatttttgccttttttgaagtgacaggtttacatgttgcccaggctggtctcaaactcctgggcttgagcaatctgcctgcattgtctcccaaagtgctgagattacaggcttgaggtaccacacctggccatgagtgttttttaaatagtgatttcttttcagcttccaacacagacttcaattgtgttatgacattctggtctctttacaatattttcttgactaatccatctccttttccaaataatcctactttttacaatctaaacttattctctcatttcactttctgtttcctgatgctgttgaggatgacaaaaaatcccttcagatttctgtgacatatcatcttgggaggtcaacatttactctgagtctctgagatactgttcccttttccttgtccataatgatttctttttactttagtttatcatgaaagagaccgtgtttgccaagaaaaagatgaagattgtctttatgtgtcacttaaacataaatctcttacagctaaatgacatgttggtttacaaaacttatatcctaatttccatcctctagcaggttttccacctagcatacctgttgggattggcatagactcatcttgtatcactacctgcatctgtattatgaaaaacaacaatccccaaggccctcgtagtttcagcatagatatagtgctttaactgtgacagatcctgacaaacatatttccaaaaatattactgccctatttagtaagcaggataatggtcttccaaaggtgtctacatcctagtccctaaaatctgtgaatgtgttagattacatggcaaaggaaaattaaggtagcagatagaattaagtttgctaatcgtctgaccttaaaacagggagattatcctccagtaccagggtgggaccaatgtaatcacaagggtcattaaatctcaaaaacagaagtagaatagtcagagcaatgcaataggaaaaagagttgactggccattgctgatattgaagatgaaagggggccacaagctaaggaatgcaggcagcttctggaaggtaggaaggacaaggaaacacattttcccttagagacctcagaaaggaattcagcctaacatcttagcccactaatatccatctatttcaaacttctgacctcccaaactgtaaaataataaatctatgtcattttgaacctcaaagtttgtgttaatttattacagcagccacagaaaactaatatatgaccatttatttgagtaaccactatttgcattcttcacatgcatatgcaaaagatgtcttcattaaaagtgatgcttcacaaaagtacttacatgcatagtaattcttgttcacttttctgattagcgtttgcatgtttctgaagcaggggaaagatagcagccaaatgattaaaggtcttccctctgtttggccacagcataagggaatcacctgttgaaattgttcattctagttccaccaaacatctcattagtagaattctctacaagaatcaagactagcttgactataaaaacaaatttttagtggcagcgacttctttttggcatatatcttcttgagtatttttatagaaagttgaaccaggtataatagaggctactactccaatatgaatttaatttcattcattcttcaatcccttcttggataaggtgctgatccacctaagtcactccctcataagtgaatgcaaacttaagaaattataccttcataaaatgggcatatttttctaactgtaaaaatgttttctttaaataggcatgactatggcctgtctattttaatttcgtatagcagtaatttcccttggggaaggagtaaaagacaatattttttaaagtttctctctatctagataggatgctagtagaagcaagatttctatatgttctgatgtgaccaagtagatatttctctactcaccagcctctgaaaatccctgtgtttacccaagatttaactaaagaggctaaactcgtgggtaaatattaagagggaattgacaaaggcatattaagtctaaggagtagactatacttttctaaaataaacacataattacagagttaacacagcagcaccttctgccttgtcagtgctgaaggccccatggcagccagtactcttcacttgacctcgtcctgcaaactttctgtacagcagataaaggcccaaagtacactatagtttagtgaatagcataaactcattcatctgtaagtactagatattacaacatcaggcttctcactggtcctactataaaaataattttatgcttgcacattggacacaattgttctggtggcatagctctttagctacaccagcactgaatagaaagaggcatcctctactattagtctgcaacagaacccagcatttccaccattgcaaacatcaaactggatgaagactttttattcccagcaggattaagtcaaaacatagattgacctaggagaagaagcattagcccttgtcaaataagtataattacttgatgacattggttagtaaagctgcaaagaatactgaggaaattaaaccagctaatttgggaaagaccagaaaggcaatatgaacaccataaaaacatgggtaaggaacagtaagatgctgacctttactgttttctctgggcatgatcctgcctggcagagctatgtttaggctcctcagaaaacccgatgctctctttgcattactagccaatgtgaagcaacattaaataaaaaaaaaaagaaaggaaagaaagaaagaaaacaatcagagaaatgcaaattaaaaccacaatgagatatcacctcacaccagttagaatggcgatcattaaaaagtcaggaaacaataggtgctggagaggatgtggagaaataggaacacttttacattgttggtgggactgtaaactacttcaaccattgtggaagtcagtgtggcgattcctcaaggatctagaactagaaataccatttaacccagccatcccattactgggtatatacccaaaggattataaatattgctgctataaagacacatgcacacatatgtttattgcggcactattcacaatagcaaagacctggaaccaacccaaatgtccatcaatgatagactggattaagaaaatatggcacatatacacaatggaatactatgcagccataaaaaaggatgacttcatgtcctttgtagggacatggatgaagctggaaaccatcattctcagcaaactatggcaaggacaaaaaaccaaacaccacatgttctcactcacaggtgggaactgaacaatgaaaacacttggacacaagaaggggaacatcacacaccggggcctgttgtggggtgtgggggtgggagggatagcattaggagatatacctaatgtaaatgacgggttaatgggtgcagcacaccaacatggcacatgtatacatatgtaacaaacctgcacgttgtgcacatgtaccctagaacttaaagtataataataataaaaaaaagaaaaccattaaaacactttagaaatatataaaggtaggccgggtgctgtggctcactcttgtaatcccagcactatgggaagccaagacaggtgaatcacctaaggtcaggcgttggagaccagcctggccaaaatggcaaaagcccatctctactaaaaatacaaaaatttagccaggtgtggtggcgggtacctgtaatctcagctacttgggaggctgaagcaggagaatcacttaaacccaggaggcaaaggttgcagtgagccgagattgtgccactgcactccagcctgggcgacagagtgagactctgtctcagaaacaacaacaaaaaagaaatatataaatgttttcatttgtatgagaacttatgaaatagtgattaagagaatgggctccaaagtcaaactgtgagggttcagatgctggtcttccccttgtagaaatgttatgtaaattatttatgcttcatttcctacatctgtaaactgggggataatactgttacctcactggctgctttgggaggatcagctgtgataattcatgtaaagcttgtagcagagtgcctaatccctaacaagagttcaacataattgctgctgctgctagggagaggctgcaaagcattctgggtaagaacagggacgctgggacaagattgtagaggctctgccattgacaagctgtaatcttgagcaacgtatttaacttctttgtacctcacttccctcacctacaaaatggaagtaataataaccattatgagggttgttgtgagaattaaagagttaatatttgttaggtgtttagactagtatctgatacatgtctgacaaactattcagctgtacatgaatggttttaaagctgtgattatggaaaaccaagggctttgtacggaggaatggagataaggagagtgtgcagcccagtcccactctgtatgcaaacaaagtaattctagctcttttacatatttaactttcaagcaagattttctttgagtaaagggtaatgctgctttaaaagaagaaaggaaggaaggaaggaaagaaggaaggaaggaaggaaaccatggctctatatgtatgagcctcatataaaatatatcagtacaggtcttacaaaacactgaatgtttttatacacattccctagcagatttaaccagatcagttttaaggttccttctagaaaggaagttctccatacgttgaaaagtgaatttcagtacattcaaattttaaagacacgacttcccatacttcttcagggtaaacaaaaatctcaataattctaatttaacatgcaaaagccatgaatattcactacagtcaaatgaataataaatcacccctgggttcaagtgcttgccatgcaaaattgcctatttcctagaacatccagaaatctgtttttaaattgctttttattacttttgctcttgtgatggttgctcttcaaagcaacttggaaaaatgtgccattctcagcattaaggcgataaaggagaagtgaggacagcagaacacggtgccatccacaaaaggaaagagagtctgtggatcagagggctgggctccggaagacagtttttaaatgtcactagataaaatttatgagataaaagggaatgttccttagtcatcctgagcattgatatctacatgaataataaatcaaaaggctctttatccatttactggtaaacattacgaccttaggttgaagatgtgatttactccactgatatcaacacaacagaaatccagtgaaagtatcactggactggccccaagttctggaaaatcaatgatgcgtgggagaacaaacattttgaggggaagagtatttttttaaaagtaaatatttgtggcactagcaacatgagtgcactcattaagatttcttttaaaggattaccctttagtctctcctacatggaaaactcaagtatactcaagttgtcaattgtataatttgatggaaagttatccctagtattttcccccaaattggattgaattattaatatttcacctttacaaatacatgcagtataattcaatttatataaaatttaaaatatacagaacttacagtgattgcaagtacctaagctggtaataaaggtatcaattaatgaaggaaaatggatatgtcaaaggacaggatagtgactacctctaatatgatcagagagagggttcagatcagggaattttcagaggactgctggggatgctagaaatacaatgtattgacttgggtgaaccttgagataggtgtttatttatagttattcattaaactgttcatacatgtcatatgcacttttcctgtacaaattatatttcacaattttatttaaatagtatgtttcattctgagatgactctccaatctattacatgagacacacttatactcaaaaaggtgttcattctttttctctgaaattcagatttaactgggcatcctgaattttatctggcaattgtaaaccaatcagaatagcatggttagattacaaataatatatatattttaaaagacaggaaaataaaccacagataaaatgcattcttaaaagtcttagtcatttcatttcatattctattaatatgatacatttgtgtttcatggtttctgaccccttgtgtccagcggactataaacataagtatgctacctagacccaaactaatttacttaaaggaaggcaaagaagctgaccattataaatacagcatgccttagaaaggagagtttcaagtcaaaaacaaatctggaaaaaaaattaatttgcttcttttttgtaaagcaatgatgtgtcgtttttatgtgcatttgtttacacagtaaaagaaaagacaatcaaataggtaaaatggatgctgtattgctcccttatacacacaaggaattacacatctgtctaacaatgctaaccactctgagcgataattatggatcaatgctttaaaaaatatcctgaattgcctgcagaaatggcaaggagaatacaattaaattatttgtaaaagccagagtctttttttcctatccatctgctacttgaaatgggatgacctttcaaatagtgcttgctgttctcaatgcaaactctaaataaagaagtggagtgtggctttttttttcctttccaggttcagcatagatacagcatttgtactgacattctacaccactccataagaatgcagatttggcttctagaacataaaagaggcgtttcaggaatataaatcaggcttttgtcccataccttcagtcatgacatttggcttctatcagaaaggtgtgcggcttctgagataagtgtttgagaacaagctacatgaagtaatttactccctggagaaaaattgcaaacctcacccccaaacaaaccgcataaagtaaatgtgttagtgaagaaccttttgttaaactacctatggctggggagctaaatagaaaaggtcagatatttaagctaacaatgggctcaaaacaaaccttccaacaggtctctcaataggcctacattatcaactaacaacttgcactattaagactattaatagtaataagccatgctttcttcactgagtctatatatattttacattgttttattgctcccctaccctttttaatttttaaagcatttccagtttggtcctttgtgtgcttttttaaaaattaggattttggacaaactttcatgtatttttcttaataaaagtgtatcaagcacatttcaaaaagttcaaaaaatacagaaatataaaaaataatctattagcacatcacccagagaaactgacttttaacagtctggtgtttatactcccattcatcttaatacataagcgtatcacaaaattagatgatattatataacaatcaaaactaatcaactgttttatgaacatctttctatgccataagtaacaatctgtatcattatacaaaaattttcattacaccttttaaatgttttatgggtatctctgtgtgtgtatagttgtaaaatataacttttaagtgaatttatttaaatacccaactacttatgagtacatagatttacagctttttccactactgtaaacaaaattgaaatgagcatccatacacacatctttgcagttatttccttagtattactttccagaaatagtatagctggaccagaaagtataaacattattagagccttttggttaatattgtcaatctgccttccagaaagtttactaagcaaggtaggtagatttccctctactgtataatactgagaaatatcaattttttggatacttgtcagtgtgagcaaaaatgtcattattgctctaattattattgctttgataactaatggggctgagagttttactggtgttttataactcttcctttgtgaatcattattcagatacgtttcaaatggtaatttgtaaagtattttgaattttggcccatttttctataagataaaagcattatcgttagtgggtgcagcgcaccagcatggcacatgtatacatatgtaactaacctgcacaatgtgcacatgtaccctaaaacttagagtataataaaaaaaaattaaaaaaaaaagcattatcttaaagtacaacaccattaggatttaagataaatacacacacacacacacacacatacacacatacacacacacaatgagaaaaatcattttaattttaaaaacaatactcagcataacaaattaaacaaaaatgcacacatacgccaggtacagtggttcacacctgtaatcccaacactttgggaggccgaggcaggtggatcatctgaggtcatggagttcaagaccagcctggccaacctggtgaaaaaatacaaaaaaagtagccaggtgtggggtgcatgcctgtaatcccagcttctcaggaggctgaagcaggagaatcgcttgaacccgggaggcagaggttgccatgagccaagatcacgccactgcactccagcctgggcagcagagcgagagtctgtctcaaaaaaaaaaaaaaaatacacaggtatgtatgtatgtggtatataaaataagtcaatacgctatcccagcactatttccaattccattttcccatggcaactaaaaaaaacaaaacaaaaaatagaaacaattacttgtttatccttctacatctttttctagtttcataccagtacatacaaacaggttttgatatagtcattctttgctttctaattccaacggtctcatatcgttccaattagtcaaatgattagatgctgccatatcatggacatgctggacatcacatatagatgtatttagttattattattagttccataatatttcacagtatggttatagtataaatatattcaacaatctcactattcatgtgctgtttttatgttaatgttatttgtcttgatttttttttgccactactaaaaatgcagccatctttaaatatacattttcacatcagagattactgactcccaaaattaaggttgcagagtcaaagagcaagtgtaccattaattttgataaatatatccagatttagcaatatatgaaactcttccatttctaagcacctttaacaagcatggatattatcaatattttccaattttgtcaactacttgactggaaaagtatttatttcattgtgattttaatttgtatttccacaactactagtaaagttgagcagagttgcatgtctcttggtcacttaaattttccctctgtgaattgccaattaatatccctagccatttttctcaaatatggtatataactgtatgtcatcagtgtctaagaattcctatttttctaaaatttatattgtttaatgtacattcatatatttaattcatctgaatttttagatttttattgtaaaaaatagtggtctaacatttacaacttactgatgaaaagccaattttcatagcatcttttattagataaacatacatttcccaactgaactgaaaagacccttttttttttttttttttaagacaggatctccctttgttgtccaggctggagtgcaggggagtgacctcggctcactgcagcctcgacttccctggctctggtgatcctccaacctcagcctccaaagtagctgggactacaggcatgtgccactgtaattgcccagtgggttctccttgcctactgcctagacagagccaatttctcaagacgagggaactgcaatagagaaagagtttaattcacgcagagcaggctgtatgggagacgggagttttattattactcaaatcagtctcccccccaaactcagggatccaaacttttaagaataatgtggtggatagggggtcggaaaggggggagtgctgattggttgggtgggatatgaaatcacagggagtcgaagctgtcctcttttgctgagtcagttcctgggtgggggccacaagaccagatgagtcagtttatccatctaggtggtgccagctgatctatggagtgtagggtctacaaaatagctcaagtactgatcttaggttttccaatagtgatgtttccctgtggagcgatttgggaggtttagaatctcgcagcctccagctgcatgactcctaaaccataatttctaatcttgtagctagtgtgttagtcctataaaggcagtctagtccccagacaggaagggggtttgttttgggaaagggctgttatcatcttttttcaaagttaaactataaactgagttcctcccaaaagttagttcagcctacacccaggaatgaacaaggaaagcttggaggttagaagcaagatggaatcagtaaggtcagatctctttcactgtcataattttctcagttataatttttgccaaggtggtttcgccaccatgccttgctaattttttgtatattttatacagacagggtttcgccatgttgcccaggctggtctctaactcctggggctcaagcactctgcccatcttggcctcccaaaatgctgggattataggcgtgagccactgcatccagctgaaaagacacttttactgaatattaacttcatatatttggatctgtttctcttttttctgtttcatttataaaatgttctcgtggctaacaacataccattttaataacagtaactttatattacattttaatgtttagaagaaaaagtaaaaatgaaacctgttgccattctgataaattatattaacatatctattttataggaatgaatgacattttataataataaaaactattagggaatatgagtatgactcttttgacaggcagttttatctccataacatttttcttttttctatataggccttttttgttaaattgttactaaggattttatattttttgtttccaaagtaatttttttctatttctagataactagttattgaaagtataaagaaaaaatttgatttttatatatttattttgtgatcatccagctaacatgttttcttagtaactgtgtaacagtcataaattctctatgaatataatcatatcacatgacagtgaagagagtatcattttcttcgcttaatttttttgtttgattacaacaagcagaacccataacacagtgctaagtaacagtgctaatagcaaatattcctgtgtattcttcctgatttaatatgagtgacttttatattttactgtttaatgtaatgtttgattataggtctttataaatattccttattgtgtttaacttccttccatgcccattttatttagagtattgctagaaatttctaatacattttatcacatttcttatcagtatgcatactgagttgaatacagtcctccataatttatagtcatgtggaatctcaagtgactttattttgaaactgggtctttgcagatgtaatttgttagattacagtaattagaggtcataagggattagagcggcccctacccaatgactgttgccctcataagaagcaaaaccagagatatagtcagacacgcagagagaataccatgtgataaaggagacagagactggagtaatgtgtctgcatgccaagaaatgccaaggactgttggcagctactaaaaggtaggaaaaggcaagggagggccaccccttagagccttcaaaggcaggatgtccctgctggtaccttgattttgaacctctagctttcaaaactgacagacaataaatgtctgttattttaagccactcattaccaaattaccaaacggtaatttgttatggtggttttaggaaattaacaaagcatatgttgtataatcaaatcatttaatcttttaattaatggtataaagttccaattcagaaccagtttgtaatttttgaaatgaagcctattttaaacattttatcatgttttcataagcagatagatacaagttgctattttttaattatatacttccacatatgaaaatgaaattagcataaaatatctcattagtgttatttatctcaagttttgatataacattttgctagatttgtacagttgagccccattctattttctctatagtcttgaattgtttaagaaccatagggaatatctgttttttaaagctttcgtatgttacaagtatcttttaatcttttaaagtacctgtttttaaatatctagtttacatgtaaaactatctgggcctggtgccttttttctagtggtacatgtttaataattttccactttcttctatgattattggtattaaatgtttttattttgcctatgggaataatataatactgaatgtatatatacttttctaaagaatcatcattttcctagatttgaaagtgaatggctataaaatttttttttaaaaaaaatctagccgtaccagtattgattggcagagttgaccaagggaagctaagagggtacataccatcttcctcccacacgactacatatgcattaaatcagaagacgacagtcttccaagaataaaatgaatcatcaagggaataagagcagttctcatccctagttagaatctctaaacaaaccaaagcaaatgtttttatttgaatcatcaggactgtgtcacaatgaaacctagatggtttgtcttcaagtcatttactactcccctaaagtcttatcaaaagtatgctaaaaaagtttatgacatttccactgagctacaataaagcttctatttttttagatacttgacaaaattttaaaaagaattatttttcccccacacctgcacacattttaaaatatcttcaacttttctacaaaacaattttctctacagctctcccagacttcacaaacatattcttttattcatagcagatggaggaaattagagtaacatatttgctctaaaatcattagtgctgcatcagcacttctgatctaaatgacatttcaaggggttattgttacatagagcaagactttgctccaggcagaaagagacagaaaaacaacttgaaaaatgaacctttttttgcaattagcttctgcatcttaatttgttgaatgccattctatttggattttaaatacaaatcaaaggaagaataaagtgatccaattctgtcagggtcataccttccttactggtcagtcgtctgattaatcattatagctgcttcctaaaaaataatgttgttaaaacttaccatcaactacttgattctctggaaaactaacatattcttacttctcagagatatcttgagaggctgataagtctgctctttagcctcaagaaatgcctaaaattaaactatttaactggtgagcttcacatgactgccactctgtccaagagataaataaacatccctggctgaagaatgaaccaacccataggtgtttctttagcacatactctgttaagtccactgtggaattaaaaaaaaaaaaaaaagtttaaggtactacacacctggaaaatgcaatcttgtaaacataggagaaaccacagagaatgatacaagatagcaacaatcatactttatatttttacactgcattacaattttcaaactactttcatgacacttttcttattttatcctcacagtaaatccataatggaagcaggataaaagaggaaggagacataaacatagaacttcagagatgaaagcaacattaaaggcatcaataaccttctttacagataagaaaatggagaccaaagggaaataagaaccttcaccttgtttcagagtcaggcaagcaaagctaatgaagtgaaggcttgtcaccccaagttgcaaaaagaagtcacaaaaataagacaagaaagagaaagatgatagaaatacaggacactaatttggatttaatgtacttttttaaaaaatagaaaaggaaaagcaattctattgaattcgggtttgaaattcaacgttggtctctagggatcacttggctatggtggttttatgccattaccagatccctttgagaaaaatactattttgaaattcatggtttccagtaaatatgttcaaggctttgaagaacatactcctgtaggtgtaaatggtgtatacacatatacacaaaagcttgaaaacactacttaattactgaacggagtctaaacattctacagctcagttaagaagctacacatgcgtctcacacccaccatctctccagctgtcctccacacaccatcccagcaagtcctagctgaccctcttaatactgtgacctctctgttgtataataaaggttgaaaatcatccttcctttgaataagaatatattataactatattattttttgttacagccttctcaaaaatgtatttcaagccacacataggccattgtcatggcatcttttatttaacagacaatagctattttccatgactcagtccagaatattctttaacatctacatctaggatattatcataattataataagagacggcactacatggatgaagctggaagccatcattctcaggaaactaacacaggaacagaaaaccagacagcgtatgttctcactcataagtgggaattgaacaatgagaacacatggacacagggaggggaacatcacacatcggggcctgttgggggtttggggggcaaggggagggatagcattaggactaatgcatgcggggcttaaaacctagatgacaggttgatgggtgcagcaaaccaccatggcacatgtatacctatgtaacaaacctgcacgttctgcacatgtaacccagaactttaagtaaaaaagaaaagaaaggtgcaaaagtgaaaacattaaaagtggaatcatgattttaaaaaataaattcacagtggtgttgaaagatcatatcagggttagaggacaagtctttgggttagaatgaacacttaatttattatcagagtgaacaataattacctcgacattttaaaacagcattttgtcaccttttaaacgtttgggaacagagaaggcgaaacaccatgtctgacacactatggaaagttttataattctcctcaaaaaggaagaaaaaatatttctatttccattccagatctgcacaatatattcttgcatcccatttggtctgattcatttacattttgctgaattctgtttttgtccattttcatcattcaaaagattttaaaaattcaacaacatcaaaaagccatcaaaagatgctttcagatgaaattgcaaagaaaataagcacatgaattagtgaagcaacttccaagttatacaattgtggcacttacatcttttctcatcttgtccgagaattaattgtactgctgaaattagacatccagcctgctccatgcagacaggagcccaagccggaagaaaactctttgaataacaacactgccttctgattcttttcacatggctacatttttgacatttacttcaatattctacccagttgcagtgtgactatgacaaaatatttctgtaggcatgactggcacctctgcggtaagtggcagggaatggaataggaaacgagtccctttagtagctccaaaaagcccacaggcactctgcaaaccttttgcatacatgctgttaagtaaaggatgtgaaaaatggaaaccgtgatgacaattttaatcaccttacagatgattctatgatctactataactttataatggcaaagccactgacacaggagactgacaggcatatattctctctctgcctctaagtctattaaatgtttatttggggggtttacacatggatagagatgaacttaacagagtatttattgaatctatccacggataaattataaatgactacaactttaactaggtggaattttcatggttatttttaatttctaggcccaaatcacttccctaggctctagaactgtcttccaggagatgtcagatgtcagtaatcagagggaacccatctacagtcaatgcagccaaaagttctgcctacaaggtagcaattagagtccagcagtctcttctggaagtgccaattactgttctgtcttcccttttgaatgcctccttaatataagaataacatatcatttttatcctatcagattagaaaatattgtttaaaataacactcacagttggcaagaatgcagagagagaagcactcccaaacagatgctggtgaggatgtaaattggaatgtcctttctggaaaacagtccagcaaaatttatcatgatgtttttatcttcctgacattagtttgggtatactgttgcatatttttaaatagtcttcaaaagctagagttttaaaactctgtgtggcattttgttacgtgaatacgctatagttttcaattatttccacatttgtcagcattttagttgatttcaacttggggtattataaataatgctccagtgaacatcttcataaatacacatttaactcacattctgtttatttcttagtatagattcaaagtgaaaatacagtggttggcaaggcttatattcaagtataattttatcctagtaattatggaattagtatcagcaaacggattcctaagctagaattcaccatcatttactaggagaaagatctgtggtggtaaaacagactctgcttatttacacagccttactaatgggcaatttgccagaggaatccaaaccagagagcatgtatgattgactaaccattacatggaaagaagaaatcagctcctaccaaaagcacattcatttcaagtaatgccagcaacctgctgagtcagttgtattcagcccctatagaaacccttcccaagttcattgatatgtgacacccatgacatatttttaccatcattggttttcatgaatttgcctgtctttgagacctgaaaaacaatctgatttattgaactgaaaaaggcgaatgtagtgaaaccctatcctgtaattggcaaaccttttacctccctggtggcttgagtagagaagttactggctggaggctgttctaaaggaaaacatgaatggccctaaaattaaaattccagactttaggagccaattaatgaggacataccacttttaatccatcactttgcaatatatttaaaatgttaagactcattgttggcaagggaacagtattccccaaagcttattccatgggaaaatgtttttgtggacaaaagagtttgggaaagagtgatattggaatgaagttcaagctgaacttttaatgtgctattaccaactgtgaatctccatggggggctgtagctagtaacatttgtaaacttcttcaaccacaaattattcctgctttatattgcctttgtttctggcaactgggtttctatagcgcattgcaaggcagagcattctatggaacgtactttagagaatgtttctctaggtcagcagttctcaaacattttggtctcaggatccatttccactcctaaaaactgtggaaggccccaaagagtttgtggttatgttggttatatctatggatatttaccatgttagaaattaaaacagaaaactttcaaaacactatgaatttattttaaaatgacagtaataaccaattacatgtaaatatacatattttcccgaaaaaagagctagtgagaagagtggcattgtctcaacatcacattaatatttagcctaatagaagacaggtggattctcctatctgtttctgcattgtgttgtgatatattattagggttgaagtgtgccaagaaaatctagaaggaatattttaatagccttttcaaataactggattttttctctaatactgcatcaaaacttaacaaatggtagtttctttaaaagttacttgcagagtagaacccgaaaccacatcaagaaatttttagtgctctgttatgtgaaaaatccatggtctgtgtagcattttgaatggatcctttccccatgtgaaattttgtaacagtgcacattgctctggacaaaaatagtggttcattggattatgcagatcttccaaatgttgacacctttcattgcatgatataaaaaagaattatatttgcaatatcatcattgaccttttattagaaaaagtctttaagtattgggaagctgtcaagctcatggtggcatatccaagtttcccaaaatttgaatttttgcttagaagcttgaattttatcactatcaacaaatactggccaacggtttacttaaagcaacagactcactttgtgcattttaaagaaaatatgttaaatacttgagtttgcataattatagtttgtctttcaatgcttctttcatgcagaaaaatagtgttccatataaaaggtagctggttcatttcactacccagtctcacaagtgcttttccttgagacaaccatgatatgtcagtacacagcagcagttctttctgcatacttcccatttcagcacacagaatgctaaaaaaaaaaaaaaaaaaaaactcaacaatcaaaatgcaattaaattaataatttttacttttcaacaaggatattcttagaaaaagttgactttttattttttttaaccatagtgcatggcagtgaaaaatgaaaggccaaaagtacagttcagtgccactgtcttgattcatgctatggtgccagtagttttaaaaaacattacatttggaggagccaagatgtccgaagaggaacagctccggtctacagctcccagagtgagcgacacagaagatgggtgatttctgcatttccatctgaggtacccggttcatctcactagggagtgccagacagtgggcgcaggagagtgggtgcagtgcaccgtgcaccagctgaagcagggcaaggcattgcctcactcgggaagcgcaagggatcagggagttccctttcctgctcaaggaaaggggtgacagacggcacctggaaaatcgggcccctcccacctgaataccacgcttttccgatgggcttaggaaatggcgcaccaggagattatatcccacacctggctcggagggtcctacacccacggagtctcactgattgctagcacagcaatctgagatcaaactgcaaggcggcagcgaggctggggaaggggcgaccgccattgcccaggctcacttaggtaaacaaagcagcctggaagctccaactgggtggagcccatcacagatcaaggaggcctgcctgcctctgtaggctccacctctgggggcagggcacagacaaacaaaaagacagcagtaacctctgcagacttaaatgtccctgactgacagctttgaggagagcagtggttctcccagcatgcagctggagatctgagaatgggcagactgcctcctcaagtgggtccctgacccctgacccccgagcagcctaacagggaggcaccccccagtaggggcagactgacacctcacacggctgggtacttctctgagacaatacttccagaggaactatcagacagcagcattcacagatcacgaaaatccatggttctgcagacaccactgctgatacccacacaaacagggtctggagtggacctctagcaactccaacagacctgcagctgagggtcctgtctgttagaaggaaaactaaaaaacagaaaggacatccacaccaaaaacccatctgtacatcaccatcatcaaagaccaaaagtagataaaaccacaaagatggggaaaaaacaagagcaaaaaaactggaaactctaaaaagcagagcgcctctcctcctccaaaggaacgcagctcctcaccagcaatggaacaaagctggacagagaatgactttgacaagttgagagaagaagtcttcatatgatccaaccactccgagctacaggaggaaattcaaaccaaaggcaaagaagttgaaaactttgaaaaaaatttagacaaatgtataactagaataaccaatacagagaagtgcttaaaggagctgatggagttcaaagccaaggctcgagaactacgtgaagaatgcagaggcctcaggagccaatgtgatcaactggaagaaagggtgtcagtgatggaagatgaaatgaatgaaatgaagtgagaagggaagtttagagaaagaagaataaaaagaaatgaacaaagcctccaagaaatatgggactatgtgaaaagaccaaatctgcatgtttggtgtacctgaaggtgacggggagaatggaaccaagttggaaaacactctgcaggatattatccaggagaacttccacaatctagcaaggcaggccaacattcagattcaggaaatacagagaacgccacaaagatactcctcaagaagagcaactccaagacacataattgtcagattcaccaaagttgaaatgaaggaaaaaatgttaagggcagccagacagaaaggtcgggttacccacaaagggaagcccatcagactaacagctgatctctcggcagaaatactacaagccagaagagactgggggccaatattcaacattcttaaagaaaagaattttcaacccagaatttcatatccagccaaacaaactaagcttcataagtgaaggagaaataaaatcctttacagacaagcaaatgctgagagattttgtcaccaccaggctgccctaaaagagctcctgaaggaagcactgaacatggaaaggaacaaccggtaccagccgctgcaaaatcatgccaaaatgtaaagaccatcgaaactaggaagaaattgcatcaactaacaagcaaaataaccagctaacatcataatgacaggatcaaattcacacataacaatattaactataaatgtaaatggactaaattatccaattaaaagacacagactggcaaactggataaagagtcaagacccatcagtgtgctgtattcaggaaacccatctcacatacagagacacacataggctcaaaataaagggatggaggaagatctaccaagcaaatggaaaacaaaaaaaggcaagggttgcaatcctactctctgataaaacagactttaaaccaacaaagatcaaaagagacaaagaagcccattacataatggtaaagggatcaattcaacaagaagagctaactatcctaaatatatatgcacccaatacaggagcacccagattcataaagcaagtcctgagcgacctacaaagagacttagactcccacacaataataatgggagactttaacaccccactgtcaacattagacagatcaacgagacagaaagttaacaaggatacccaggaattgaactcagctctgcagcaagcggacctaatagacatctacagaactctccaactcaaatcaacagaatatacattcttttcagcaccacaccacacctgttctaaaattgaccacatagttggaagtaaagctctcctcaacaaacgtaaaagaagagaaattataacaaactgtctctcagaccacagtgcaatcaaagtagaactcaggattaagaaactcactcaaaaccgctcaactacatggaaactgaacaacctgttcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcatcactgatcccacagaaatacaaactaccatcagagaatactataaacacctctatgcaaataaactagaaaatctagaagaaatggataaattcctcgacacatacactctcccaagactaaacgaaacgaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaactgaatccagcagcacaacaaaaagcttatccaccatgagcaggtgggcttcatccctgggatgcaaggctggttcaatatacgcaaatcaataaatgtaatccagcatataaacagaaccaaagacaaaaaccatacgattatctcaatagatgcagaaaaggcctttgacaaaattcaacaacccttcatgctaaaaactctcaataaatcaggtattgatgggacatatctcaaaataataagagctatctatgacaaacccacagcaaatatcatactgaatgggcaaaaaccggaagcattccctttgaaaactggcacaagacagggatgccctctctcaccactcctattcaacatagtgttggaagttctggccagggcaattaggcaggaggaggaaataaagggtattcaattaggaaaagaggaagtcaaattgttcctgtttgcagatgacatgattgtatatctagaaaaccccattgcctcagcccaaaatctccttaagctgataagcaacttcagcaaagtctcaggatacaaaatcaatgtacaaaaatcacaagcattcttatacaccaatgacagacaaacagagagccaaatcatgagtgaactcccattcacaactgcttcaaagagaagaaaatacctaggaatccaacttacaagggacgtgaaggacctcttcaaggagaactacaaaccactgctcaatgaaataaaagaggatacaaacaaatggaagaacattccatgctcatgagtaggaagaatcaatagcatgaaaatggccatactgcccaaggtaatttatagattcaatgtcatccccatcaagctaccaatgtctttcttcacggaattggaaaaaactactttaaagttcatatggaaccaaaaaagagcccgcatcgccaagtcaatcctaagccaaaagaacaaagttggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccataggtagaaagctgaaactggatccctttcttacaccttatacaaaaatcaattcaagatggattaaagacttaaacattagacctaaaaccataccatatgaggcactattcgcaatagcaaagacttggaaccaaccaaaatgtccaacaatgatagactggattaagaaattgtggcacatatacaccatggaataccatgcagccgtaaaaaaatgatgagttcatgtcctttgtagggacatggatgaaattggaaatcatcattctcagtaaactatcacaaggacaaaaaaccaaacaccacgtgttctcactcatagatgggaattgaacaatgagaacacatggacgcaggaaggggaacatcacactctggggactgttgtggggtggggggaggggggaggggtagccttaggagatatacctaatgctaaatgatgagttaatgggtgcagcacaccagcatggcacatgtatacatatgtaactaacctgcacattgtgctcatgtaccctaaaacttaaagtataataataataaaaaacaaaacaaaacattacatttgcatcattaatgaaaatattaacatagtgaaaaagaaaaagagcaacttagtattacagtaatatagtttcgaccttgcagactccctggaaggatctcagggatcaccaggagtctgtgaagcaccctttgagcattgtggttctagattcaaaatgtggccttggctgagcacggtggctcatgcctgtaatcccagcacttcgggaggccaaggcaggcggatcacctgaggtcaggagttcgagaccaacattgcaaaaccctgtctttactaaaaatacaaacaaattagccaggtgtggtggtgcatgcctgtaatcccagctactcgggaggctgaggcaggagaatcacttgaacccaggaggcagagtttgcagtttagctgagatcacaccgctacactccagcctgggcaacagagtaagactgtctcaataaaacttacacacacacactcacacacacacacatgcaaaaaacccttagtttaaaacacaaacacatcgtacagctgcacaaaaatattttctttctttatatcctttttctataagcttttttatatttttaaatatttgtattatttttttaaacttttttttgttaaaaactaagaaaaacacaaacattaggttaagcctacacccggatggtatcatcaatatcactgcctcccacctccacatctcatccaactggcaggtcttcaggggcagtaacaggcatgaagttcttacctccaatgaaaacaatgccttcttctgaatacctcctggagttcttgcctgagactgttttatagttaactgttctttaataagtagaagtacatgctaaaataatgataaaaagcacagtagatagttcataaaccagtaacagtcatttgttatcattatcaagtattatgtactgtatgtaattgtatgtgctatacagctggcagcacagtagatttgtttacaccagcatcaccacaagcacgtgagtaattcgtgacgctatgatattagcacactacaatgtcactaggcaataggaactttttagctccattataatcttaagggaccaccctcatatctgcagtctgtcattgaccagaccattgttaagtggcacatgactgtatatacaatggaatactattcagcatttagaaagaaggaaatcttgccatctgcaacacgaatgaacctggggaatgttatgctaagttaaataagccaaacatagaaagacaaatactgcatgatctcacttatatgtagaatctaaaaaagttaaattcatagaagcaggtagtagaaggttggttgccaggggctgtggtgtgggagaggaaaaaaatggggaggtgttggtcaaagggtacaaagtttgagttaagcaagataagtaagttttggagatctattatacagcataataactatagttaataataatttatacttgaaaattggtaagaggttagatcttaaattgctaagagagtagcatttaagatctactctcaccacaaaaatttatgagatgatggatatgttaattagcttgatttcatcatttagcaatgtatacatatatcaaaacatcactttttaccctgtaaatatacacaagttttatttgtcaactataccttaataaaggtggggtgaaaatgcatattcctgaaacccatcatgggcctactcaaacagagtatctgaggaggaggcagggctacccgagcagcagcgcaggttgtacactgcacaccttgcacaaaggtatacagttagcgaagatttgagcttgaagtttgccttttaaagaaattgcatatgtgaatcttggttatagtagaactttaagtgttctagagcagttgttcttcaactttatgtgcatcagaattacctgtcttggggttgaaaacacaaatttctttgtgccatgcttgaactacctaattagaaacctgagcatctgtattttcaaggaactacttagccaactctgccacctaccaaaatgtgacagccatttttctagactaaaaatggtatagctgtctacaagaaatcaactcaacaaaagctgaagacaacacacacacggcttaggatactcaggcatcatttggacagagtctattcaacagctataaatttgttgtttaaaatagccaatgttttttaaaatgcaactttccatagttttctgttgttatatttgttttcattctgtcagtatggtattggatctcaaccttgtatgttatttcaccaacatcttgaaatttatttagccatattttcatggttttatatgaatgcttactaaacatagtctgattttttaaaaggttttatcttatgcaagattcttcaagagaaaagacaaacttagtttactgtcaaattaccaaactgactcagatttttaaaaaccattcgaagtttcatgttatgcacttaacataaaaaaatgactcaatgtaaatgtcatgtctcgtaatgatcctattcctgggatctttcacatgaaacagagtgggcaggaacattctatggctgccaaaatggaattaaacacatggaaacaaagaaacaaaagcacaactcaccccttccagacaacaggaaaacatgtagataaatcagtgattttccttccagctaaccaatgaagtagagacatgtattttaacaattgtaagggcactgggcttaaggaaaggcaaagtaaaaactaggttataatgttcttctagatgcgaaaatgccaaatctgccagtcactcatgaaaagaacacagccccaggcaactgatattgatacattcaaagattatagttatgtatgattacagaatagcatttcataaactctatcagacagaacaactctttaatggaatgttaagagttgggagagagagaaaagttggtcattctaaggtccaattaatttgaaaactcatgagttatatagaattaaacaaatttttttgactgtggaacttctcagagcccttctgtactaatgtgcattacacctctccaagaagaaaaaagcatgcagcatttttcaaacttttgatactttgatgcttttttatttagcttctgactgggctagagttctctgggacacacccagggaaatattgatacagacaggtcaaacaattaaggcaaatgctcaggcatatacctgaactgtggtagaacaatctagatgccacagaaatggtgaaggcatgcccaacagccagccccactatatcaagtcccttagcctctctccattggccttagctctgaaagaaagatgatgcttattagtaaagtgccttgggatggttgggcaagaaacactaaataagaacaaattattaccctcattacagggtagatgatctaataaaccatctctattacttacaaagtttggaggcctgctatttttttccttttaactacactccaatttgaccttaaaaatctatgctaaaaataacttataggaaatatcccaaaaccataccataaactttcttatcggacctctgtctgtttgcacattctcaatgactgccaatcacctacaggtaaatgcaaatttcttagcctgctgtataactctccatctttcaggagctgtagagtttatgattaagatcatggtctttgtagggagacagacaaggttcacatgcaggctccactctactacatctgaagttatttctcttctctaagccctagattatcaaagtatggtccatgaactggcagcgtcagcagcatttggggcttcctagaagggcagaaattcaggctccattgaaaacctactgaatcagaatctacatttcaacaagagcctcacactgtagtttgagaagaactacacaaattctcatacgctttgaccagctcctctgcaaattggaggtaataatagtaaacttggagatggcattcatcgtctactcctttgaatccatcctcaagtcctaaggtccacgcaaatatccttacctgtctctttcccttcattaccttagtccaagctgttctcatttctctccagatctcctgcaatggccactcaactcattacaatgcatctcctcttgcttccttctattctgtttcacttactgcaaccagagagatctcccaggaaaagcaaatgtgatcagagcttccatgagctctcaaaataaaggccaaaagcctttcacagaactacaacctctgttgagggggtcgcttcccacctctatatcttatcttgcatgatgctccacctggtttcctctgctccagaagcactggtaaattcttttttccactccttgaactagccatcctccttcccgatacagaatatttgcaaaaccatcctcctggtcatcagtgccttcccctcaactctttacctggttaactccttctcaatctttagatgtcagctcaaatgtcatctcccctgaaagctttccctgaacctcctacccagcagccaaacacactgcctgacctgttgcctgtgccccataaatatttgttgaataaatgaaggaattaatgaatgttcattcatatggttattgtgacaatcaaatggattgaaacctgtaaatcatttagcacagtgcctggtagagagcaagagcttacttaatgcagtaccaatggtaatatattttgaatattagtcttgctaaaaactagaccccaagcagtacttaacaggggctaacaattagaatcacctgggaaatgttacacttctcaatgtccaggctctgctgcagaccaattaagtcagaatctctaggtggtgggacccatgcacctgaggattttaaaactctacaggagattctaacgtacagccaaagtgtgactgctttactcgttgtctcactgtggtctcccagccttccagagaatagcatactgggcgtcaagaagagtcctcattaatcatggcatgagtctgtggcccacagaaaggggcagtaatatgaatacatgtagtaaaaatctagcaattcatttcccctggctccttgacagcagccagatggtggaaactctccatctattacccaagccagaagaaaacctttctgggaaaatccaagttgcctgaactactgttgggaggaagtatggtaacacgtgaagatgactctggtcctttgggttaagtgatgacttaacaaaattcatcaggattccattataaatctgtcataattgttttgttgaagcaattgctttgtgggagcaattaattcctactgctaaaaaaaaaggtgagaactcctgagtgttccatcaggcaccaagaaataggtgagccgggaagcatttgcccttaccttctgtcttcttcactactcaagtatttggagtgtcaagagaccacactgtacttcaaaggcctcctcttccaaataaccaaccttctgctatgtaaaaacatgattaagaacacacatatttgtactgtatgtctcactcattttgaacttttcaaaatgtgatattgccaaagaagctttatctcttttaagggtttcacacacacacacatacactgccttggtttgaaaaacaacatagaatgcaggcctcatacaatttgagaaccatttacaattataacctaccaagtcagagctgataccaagccaacacaaaggcctcagaattgttataaaaggaacagaattgctctctggaaataatatcccagtgggctaaattccccctccccctgttcctccaaggtggtaaattgcaacaacaacaaaaaagcatgattcatgaatataaatttttcttggcttttaaaatcatacactggcatagtcctccccgaacttcagccaaatgagaatacacagataatgacaattttacaataagtggttccaggacacaggcttttcaagatccacaaatgaaaggcactataaaaaagagtattattattattattatttcaagcacccagaaaaaccacaatcaatgattagccataacaattaaactaacaatagtacatctggaatcagctccatggtaatatgtacttcatgcttaatagttcaaattaattcaatctgatggtgttagacataccagttaggagctggagagcaccaaaattcacattagcttccacttcaaaagatattatgaaaagagaaggaaggaaatgaggctataaacagcagtggtaaatacgaaaggctcagagatgatatggtcaggaataactctcagctattaggaattcagtgatgaaaatatgaaggctgatatttctatccttgcacattcctccagagtcaatgactgagccacccatctgagcgacagaactgaaaccctaaaatcagggcaattatattcaaagaagagggggccttcttcattctgcttacagcatcctttactagtagcccatttatattgcagaatgcatggagaatttctcattttcaggttatagacttcaagtaataagaaaagagagcaggagttggggcaggcataaaaggtgaggtagttattgcctgattaccttatttgtctcactcctccttgaagattcactagataactgtcttaagctgcactataaatattctctaaggcaggatttctcaaccttggcactgtagacactttggcctaggtcattctttgctgtgaagtgctatcctgtgcactgtaggatgtttagaaacatccctagtctccaccttgtagatgctagtagcatcccccacccccagttgtgacaacaaaatgtcttcagacatggccgtatgtcctcttgggggaaaaatcatactggttgaaaactgttaccttaaatcttttttttttttttttttttttttagatggagtcttgctctgttgaccaggctggaatgcagtggaatgcagtggcgcgatctcggctcattgccacctctgcttccaggattcaaatgattctcctgcctcagcctcccaagtaactgagattacaggcaggagccgccacatccagcgaattttttgtagttttagtagagactgggtttcaccacattggcgctggtctcgaactcctgacctcaagtgatttgcccgcctcggcctcccaaagtgctgggattacaggcatgaaccaccgttcctggcctactttaagtcttaattcacttgtttctgggcatcgggaggaaaatccagagggcagactcccctctagactcttcttcctcagagatgagcatggattgtattgccagctgtgtgcaaggcagcactcttcccacggcatgctgaatcctcctcctaacaccttttgcacatataggcttgttgcatataatacagaaatttggaacctggcagtcttctattcattgtgcagaaaagagttaacacagagcaggctcgagaaggcctatccttagaaggcctgtttgcaatgttggcctttggttagcagctgggaattggagctggtaaacagttccctacactaatatgacatttttcctaaattatagagtggccactatgcctcacctgtttgtacaaacagtgtggtttatgctgaacacctgctttccttctgggagtctggaatttgggtatgtgctaggcagatcagctcccagcagtagccttgggcactgagtctctaatgagtgccctagtaggcaacacttcaaacttgttgtcgcagcttgttgcttaaggaactaagagcatcctgtgtgactgcattggaagaggactcttggacgcttactcctgatttctccagactgcacaccatgcaccttttccctatgttgattttactttgtgttctttcactgtagcaaatcagaaccagaagataacaatgctgagtcctaggagtcctcctagagatttacagaaccttgcaagtggtcttggggaccaccaatgcagggactcattcagcattctatttgtgtgcctctatttctagatacagcaaagacttaaactccaagtcctcacagaatttatgtggtagcagcgagcaaagcattaattctagcatatttcaagcttctttcatagaaaacaagccctgtggcatctcttttttgtttttataacagctttttagagatataattcacatatcatactgttaatcaatctaatgtgtacaattcaagatttatattcatagagtcgtgcaaccacgaccacaatcaattttaggacattttcatcaccccacaaagaaaccctatatccatttacagtcactacccattttctcccaaccacccagctaggcaaccactagagtttctgccgctatggatttacctatttttgacacttcacaattggtcatatgatatgtggtcttttgtgagtggcttctttcacttaccaaaatgttttcaaggttcctccatgatgtaacatgtatcagcactacatttatttttattgctgaataatatttcattgcatggatataccacatttcatttatccattcatcagtaaatggaactttgtattgtttctactttttggctactatgaatagtgctactatgaacatttgcatacaatttttttatgcacatatgatttcattccccttgaatagctacctaagtgtggaatttctgggtcatacatatgtttaacttttaggacattttcaaactgttttccaaagtagctgcaccatttacttaccaatggcagtgtaacagagttctaatttctccacatccttgctaatagttactattaactgtctgttttttttttttgttttttttttttttgagacagcctgtcacccaggctggagtgcagtgatgcaatcttgactcactgcaaccaccacctcccaggttcaagcagttctgctgccttagcctcatgagtagctgggattacaggcacgccccaccatgcctggctaatttttgtcattttagttgagatggggtttcaccatgttggccaggctggtctcaaactcctggcctcaagtgatcttcccgcctcagcctcccaaagtgctgggattacaggcatgagccaacgcgcccaaacttatctgtctttttgctaataaccgtcttagtgggtgtgatgtggtatctcgtaatggttttgatttgcacttccctgatggctaatgatgttgagcatcttttcatgggcttattagccatttgcatatcttctttggagaaatgtctattcagacctatttgccccattttaactgggctatttgtctttttattattgatttgtaagaattctttttatattcatattctatctccaagtttcttatcagatatatgatttgcaaaacacttcttccattttgtgggttagttttattatttcaatcatgtcctttaaagcataaaagttttaatttttaggatgtccaatttatccatttttttcttgcattactgtgcttttggcaccgtagctaagaaaccattgcctaacacaaggtcatgaagatttatccctatggttttgtctaataatgttatagttttagcttttccatttaggactttgatactttaaggtaatttttgtatacagtgtgaggtagggggtccaactttattcttttgtgtgtggatatccagttgtctatggcatcttttgcatcactccaagacatagtttcaggtaatttttgtctatacaaattaaggtaacaggtaccaaaacacagaacctatgtatgtgacaaactgcctgaaagcctttataaaaacttttgcaattggtgttctttttttctattttcagaatatgctcagtattttgctatatcaggaagcagtaccaccattattaccactggtgctactgctgctaataataatagtaactagcagatattttgtacttagtatgtgccagacactacacttgcatttaacattcattaacttttaagcactacacatgctttaacttacatgatcttcctgccaacaccacgagataggtagaatcattatcttcattttacagatgatgatattaaggctcactgatgtaaaaaaattttccttaggtcatagaacaagcaggaaaaccgatttaaaaaaattgagggaaggaatggcactggaaagtggaggtcaagtaatgtcggatagcaaattctaacaaacagtagctaagcacgtatgcgaaatatacaaaaataaacaagccaaaatctagcactggtagatgacattcccagttctgatcaagttgctgacaacaaaggattggtctccccttctaactcaacaaagggtaggaaatcttatcactcaagatatcaatcaagatttatttgatcgctgaaagggttttgtcaacactccaaaaattgtattagtgactagatgattgatggaataagtcaattagaaccagattagaaatcgagatatgaagtcaattacttccaatctgaaaattaggaatcattaaacaataatataatagatggcatcaattttcaaaactacccttcgtgtgtttgtctatagggcaaaattcaagtaaaaaataactttgaaaagactaaaactatagagcaacttgatcttgggagtgttttcccagatgggtagtgggctgagtctggtcagttttcagtggagaaaatgtagacgagataagcagttgatgttcccaaattcaaataactttatggcagaaaagtcagtcaagtttaattctctttccctatactagctgtgtccttaatgataaatacaataataatagctgacatgtattgagtcttacattatatagctctctaggtacctaaaagatgacaactaatttatttaaaccaaggcatatgaagtaagtactattattattcccattttatataagaggaaaaggatgtgtaaagtgctaattgacctgcttaagaggtagagtgagaccttgaaccctgtagtctatgtttgtcctcctaatagtgtctctatatggtttcagaatagaagcaaatagacacataagggttaagcatggctaacctaactccaagttgagtctttttacactaggcaatgctgtcttcaatatatttataataactttatacaccaaataacattttgaagtttatttcctcccaatacagaaacatcactgcatttccactgggattttcagtactgtctgttgtggaactgatctgggcttagtgagtattgctttatcattcttaaataaaaaccattatagagaatgcagaaaacaatttccctttcagtttgcccacttctacccataccgagaaagacggatccttaaagctcagaatgtaataaaagctcacaatataataaaagctcagtatcagaaatgttccaagtccctccactctttctctatagttaggaaactaaaatttaatatagggcacaacgctccagagaattcagtgtatcgaaatgttaatacacttttatatattttaactgagataaacaagaaagagatagggaagccagagcagctatggcaaagacataattatgataagactaatccagctaacagcaatagaagcagatagtgactccactgtgatgctgtggtagagtttgtatggtcagaaaactatatcagtatacaatgttaatgacgcaggagccccattataggaaagcaaagataacttactatgtgactctataaagtaaagttcatccaaaagatcaaagagcatttgtcctattactaaaatattatccaaatgtattttatcaattaaaacttggataaaatcatttgcttcattgaacagtaatttaaaaggagcataggctgggcactgtggctcacgcctgtgatcccagcactttcggaggccgaggcgggcggatcacaaggtcaggagatagagaccatcctggctaacatggtgaaaccccatctctactaaaaaatacaaaaaattagctgggcatggtggcgggtgcctgcggtcccagctaatcgggaggctgaggcaggagaatggcgtgaacccgggaggcagagcttgcagtgagccgagatcacgccaccgcactccagcctgggcgacagggcgagactccgtctcaaaaataaataaataaaataaaaggagcatagtatgtccataaccaaataggaaggaaaatgcctattttgattttcataacagagcttaaacattgtggcaaaactttaaaatgcaggacataatgtaaaaattcttctaccagctctaaattcgtggttgtgctatcaactatgtcacatttctcagtgttgaccacaaaaataccatgagatacatacacattgctgaaatacactatttctcaaactcaactttatcttctactccaataaccctgtcaaaaggaaaactagtctggttacttcatttctggcagatccacattaactcctttcttttaatgctcattaatctttctgttaacaatacttctgaccctcaatacccaccctttcagacaggtcaaaactaaattcttcagtttaccatttaagcctttccttcaagtttttgcaggtaaaatgagataaaaacagacgtttgtattccagccagattgaaattttctactaccctctttgctcttcccattaaattctacctcgcagtttgtttgtttttgttttattttgttttgcgtcgtttttttaaaaaaaattgtttattgtttatttactaaatctggggcatattagatacttgaccaatttaaaatttacatcttttaaatcaattttgaagtgttttcacacacacatacacacacacacacacacacacacacaattggcatgcaacagttgtcctaaggtgaaacaatcacctcatcaacaaagtgtcataggtgttctcacccaaggttgcttatcctaaacctgaaaacctgtaacaaatttaaattacttatataaaactcattacttgtagttttccccttgcaaagatctccagaaatgtacaaataactaatatacatcagtcacaacataatcctggatcatccccacatcaaaaccagatgctcctttaattttaaactcattatcagagagcaagagaaagtcatttcgttttacacaaaacaaaattcacatatgccaaaaaagaaagacccaagagaaacaaaaacaaaaaccctagtgctgacactgatgttcagtgccctggttaaacagtggcccgaaggccacggatcaaaaataaaatagcggctgtatatcactgcaatgaagtttaacaggctttaaccttctggcttcagaaatccagatttttccaattacatgaatgcatacttcctacattccaagagtggagaaagtggatgcgccagtgtggaaatgaaaagagccaccattcactgggacaaccacagaactggctttaacagagactccttagaaagttacgcaaaaaataaagacaaaaaatggttgtatgcggcttgtgtcatcaattttaagtggaggtgactgagtcctaaggtacaatgtaaaatgtatgggggaaaataggtgctggggcaagtcttacctttaaaagcaaaacttgaaaacaaagtataaaagtgcccagcctggcagcatacacccaagccagagagctctgccatgagcatgcatagaaaatgtcaggattcatactattgtttctcataaggactcaacaaaatgaatccttaatagcttaaaccacagaatgagggaatacacagaatgcagtcatttcagtaaagtactatcaggctttgtgctgatttcctgaactaactgcattttattatcaaaacaaaaggaaaagaagattttaaaaatatatatatatatatattcctatatttcaattccagtgtttaatttctggaaggacctatataatggaggcagcatttaattaggaaattatgccaatcaattgtcaaattttcactatgactttcctaaaaaggtgttttcttccaatttctattaatcacaaagaaacataagctgtgactgtatagttcagaaaattaaaacatagaaattaatggcctatgacgttatcaccaaggtgtttggtaaacagtaaactatgagtttggaatcatcaggaagaggcttttgaaacaaccctctggacttcaaaaaatctcttcaggtagtagatgtgtcccaatgtcatggcaattagaacaagagcttcaaagaagcaccgaaggaccactgggctgtttgtgttgtcactaatggctctgtgtatcctctcccagattttcgtgtattcctctttgtgctgtacagctgtcatggccacagccagctcactgatcatttcttctagtttgttctggtgagcttctgtttccatgtcttctctttttgtagcctccccaatatcaatggtgaatatcactatctttggagtcatggtggacactcggtcactaaaacaaaatgtatttgttccatccatgtgagcagaaaatgtgtatttcccactggattctttgtctcctttataaatccttttattcttaggtcctgtaatctccatgttgatgcccaggaagccaccttcgaagatgaggcccatcttggtgcctgaggtgactcacttaagcattcttcagcatgtgcgtggatgctgatgaaatagcccaagaccatggtcaggagagtgttctggagcaacagcagctcagcgagcgtcaccacagtggggctggagcagaggccaggactcgcactgcggcctccagagccactgccgccatcaccaccctactgccttcgcctacctggcactttttgctaatcctaggaaaaacgcaaactcaaatgccttttgtgctgggaggtactgtaaataaatgaacagagaagtctagtgttaagaaaaataagacaggccaagtgcagtggctcacgcctgtaatcctagcactttgggaggctgaggcaggtggatcacgaggtcaggagatagagaccatccaggctaacacagtgaaacccagtctctaataaaaatacaaaaaaaaaaaaaaaaaaaaattagcccagcgtggtggcacgcgcccgtaatcccagctacttgcgaggctgaggcaggagaattgcttgaacttggcaggcgaaggttgcagtgagccagggtctcgccactacactccagcctgggtgatagagcgagactctgtctcaaaaataaataaataaataaaaataaaaaataaaaataagacagcagtacgttactggccgaacatatctgagtcatgcgtcatcaaagaatgttaccagcagtgaatctgtatgggtctgcagcaacctcagttcttacctcttcagaagaaagagttcaaccaaggggcataaggcagaaggagacaccaaagcaagttttagagcaggagtgaaagtttattagaaagctttagagctggaatgaaaggaagtaaagtacacttggaggagggccaagtgagtgacttgagagatcgagtgcatggtttgaccttttgacttggggtttcatatattggcatacttccagggtcttgcctcccttctcccctgagtcttcccatggagtgggctgttcacgtgctgggtggcctgcatgcacagtgtgtttactgcagtggtatgcatacccacttgaggcatgcttcccttacctatcaagcgtccctataaggtcatacaccagttaaactccaccattttgcctcttagtgcacatacttgatcccacgcacccacctcctgagatcttattaggaagctgctgatcaccggttttaggtttcttctgtctgttgggagactattgttccctggtgccagctgcaaccaattattatttgagagaaccatcttaacaactgcctgaccatcacctgatggtcgcctgacattcctggtgggatgtggggtgtccctttactgccccaactcatatctgactagctgactagctacctactgtaacaattacacttgattgcatttttttgttgttatttaatttttatttcataatcataaacttaactctgcaatccagctagggaacaaggaaaacatggaacccaaagggaattgcagcgacaatacaaagattctaggatactgcgagcaaatggggtggaggggtagtctcctgagctacagaaggaatggtctggtggttaagagaaaacacaagtcaaacttagtagagctgtccacagtcagcaatggtgatcttcttgctggccttatcattcctggacccaaagtgttccatggcctccatgatattcatgccttcaccatgccaaagaccacatgcttgccatccaaccactgagtcttggcagggcacatgaaaaactgggaaccatttgtgttgggtccagcatttgccatgggcaagatgccagtacctctatgcttcaggatgaagttctcctcatcaaatttctacctgtagatggacttgccaccagtgccatatggcatgtgaagtcaccaccctgacatataaaccctgtaataattctgtgaaagcaggaaccctcacacccaaatcctttctttccagcgctcagagcacgaaagttttctgctgtctttggaacctcgtctgcaaacagctcgaaggagacgcggcccaagggctccgtgtcaatggcaatgtggaagtacacggtggggttgaccatggctgatagtagggtgctcccggcagtggcagcgtctgcaaagactgcttttttttttttttttttttttgacaaagtctcgctctgtcacccaggctggagtgcagcggcacaatctcggctcactgcaatctccaccttccgggttcaagtgattctcctgcctcagtctccggagtagctgggactacagatgcgagctaccacacctggctaatttcttttgtatttttagtagaggcggggttttgccatgttggccaggtctcaaactcctgacctcaggtgatcggcccacctcggcatcccaaagtgctgggattacaggcgtgagccaccacgcctggcctgattgcatatgaaatgcactatttccccatcctatctcacccccatctttttttaacaaagacttctgaaaatgtatttttcatctttcaaactttgctggacaagtttttatgaatagtctcaacagtgcaagcatgatgctagagagcaattaacctttgacttcagtgttgggagactgcagggagaggtgaagactgcgacaaaccactcgtgtatcatggcaatcgctactccctctcagccatttcttgccaactaggaattcaggcagaatgttgtcagatctttcagttattacagaaaagtaagaaaacctgcattttatgtgaaacttccagattttctagtattttctaatttttgcttgaaatcttttattgttccaatatattttatttctatattcctgtgtagcacacatctggttttttatttgtgtggtttttgttttgttttgttttgttttgtttttaggccagtgagctgacagatcgagacctctgggttatgtcattccttggtcagtagctttcagtctttttcaccactacacccacctcaaccaaccatcctttccaccaaccgatgcccatcacttcctttcagatgttgctgaagaaactatttctccatataattttccctagatcactctatccttcattcctcattaccaaactgttttactcttttagcctttagtatgtatgctctgtggtccattggtgagccctttatctttctctaattacacctggactatagatttctaatgccgaggacccttggtctcctgccacattcacattcccttagcagaatgttgcacacccagcagacagtacatgtatactgtgagtaaatattttgtattcctagtcttgctaggatagaagtttttattctatacttgatgcatttctggatcaaaatattaagtctaagtcaagtctccatagttaaggtaatcttgaggattaaaacacttaggtggacaggcaacataaaacactttatctgaataatgaaagaagaatccgtctgttggtctgaagtatcaaagcaactgtcccaatcctacaaactttcagcattgggacttcctttcaagatgtaagcagggatggaaaatatacaatgcaagcgccattgtttcactctcctgggcctgtgacagacatcattaagtgatcacaacgttcttttcttctaaggctgaatgcagtcttagaaaccattttaacatggtatcctagatgtatcgtgtccatcttgtttatttctattaagaaatagagttggcatgagagctgaagatcctatcatatgaaggtacacatacaatttattattcaaaagccagagaacaacatacaactgctgctgcatctcagtctctctatattttaatttatttattgttttgagacagggtcttgctttgtgcaggagtgcaggctggagtgcagtgataccaacacagcttactgcaacctttgccacccaggctcagaaggtcctcccacctcagcccccaagaagctgggaccacaggcatggcaccaccggcatcccgccatgttaccaaggtctcaaacttctgagctcaagcaatccactcatcttggcctcccaaagtcctgggattacaggggtgagccatcccacctggcctcaatctctgtatattttagaggatagataacttcgaatgggaaaagttgtctctaaagttgaccagtcaagaagaaacaatgcttccactttaatgcctatgccagacttaccttacccattaacttttaatcctgtaagaaagatttgctatgtgatgaggctgcttttgttgcaccttgtaaaacatactgaaataaacaaactgtaaatgactttgcagggattgctgatttaaataaataaattgttataattgtagttacagttatagtcaaggggctatttcatttctcagactctgaaccaaagcaattaggaacaactcagacacaaaatgaccagcatcaagaattacaatgaaaagccaattacctttaactataagaaaccttatttgcatttattaaaacaaatgatctctcagtactggagaaaattatgtggattggttgattaacccttcacttgtaagagaccagaaattacttttcagagagcctgtatcttttctaaatttacagacaggaaaccagtaaatgataaatgatcaaggcccaaggaaaaaactgcatagcacaatggacatctatgagtttcacttgtgctagcatgcattcctcattgtgctggtaccatcatcctcactttcctctggggaatccccttctccagttctgactccagatggtgtagatggagctaacttcactccccactgagaatgagcaaatgaccaatcaatgtatttcaccgatgaatgattcagggagccaatcattaattcgagtcagtccagtactactcaatgctaagatttgagaactactgaaggaactattgtgaaagggaagaatttaaaaaaaatcttgctggcattctgagctggtaagataaaaactttgagcgtctagcggccatctaaccactacaaagtgagaccatgcctatgcgtgagaccaacccaatggaaagaaaactaagagatgatagagacatatttctgatgccatctttgagaagctgcatccaatcattctggaggcaaaaagctcttaactttatagataggcaagccaaaatcttcttactttcattaagccacagttagagctaggtttctgtcatttgtaaataaagaagttaagactaaatgcaaatcacttatagcttattttattactaggtactcaatgtctatgcttttgcatagctaagtgagagaacttaaattccaatactgatgggctattacctcatgcaggtaccctaataaatcttgtttcctctcagtgccattgtttcctcatttctaaaatggagattaaaatggtagctcacaaagaagaaatacaaatggcctataatcacatgaaaaaactgttgaacatcattagtcaagaaggaaatgcaaatcagctctacaatgataccacttcacactcactagaatggctatgatcaaaaagatagacaataacaagtgttttctaggctgtggagaaatttgaagtctcatattggcaagtgggattataaaatggtgcttcaaaaagcatctggcagttccttaaaaagttaaacatagagttaccgtgtgacccagcaagtctactcctaggtatatacctctgaggaaataaatatacaagtacacacacacatacaaattaaaaagtccataaccacattattcttaacagccaaaatgtgggaaaaaaaaccttaaatttccatttactaatgaatggataaacaaaatgtgtcatatccacacaatgggcattatttggcaataaaaagaaatgaagttctgttacatctcacaacatggatgagccttgaaaacattatgctatgtgagaaaagctagtcacaaagaccacatatcatatgattccatttatgtgaaatgtccagaataggtaaattcacagagatagcaagtagattggcagtcaccaggacataggaggagaggaaggacagtgactgttaatggctaggggtttcttttcagagtgatgaaaatgttctagaattagatagtggtaatggctactcaactttgtatttatactaaaaccaccaagtttcacattataaacggataaacattgtgctatgtgaattatttcaataagaaaaatatcttatagaaaaaaaatggtagcctattctgattctcacaaatgaccattataagaaatccatgatgataacaatattaaagtgacgttcttgttggagcctaaggaaaaacaatccatacaaatgcaaaggcctattgtttttaaggcctcagcaagtgctaagagaatgggaaaagaaaattaccaaatagattttcccagatcacttagcttcctttgtatccagcaatggtcaacaaatatatagcaggcatacataaaagctattcggagatctcttgaggttaacagcatgcaacatattgccactgcccccagcctggccaggaatattatttatgccaccctttcacagctgtatcaatctcccatgaaacattcagagcctccttgttaataaactacattatgagccggatgcattgtctggataaactgcattgtccaaaacactgccccattattacagaaaatgcagaatgtaattagtattcttctttgcataaactgcagcttccaaaaatggtgccatattataaagccttaattaataaacaagagttgggccatgaccagttacacttatctgaattttatattgtgaagaaaggccactgttcaaattccgtttacaaatatctaaattctggctagcctacatgaagatagtctaaacagaaagcctgagaattctgtgttgctaatagcattgtgttggtacaccaacaatagcaagccattaactgctgggacataaaccatcctgagaaatgttcagagtggaaggatgataacattgtatttcagctgcatcgtatggtgcaattcttctatttgttcatatgcatttcccatttaatagatggaggaaccagggtggcttttcatatctctgtgaaaccttaaatgtgggggagaaaagtgagctggcaaaaaaacaaaaaggataagtacgaggtattgtggggtgggagcagggttacatcacaatggaatgtaagtacacagttgctttctccatttccagctggtttttattgattttcccctaacctaaccccaaagcaaggccatttacataagtcatgagcattgaactaatatttgggaccataatattaagcagcccattttatgaacctcggctaaaggagcatttgcattaaactgcactcacctgattaaaatccatcaactctagcaccttgagaattgtagagtacctgttaagctcggctgtgggactctgcatactgaggcagaccataatcagaaggcagcaaggaatccgaccgggagaggaaagggaggaggagaacatgtgatgtgtgttgaaaagcagatcgcatgaaagaccgccagtgctcaaatctgaaaagagtcctaagcctactgcaaacacagagctgtgcgaacatgataattctttcagcaaagtccataatatggcttatagggccctgtgaaaacaaggtggatgagatagtattacagttcagtgaagagtaactggcccagcaatggaatgtagcatacacaggaggccccaaaatggtccctgcctcagcagaatgagcaagagctcagagagtccaagccgagggactttctgcagcctaaacaagccgtcttagatcactgccctttccatcagctccaggtaccaagcacaggctcagagtcctatctgtctcagaaggacctgctttaccgtgaccgcaaggatggcatttgaatcagtaataggctgtcagaggccaccttgatgcatttgaagaagagctatccctgagacattggttcaagttctcgatctgtaccacctagctgtgtggtcacggacaagcagtcttgctcatctgaccaagtggatgcagataataaacacatgtgaaatgaatgaatgagagaataagacctctgaagcagaatttctctccccagtgatacagacagaagacaaggaaatactgggtagaagagggaggttccctggcaaaggccccaacctcaagcctggagacctgcggcccctaagtggggcatttctgtttttgtacccaaacggttgccttttggcatgccacactcccttatcctgtacccatataaatcccggaccccaggctccaggagcagacaaggagaagaggagaaaagcagacaaatgacacaacagagaaagagagaggagaaggaatgtctgaacgccgagaggaactcagctgggggcagtcggagaagagtttggccgctgaacagccaaaactccaggggaagatcatcttcccattccatcccccagccagctccccatccatcccattgagagccacctccaccactgaataaaacccctgcatgcatccttcaagcctgtgtgtgacccaattcttctaggatgctggacaagagcttgggatacagaaagctgtcacactggccctctgcccttgcagaaaggcagagggagcactgagctggttaacacttaagctatctgtgaatggcagagctaaaagagcattgtaacactggggccacaggcacccacccctagacactaccatgggactggagcccaaagcactcactcttgctcctgcacctggccatctgtgtgctccctctcccacaaggggtttgagttcatggtggttgaacagagagccgcacccctgtcgcatgccccatgagtggggccagggaactcttctgtttcatcaacactattgacatttgaggtgggatgattctttactggggaggctgtcctgtgcattgcaggatgttcatccctggcctctacctacaagatggtagtagcacacatactccctcaattataacaaccaaaaagtctccagacattgccatatgtctctcaagagccaaaattattcccagttgagaatctctaatttatccttcagaatgtacattccaggatctaaattaatgagccatacacccagatagtgccccctaattattaggaaaacttacatagataccttcattatcactggaaattcatcaagacaaaaattttactgagcacctattatctgccatgtagaaagatactgttcctgctcctgagaagctcacaagtttaagtggaaagtggcattttacaacttcacatcaaagaaaagagaaatgttcaggtaaccatctttccaataaataatagaatatccttctatctgattagagaggtgaactgtaaagacaggcaagaatcagagcatatctctttgctattaaaagaatactacatgtatcaaagttgctgacatttgataaggtgaatttttggtaattttgactcattttagatgtttgctgcagttgtttattgctgggtgcagggagtctcagactcaaaggacaatcttatgaggtggtttagcctaagagcataagccaaaagagagagctctggaatgaaactgcctggttttaaatctagattctgccatttgcttgttacgtgacccctggcaattcattaaccccttcaatcctcaaatccttctctatgaaaaggagataatcaatgtacctacctcacggatttgttaaaagggttaaataacttatgtaaagtgctgaacacaatgcctcccacaaagcaaaaattgtaagaacaatagctgttagcattgttatattgatattgctgcctctccattttattatgatcttttttattgtagtaaaatacatgtaatataaaatgtgccatttcaatcatctttaagtctacagttcagtggcattaggtacattcatattattttgcaaccattaccatcatccatctctagaacatcttttattttccccagttgaaatttcccattcctccctccaccagggttgttctcttaaaccagtccttacccagcaaaataccttctaaggaaatgaggacaaagcttttgtaaatgagactaaaggcaattcaaactcaggtaccctggaaactgaatagaggtagtgcttaaaatggccatttgggccacttggggttatgttgatgagtttagtcaccatgaaccaactcctaggagtaacattctaagtgggtttttgttttgttttgttttttgttttgaggcaaatggttcctggctctgtggccttcccatcttaccatcacagaagcattcactctactcctctaatcaatattaacccagaaaaaaagtccagggacatatatattttggtagcctagaattaatgggaaaagacaagttgctgggtctaaactatcaaagtcacgtactttttaacagagaatgaacaaacctcctcccttcaagaatccacctgtttttgcaagagcattctggggtgggaggaaaaccttctgatttctagccagctcctcaaaatagctaaagagttcctaatttcacctcaaacctctgtttcagcacctactgtgttgtgccaagttatttctcatccactatcatttttgacagtggatctgaccctattgcaatcgagtttaaggagtttgtagacaggaaccctatctgagctgtcagcacgttgcctgatcatcttcagcaagtggtctggcagaagcatgcaggtaaggatgccctgaagcaggctgtcaagaaaactgaccaatgagaaaggtgttttgtgctccacagctgaagccaattctgctgggacatcccaagacagactccactcggactcaactgataatacacactttacatctgtcactatctgcccaggcatattgactttgtaacattccccccaggcacttcaagtccagtttcgactctgtgacttttgcctgtggtcactttgcctgaaatgccctttctccttctccttcttatccattcattaggatctagcaaaatgtacctcctttgaaaagcactttctgtagccctcaggcacaagtggggatggctgtgttggaccagaaaaagcaaccattgaaatttccaaactgaatctgtactttgatttatttcagtgtggtataatgtatggtataatatatggcaatgttttccaagtctgactgtacatcacagtgacctgggggacttttgaaaaatagattcccaggctcccctccaattaagacagcaggtcagaaggttgcaactcaggaagctttacttaatgtctagaagtttcccaggatattctgatgcatgaaccgtacttgaaacaatagtcagacattgctacttatcagctgtgtgatttggggcactctgagcttgtttcctcatctgtaaaatagcggggaagtaggggagtgtcacaaggtcttagaaaggaccacatgagggaatgagtgcaaaattcttaaatgatgcctcagtaagtgaaattatgatgctaattacaacgaatgtccttaaaaagctacttttcacttccaatagtccagcttgcaaaaccttcctctatcagagaaaaatttagtgaaagagtaaatgggcttcacaccaggatgatagcctggaaaaatcaaaagagacattgagacattgcccacatagaaagcaggggaagagcatgttcagtttttctgaaggtctatattcttcattcctactgtccatttctcctgattaaaagtctctcccaatagctgagaccattaacaaatataagcccatcaaatggtagctaccccactttgtaaaattaggcttttgtgtctctcatagaataatgttctaacacttcactacctgtaataaagtatttgcaccacaagaaaaaaatgtatttcatgaccagcaggctacaaccagcattctgcttttaggaacccatgcgtttgattgtatcctaagttggtaatgagtcaccacttttgcatttagttaaggacaccaaacaatgactctgtgaacctcagctcagactgcccctgagtcctcagaagatgcctaaatatggactgttctgtagcgcttaaggatatcaaatgacagtataccatgacaatcacaactaatcgaagtcccctgcagagtagttcctcataaagagatggagatggaaaagtaggaacgtttttcaatgctatgcagaaggaaaataatacctactgaccatattcatcctttcaaaggtctgccctgaaggcaagttgacaacacccaggcttggttctcccttttggaagagctaacgctaggagagttcacccttgctccctctggcgggaatcagcagaacagagcgggaggcactgtggcattaggattgcaaaccctggcttcggacacagtgctgcttgaatcagaatctacactgcagctgggcaactggctgaggtcacatttttaggctctgagctgctttctctatttgcaaagtgagaatacacagcttctaaggtcataatgcagatcaaattatatataaagcacttaacatgtgctcagtaaaaagtcattgatctaattattgttgtactttattgtcattaatatcaagggaatgacagcatagtgagtctcctagggatgcaggtcaatagatgttgaactgctattatgcagcaggtactgtgctaggtcctgggtaataccagagcaaacaagatcaacacaatctgcacctccaggaagcttatggtctagttcagaggtaggaaaaatgtgttttgtttggcctgcaccttgtgtataaacacaaaacatagagcaaacattttaaacttggatgacttcacaccacagtccagatttctggcttctctttgaaaacatcagaaattctgagagtaagggagatttctgtccacatgccaagccttctaagtcccaaagcaccaaccttccactggagagtggcctgctggctcttctcattaagaaaaatctccctctggctacacatgatgaggggcctggaggaattaagagagatgaggtagctgaggacacaggtccaggggaccagaactgaagcaaggaaggagaaaggagactcagcgctggttctctttcacggggtttttttgtctctcagctcagctcgctctgtttggctggacacagaaaaccctggaggagaattctgattccaacttgctctttgcacagttaattatttggagctcccagaaggttggagagaacaatgacttcccctgcagtggcagctggactagcttagttcccttttctgcccccaggggtcagaacccaaggaaggggggctatttgttttggccttaaaccaaatctgcctagagacacagagcgatgctctgacctgagaccacaaaagctactatttcaatgcctggtaaagctcctctctcttgccgtccacagcagtctactgacgaaaaacgcgttttccctatgcaaactgtttacttctctcctttgcaaattggaagtaatgtaaaaaaaaaaacaaaacaaaacaaaaaaaaaaaaaaacagaaagaaaagaaaagaaaaaaacctatatgcacaagaattccatctctccttgcaaataagatatttcacatttccttaggcagatagcatgcagacaagtaggggaactaattgggatggatcagtgaaaacaacgaaagctcatttatacacaacttgctaagtgtccacaactttgttctaataggggatccatgacaagtccctcaaaaacagagaaacaggagagaataatttacactttatagttgtgagccctgtaacagtagaacaaccttcctgcagtcccagagagattgtccccacatctaaccaaaaccattaccatcaatggtgtcctgcattttgaacagttgttaatgaagtcttgcctgacccaatacagagtgaaatgggtgtagttgctgctacaggctgccttctagccttcctgcatctgaatacattttctctgttggctgttctgatagagattcatctggaattcttaactagataaatccctcaatgacaaggtaaggcccatcttctgattaaacttgtattgaatttatttatttggccaatcatgtaatccatatttattaggtaccttttaagcaccaagcattgtgctgagtgacggggatatcaaggtgagtcaaaacaaccatagtccctgtccttagaagtccagaggggctgggtgcagtggctcacacctgtaatcccagcttttagggaggcagaggcgggaggatagcatgagcccaggagtttgagacctgccagggcaatataggaagaccccattctccacaaaaagggggaaaaaagcaagtccagagaaaaggaagctactaatcaaaagatctcacaaatataaaactgaccctctgaaaggtgtataagaagtattttggtactaggaggctctattacaaagagttcgtctagatatggggtggcagataatttgtctcagaagaaacagtacttgagctgacatttaaagccaggggaaaagcatcataggcagcgggaatcaaacactcaaaggccttgccgtgaggctgagcagtaaacataaggactgaataaagaccagtgagattggtgtggagaatgcaaggaatagagtgatgaagatggagagttggtagggaccgtgcaaggccttgtggagcacttcaaagatttccagcaacataaagctatttaaagatgtttaagcagggtataatggtggtagttgatgtgatcagatttacgctttgaaaaaatatagattagagttggcattttggggggacacagagtagatccaggtagatccaggtagaccaagtagtctagacctcctaggtcacaggtgtctaggaggggatggtaatttggacttggatggtatggcgctagaggtgatgtagccacattgacatattctaacaatagttactctggtaccaacccaatataccagagtcatccaatggcccaagagtggtactaactgtaattcctgattctgtgaagctgagtaaaaacatttagaaagaccaaactaaaaaggatctgaacgcatctgtactccctcatccccagcagcaaggtaccaccacgtactctgagtgatcatagctttatacttgaattgacaaattctgcataagactccacaggaaacccattaaataggcagggaagaaaatgctcaccattcagcattgacaagaaagatgataacaagcaagttttcagtcaaagtgggtaaaatgttgaatttctactctagtgtcattagcactgcacctgattttttaaaacaatattttggttaatcaaaactctgggtcaatcaactgttccacagtgacagctcctgtggtcatcaatctttgttatcgcttgaagctgacatggtctcggtccacaggagagtaagcagcaaaagacaaaggtttctcttcatttcccccaaagggagttaagcaatgagtcataaaagcatctaaattattcacatggctttccagaagtttatgattcaagatttgggagagataattgaaggaggtggggtgggaaacgtaacactggatgaacacatttattttgaaaatgaaaggatgagtttctgaggtagacccaattaccacacacagggcttcaggagcgacagcagcggcctatggttccgccacacaatgcttcattcattccttacatgggttcggacgatcattattaacctacagtcacctgagaaaagctcagtgtctgccaatcagtcacactggacttttgtggaaatggaaaaaggaagagagagtaagaagggagggatggagcaagggtatggagggaatgtgaggaaagcacaaggaggggccagaaggtgtcagctggtggaggagataaaatgttttctgtttctgttttacttgtagggtataagaaagagacatcagtgtgaagatatgccactgggtaggggctgagggttgtttgtatgtttgtttgttaataaacgtggcttgaattagatatatggctctccgttttagtatataagaaatacaagtaaaagagttcagctattgtgaaacttcattctcttgccaaatggagtttccttgactgtaatgctccaagactgaaccatgtacattcactatttataaaagctagacatgcatttattgaacctaccagatgtaggtactgtaaccaggcatgattaacagtagaaagaactgaaaaacccttcatgattcagccttagtttaccttactggttttatctcctgtgaattctcctttaaaactaagatcacagttctgtggttcttggaattcacaaaaaaaaaaaaaaatgctctacttcccctctgtgtatgtgagtattctctctgcactgaatgcccttcctccttcatctagcagcactgctcctctctgcctggaattgtctaattcctgccattcctcggatctgtttagacataacttcctcaggatgccatcctgaattctgagctgagtcaggtatcccttctcagggctctcactgagcttatctcaacagtagtctaggtagcattcaatcataattagatagtgtgcaagctttctgatggcagaggctaagacgttatcatgtttgtatccccagcccctagcacaccatgaaacacaaaatgcccaataaatttttgctgaataaataaaaaaatacaatacttgatacccaactccaaggcactttcagtgtagttagtaaagatagaacattttgaaacataacacagcacagggcaatatgaaagaaaataaaaaattaaataaatctgttataagcaacaaagcaggtatttagagaaggcaaagattacttttagctggggtgacaggagcaacagaatcaacgacaattcaatgtgtgttcatgacacaagtcctgtgttagttgttttcaacaacaaccctgtaacttgataatattatccccattaacaaatgtggaacccaaggttcagagaggtaagtgatttttcaaggttatataatcagcaatgccaggatttgaatgatgaatctaagatttcaaaacactgagaatggaaaggtgggtatcccaggtagagtaaaaacagaaacagaaaaaaatgtgcaagtgcatctcagtgtaatgtatgtcctggggattaaaaacaaatcaacttgatataatctattataggaatgctaaggatgctgatcctagcaagtaagctgtgactagactgctgggggccttgagtgtcatgctgaggaacttgggtgctgaggagccattagaagctttggagtagagaaaatgtgatcagagctgaaactctgaaagccttattagagagtgggagataggatgaactggaaagataagaaggaagtttgcaggcaaggtaattctgttggggacaaaaaaacttttcctttatcttcttatgttaggtatttgggggcctgcaaattaaactgacaaaccacagattaacaggagaaaagtttatttatgtgcatatggaagcttacaaaagaagtaactcaataaatggttaaagttagaggcttatacagtcttgcctgggtatccatggggaattggttccaggaccctctctcgccctccatcggataccagaatccaggttcacattccttatataaaatagcaaatataacctgtacacatcctcccgtataatttaaatcatatctaggccaagtgcggtggctcacacctgtaatcccagcactttgggaggccgaggtgggcggatcacttgaggtcaggagttcaagaccagcctggccaacacagggaaagcacatctctactaaaaacacaaaaattagccaggtgtggtggcacacgcctgtaatcctagctacttgggaggctgaggcaggagaaatgcttgaacccgagaggcagaggttgcagtgagcctagattgagccactggactccagcctgggcaacagagtgaactccatctcaaaacaacaacaacaaaaatcatatctagattacttataacacctaatacaatctaagtgctacataattattacattgtattgtttaagcaataatgacaagagaaaaaagtctatacatgttcagcacagatgcaattttctttttttcaaatagttttgatccactgttaattgaacctcagatatggaggggcaaatgtataactaccttagtagggaaaaaggagtgggagaaaagacctctttggaaagaataagcaggtttctacaggaaaaacaatgagagataagaaagtttgtaataatgtttgttcatccaggtacgagtggtctctctgtcttcttcaaggctataaaactcccccagagaggatatttatgatatattgagtctccttcctaggagtaaaagccaccctgaagaaggaatttatgaaagcctcatttcccagaagtttctgctattagtcaaataagagaagctctgagacggttttttttccgcatctgttgaatcccaaatgtcttcagcttaaaataatcttcagaccaactctgggcttctgagtgggtacccgacattaccacctaggagcctagcacaactctccagctccaaaggcactgatgtctgggatggagggaaagggtggattcaagccctactgtgagagaagacaccaacagcccctaacagctgagttattgtgcgtctgaaagagaaggaactaatggtgacttaaaagcattaagccaagatgacagagagatcattgtcaccactaacacaaataaggaagccagtcaggagaaagtactagtttgaagggggaaattttaaacatgctgaataagacacagcaggaaaaatctctaggagacaattggaaacgtggaaccagaaaaccagaaagtgatcagtgcaggaaatgcaacttgggagtcatttgcctaaagccataacttgaagccatagtaaatgtgggtatatctccaaggattaaggaatagagaaagaagactagaaggtaagcaacaaatcttagttaatactcaaatttagatggtctgcatgtgacattaacaagtgaaagatacaaagaattaagattaaagtgcccagtataagtctgacactaaactgggaactttttctatgtcattttatgacgtaggcactacctctatttcattaaaaccaaggctgagagtaatgtatcttgtcaaagccatataactagtagacaacagagatgggatcaaaggcatgttgcctcactcagggaccatctgactcatgccttcatggacaggactgtgggatggagggcaatggaggaagagttttcaggagtgcataggatgaacgtagtcaaaggcaatggggaccgagaagaggccactgaattctgagtcctctgagaggactcacctctcagaaatagttgcagtataaggtctaaaatcaaggcccccatattttgtgctgctttgacatatggagaaattcaggagggcctcaaatgacctaatgacaagttcccctcctgacatggtttggctgtgcctccacccaaatcttatcttgaattgtaactcccacaattcccacatgttgtgggaggaacccagcaggaggtgattgaattatgggagcaagtctttcctgcactgttcacatgatcatgaatcagtctcacaagatctgatggtttttaaaatgggagtttccctgcacaaggtctctctttgcctgctgccctccatgtaagatgtgacttgctcctccttgcctttagccatgatcatgaggtctctccagccatgtggaacagtaagtccaataaacctctttcttttgtaaatcacccagtctccgatatatctttatcagcagtgtgaaaacagactaatacacctcccagctctgctcctgcaaataaagtcccccagccaaacaaccctccctgtcatgtgaaccaggcatggttcctgcttattcctcttattccggagtagtggatttcagtttcctgccagcctgcagaattattcagacaagccgacttcatcctcccatagaaacagggataatcccacccctcttaatactaaagccttcttcccacatcccctgattgctcactgtgttcccaagtgcaactcccacgtggacctgtgtggcactcagggtccttcctccctgggctgtgagtatatgtgactaacaaactgctgtctcactggtccagtgttgttcagtcatctttctaaccctagggtgggaccctttctcaccaaccaggtaagtcgagagtggttagaacaacagaagacaccagagtgtttactgtggaagtaacatgggtgaaatgcttcactttaataactactggctttattacaactgaagaaatctgagaaatggatgattactcttttctaattttatataggaggaaactgaggaacagagaggtgttcaatggatacttagagtgagacagcaccaaattatttttctcactttaatgttgcattgttctcaaatattttttttacaagatcctttccagatgcttctatgagaatcacatatatccagtatttacagaaagccattgcaagcaataaggaaaatccaaaaagcaaaatatgggcaaaggataggaacagataatttccaaaagaagaaataggaatgccaatgatggcataatgtccaacctcactatgaatcaaagaaattcaaacaaaaattacaacaaatatttttgtccctttttggttgagaaagctttatactacccactgttggtgagattttaaggaattggagatgctcatacacagatgggataagtagaaatcagtatctctctgaaaggcagggtagcaactttctcaaaatctttaatggtagtattttatgaaaaaaaaattcattcgtaggattatatccaaaggaaacaacttgtgaaattcataaatgtatatggatgagaatgcttattcattgtttttttataatataaaaaaaccagaaacaatctaaatgcccatcaaaaggggataggctaagtaagttgtggtacacctataaaatagaatactatgcagtcttttaagtggaagatgtagatgtatatttatcaacataggaagatgatatttggttttaaaaactaggttataaagctgcaggtggaagagtacacatattatgtaaaatgtttataaaattttgtgtttttctacgtacacgcataatgagacatttgttgggaaatttgcaaagttttagtattccatagtcttcaaatttcaggtgagtcttactctcttctttagtttatcccaaaggcacatatcagtaatcaggaaataaaaggttgttttcactgggggtgggggaacacatggagaggaatgaataggtcacctcaaaaagaaagcatacttcaggaagaacttacacaaattacacaacatactttgcttttgcacttattttttatttcccaacagataacacgtgaaattccagaaaggggagaatcaattgtgcattcgatttttcacagggagctcatgaaactaaggcttctgtgcagcagcagggccatggagtggaaactggaaggcgactggggtcagtaggtgctggccagtccctctctgattgaaaaggacatgtgaagggtgccaagtgagacctcctctccaagttctcaacaatggctacttttttgcgttttattttgtgaacaattcgaacccacaaccctggatacattccacttgtgtaggtttccccttcagacagcaaatgctgctgtttccaaatccaatcatgagtgtttgctgttggagcgcttggtgtaaggcatgtgtgtcctataaaatatgtttctcaaaacttaactttttaagaaatcagtcactggtttatctcccaattctatcacccagaagaagagaaagatgccaaaacagatcccacagagagtttcattctgaaaaacagacatttaatgtagttattctgaaaaaaatacaaactgtattatgtcactttagaaatttcaaaatagagatctctaggtatcccgttaggcatctgtcgtgctcccaattacattactttcgacagccctaagagaagcaatatttattggcctactaagtctttaagaatgcaaaacttaacccatctggaactagttgtgttgttggctccagggttccttacatcagaacaaattcagacataaactctgggacagttcttgaatattgcatgaaggtgagttgcaggcattcacacaacacagcattgtcttttaaagcatttttataaagcagatccaaaggctggcaaacctttccttcaccataaaggaaatctaggctaaaggggaaaataagaagtttatgaactattaaaaaaataaagctgtggagttagggagttatggattaggttccaatccattaattcttttattctctggcagagctggctgaagatgtgcagccctctggcgggtaacagaaacattcatgtccagaacaatcacaaaaagggagagaaatggctggcagagcagagggcggatccactcatttggatgttaatttatacagaaatctggaattcaataatctcacatcccccaggtaagggagcgatccactctccaatttcatttgggagttctattacattaagcaatattctgtttggccagacatgccattcttctcttgaaggaaattaatttcttgattcttccatctaataatctaatataatcccaagtcagtgctttaagttttctcatgacactactagacaaaataaactctgaagtacctcttgtgggaactcacaagatacagatgaaaacaaaagaagaaagtaaaattgaagagggtgaggccagggacaattaggtattgaactgcctgccctgcctctgacacatgatacatgtgatttgttaagacgattttctatccttaactcttcactaagtagggctgctttacaatttccataggaaatttatttttaagtatgtaaggcctgtgaacaggataaataaaagattacaaggaaaaaaaaaagcagtgatttctggttgtttaaaaggcaactcaacaagcctttcccagcaaaaggaaaaggtcaggatcaataaaagggcctttcctttgggaggagatctgttttcaatttaacaaaaataaatccttatggtgtagtcttctgaagaccaaggaaacatcaagctatacaagggatctggccttaccaggataagaaaacttcttcatttgatattctccaataatatcaaaacaaagtaaactgtacccactttgcactctttctcggccccctgcctgttagtgaaaggccagttaacctgaaaaatgaaaaccagctcttaaatgtaaagatgatactactcattgatgcaatgttatcctgatagtggcttttcagagatatcatcttaagcgtgatatcaacagggggaatctcacatacgagtagaggctggtttagaaaaatcctgcaggatatggagtgtctttggtgacagaagtcatactcttaaaggtatcttggtcaaactcatcatctcttactctttttatattagccgggcgtggtggcacatgcctgtaatcccagctatttgggaggctgaagcaggagaatggcttgaacacaggaggcagaggttgcggtgagctaagatcgcgccactgcactccagcctgggtgagaagagtgaaactctgtctcaaaaaaaaaaaagtactggctcaactactatgatgagaagcttttgggagatactcagtggtaatgtcagccttattttctgtggcaaatctgaatctttgctgccgtaacacagttgttttcaacatttaccctttctacactcataggcacacacacaattttaactgatgaattcatagaattcataaacctgacagtgtcccattgctggaaccttagtcatacccattcctagctcttgctaactataacttctccatttttccttcctctcaagaaagtatattagattgcaaggttgcaagagagtaagagtcttaaccttaaatatgctttcatttattagaaaaaaggaaatcatctgcatccttcagcaatttaaatattattagagaaaaacctggtgggattcagcatcaaagttattctcctttctggcatgacctcctctcagcacttcttcaagtatataaatcctaccaatacctcaaggtccatctactctgtattctgaaaatactccaatctcctctccctggaatctaccaggactctcaaactcaagtgttttccagcagtcaggaaagttagttgcatgctgcaggccaattttcaggcatgtgtgtttactggatgagtgatgaggacatgacaacagaagagaacacgtcctccctgaagggggcagcagccagtcagtcccatcccattgctgtcaggtgggaatgcaggcccatagctacccgatcttccaatgttttaagataagtcgaaaatctgcattctatggataatatctcaacttcaaatgttggctcacttaggatgacaatgactctgtgatctgcattggacccatggaaccactaatttgcaacctctggtttctacaaaacatgaagctgactgataaatgacaagcttgtgccatttatcagcaagtgtttgctatttcacatcatcagtcacatcagtatttcagagagccataaataaatgtataagttataggtaacaaaaataaagcagggctttaacttaattatctttaatttagcttatttaaagtttcaaataacatgtaaagagggcctgagatatttatatttagaaatttagagacattggttaaataagttaaggaacaatgagccagactctgaagtcccagcaaggagggactgtatctttgttttattcagtacctatcaagagtgctaagtacacaggtttgaatggaactgatttgaatcatttaaggaaaaaggttccagacaaacattgcatgcattagaaactgagtatttcccgattaaacatacaccacccttacatttccaaagtgtcagcaaagcattctgttctttggtcaaatcttgtaaaagccacttactcctaaatatttttactttgtaaccttcaccgttccaagttcatctaaaagaataaagaaaatacctggcacagagaatgcattcaaagtgtattagttaaatttcactaaaaagaagtaaacaaaagacaaaaaacttcaatgcatcttgattctctgtagagagagcaccttgtggcttgggcttcttctatcaaacacatacccacacctttttgtcagataaactcatttggtttttcttgtgtaatggggtgagtattgtacaaggtttcaatgccttttttttccaactcacattgtcccttagaagctcgaagtactaacaaagtgcttcaccacacaaaagtgctgtctacatttgtctggcaaatacgatgccaaacgaaaagcctgatgagtctgcaattcgtcatgggcatgatcaagctccaggctgcttccaccagagagcaaattcaacattataaaggaagtgtggacaggaaagccttccagcaagattctcagaatatggacatgagattcaaagactaataaaatgggttggggagacggtattgatgaagaagcagccggagaggaaaaaaggaggatttgagcagatgtctgtcactaaagaaagtgaaagacacagaggaaagagaagatctatgttatcacctgtgatcctaaaacaactctaggaattaggccgcattatccttgcttttatagaggaagaaaatgtggaacagaaaagctgaataacttgtcacagtcttacccagccaattagtggcttaactggagtttggccaggtctttttgtctgtatagcacaaaccttgtgaccacacagcactaacttccaataagtcacccaaaaagtcagctgcatgtaattagctctgctgtgaaactatggactggggaaagggcattgttcatttgttagcttaatttttgttaaaggcatacaagaccaaccacaaaaaaagaaaaacaaaaacaaaacaaacaaacaacagcaaaaaaaaatcagccagagctgtagaaaatcaactctgtcattagtaagtatattttattcaagtatgtgttattaatatatttgagatctcccaaatactaaagagatagaaatttagatacattggagataaacttcaagtaagctattttttcactattgcataaatgggaagatattttcattgaaaataatgttcctttactcaatcacccaatatttattgagaaaccacctgggccagacattgttctgaattctgaagatcagagagtgaacaagaagcaactgactttgttttgtttacagttcagattgaacaaagcaatggcaacagagaaagaaagagaagccatttatggtttgtgataaatgctgtgaaggaaatattttctgatagagaatgaatggaaaacttcctttaggcaaagaggacaggaagggcctccttaggtgattgtgtctaaatgagtcaagcatgtcgagggttgaagaaagggtgctgcaggcagagagataagagtatgctaagagccggtgaggacactgaacttagctcttcctgggaagtggcagccccttgagttggtgcagtgaccagggtggacatgtgtagtataagcttcagggaagaggtgagtagaaaccagccagcccctcatgggtctggtataccactagagtgcgtttggaattaattgtaagcacaagagaaagctgttgaatgattcagtcttcaacaagggaacaacatgaacagattggtggttttattttggctgccatgtgaagaatggatgacacgacactcgcatagaagtggaagactagtctagagtttggaagatagcacttggacgtcctgctggatgcctgccattaccctctggatctgccctccaccctttcctcgcctgttgcctgcctcagaggctggcttacatggactacggcccagggctctctagcttccagttagtttggtcaatgggaaaccccagccagagatcagaagggaggagaaagaacttaggatattagtccctcagcaccctgtcacctccaagcagagtttctcacaggttggttgtatcccaccacccagggctgctggtccttcaggtggcctctgccaaggggcctgtcacacagctctccctcaggtcccaataaccttccctctcctatgcctctttcctcccctttacccttcaggagttgagtagcatcagaaaacgctgcagctagccccaaggtactgcactctgtcttgtagtttgaaaatgctacctttgttaaactctagtcaaattacccaatgtatggatgccatctgtttcctgtggggctgactgatacaggaagagagaagcaagatactattttgacacgttcagttactgtgatccttgagtaacattctgtttagcttgagttcatataactcaaaaggttatcaaggaaatcttacacccttttacctttttaggagaagcaacaaattcaccaaagaggtaaaatgccaaaatcatgggcgtgcggattcagaaaataaaataagcattagtggtcatcagtatttgatttcaggccaattgttagagctgtcgcttaaaaatttagatgtacatttctcattccatgtttcatttattcaatcaatgtttattgagtgcctactacttgcaaggcactattttatgaactagacatagagcagagaccaaaacaaaatgcctactctcttggagcttacattctgggggagaatcagaaaataaacaactcaatgatatcttatgtgcttataagaaatggttaacaggaatagagagtgggagatcagcaagaggactgctgatttataaaagacagagtaggcctttcttaaaaggtgataatctgagcagagatctaaaggaaaagatgaagcaagctacggcgatgtccagggcaagtgtgttctgggggcggaaatcatgagatgacgaggtgtgggtggcacttttgagtaccagtagaaggccagtgccactgtagcagaggaagtaaggaggacattggcagcctatgcaatcagggagacggcagggacaagatgaatagcctcaagaactttggcttctattttgagacaataagtttttatggttttgagtagaacagtgataggaattgatttaggttcaaggggctcattctggctactgtgttgcaaataaggtggcaaggatagaaatagagaacacttacgcaaaagtctagagcaaagatggtgacttagaccagggttgtagcatttatatttgatatgccatttaaatatccaagggaacatgagtaggcatgggatgtgtaaccgaagtctagagttgaaagaagaggtctaagctagagatagagatttcgaaaacatcagtatttaaccttgacagtggatgagattttctaggaagtgaggagagcattaagagacaagtttttaaggatggagccctgagtcattacagattgacagatcagaaagaggatgatgaccagcaaggagaccaaaaaggccagtgtggttaagtgggaaaccaagagggtgtggtgtccccaaagccaactgaaaaaaaagtatgtcacgaaggaggaagtgatcaactgtatcatgtactgctgatagatcaagtaagaatagaactgagtagaaaaatggatttggcaaccaaggggccatggatgacccagacaagtgcattctgagaagcggtggggatgaaagtgggatggagagaacatgtgcaggcaactcctctgatgttctttgctgtaaatgggaagcagagaaacgtgggagctggaatgaattatgcaggcttctttctttttttcttttcccttccttccttcctgctttccttttttccttccttcctgcttgcctttctcccttcttttctttcttccttcctttatctttctttcttttctccctctcttactctctttatttcttttctttatctctttctctttctttccatttctctctttccttcctttgttctttttctctctcctttcgttctttcatctctttagtttagagacactacagcatcttcatatcctctcagaattgtctagtagggagaggaacccaaatgatgcaggagagaacagataattgcggaagccaagtgtttttgtaggcatgtgttgaggttcacggcaccatgaaggccgagggtggaagcagaacagttcagagagcacatggtctaggagcaggtaggctagtgagagcatgtggaggtttcctcctgactgagctttgctcagtaaaacaggaagtaagggcatacacatagcaggaccagcagagagaagctattggagatctgagaaaagggtgggaaatagtcatccagggcaagtgggtggagtagggtcctgcagtaggattgctgagcagtgtgttgggctttaaactgcctttcatatgaatccacaaatcctactaatattaatgaaagatattaattttcatttttcctgctcccgtcagcttaaaacgaaaagtttctctacttagcccatgaggagtcagaaaagaaaaagtaatgcccagcaaatttctccttcctaagctagaaaggaaaaaataagatattcatgtaaggaaaataaagaagacatggcaacttgaaattatgaagaaattccaaatgttgcatttggtagtgttcttaagctaccataagagatcttcattctattctgggtagggagaatgtacgtggcagttgctaggaatgatcctttgcccgtgatccttcccatgtggtaccccactgtccccaatagacctgagtggcacaaccaacaaaacaacattcaaatatatggaaatgatctttattttagactctttctcatttagcctgttgggctccgagaatgtgaaaaataaatctgaagccttacttttaatagctttcttataaattatccccagtatgtaaaagcccagctcctagatataaccagaagaagggggaggggggaaagactaatgacctttgacattaaaatttaaaatgtcctgcatgcaaatacactttcctgccactcttttgtaatgcaataaccagcaagaattagaattgcaaaaattccaaaagagctacatggaaattatacaacaaagtggtttcacagtgatattgagaaaggaatatgaaatgaatacaagataacatagagacagaatggggtgttacagatgtatgagtgaacgtgcgtatgagcacatgcatgtctcagagagagcaacagataaaaaattatttctttttttatgttgctcttcatgagcaaaattttaagacagacactgttctggtcacatttcaataatgtgacacatggtttctatttacattccaaatgagttttcactaaatgactttcgaaatatttacttgcaagtataaaggagaccctttgaatgtctgatttgaaaaaagaacaaaatcaagcaattatcaacatagatgttctaatacaaactgacactattttcttccatgtcttttttttttttttttttcattcctagacaccacaaaagaccaatgctacagatgtctctctttcggctttaaatacttcaactgtgacaatgatagtgagacagactgcttcaggccctgtagctaggacataataaataattcaaacaagttttgaaaaatcatttggcccatataatataccagctatccgaacatttaccaatgcccgccccctcccctcacacctcatccttattttcattttttgctgcttccatcagcttaaaatgaaaagtttctctacttagcccatcaggagtcagaaaagaaaaagtaatgcccagcaaatttatccttcctttgctaccggcttccattaaattgaaggtgacttcacattgatcctgggttcaattcacatatccaaagagacctcagtgattaacataaagggcagtccaatcaaggatagacacctccatgtgtgtatggtgagcaatttggtgggatgtaaaacataaatgatgtagcatcagaacacctggtgtggatgatgccaccacttgcctacccagttattctccacttcttgccctgagtttttctttctctctctctcttttttaacttagataaaaaataatcagcttcttaacctcccttgcatctaggagtcatcaaaaagatatcggttgatcaataagatcaataagaatttgataggcagggcttccaaaaaagtctgttgaaaagggaagactcagataacacagtttgttagtgtttgccttttgcccaagatccttccctctttcttctgcctgtgatgcccagggatggagtagtcagtttgtagcctatgaggacaaaagtcccatggcaaggcataaccatgcagaaagatagaaggaactgtgtcccgctggcactttgaacttcttgaggcatcttggggaaaataagcccctccttggtctagcagtatgtgacagttaatttcaggtgtcaatttggctaggccatggtatccagatacttgttcaaacatatctggatgtcactgtgaaggtaatttttagatgagattcatcattaaatcagtagactttgagtaaaacagattaccctccataatgtgagtgggcctcattcaattagttgacaattagttgacagtcttagaaaaagagtagcatcccccagggaagagggaattttgccagcagtctgcttttggacttgagtggcaatatcaactgttccttgggtatttattgtgttggcctaacctgcagattttggactgagatctcagccttcataatcatgtgagtgaacggcttaaaatcgatcatctctgtctctctctggagaaccctgactgctacaccattacaccattctaactgggtttctgttcactgaaactgaatgcaattctctctgacacatctgagatcaccacttcatacactgtgtaactgtgtaggtgtctgtgaccctcagcttccagatctacaaaatgggaatatgagtactcctgactccacaggcttgttggcttacacacgagacagaatgtgtaaaagtgctgtgctgtgttaagttacaaagcccaatcgaaatgatagggatcattatcatggtgggctcactgtcaattcacgactgtaagtctgttatgattgtattcacttaaaataataatattcttcaaatctgaccataaaaagtcattatagaacatttgaaagttcaaaaacgcatgaggaagaaaacactcaaccacctccatcattccatagctactgtcatctaccaatacctagcatttattgagttattatatagcaggcaatgtgtgaagcaattcaatgcattatctctaccctgtgaaggtaggtactattttggtgcccatttggcatatgggtgaaaacttgtcaccggacatatagctagtaagtggcaaatccaggattcaaacccaggtctgaattattctaaagcccatgtatgtatccagcaacacatggcgatgagctgtgttctttaataatgtattggctactacaaaattggagtgtgatcaggtaacccttacatcaggaaaaatggggtatgcacattgctcagcatatacacaaatcaagactcatattacaaggctgctagctctcttgtcagggataacattttaatttgaaatgaagtggaagaatgtttcatatcagctactccggttaacactgctttttacttcagataaagatatcccttctgtcaggcaccctgaagtttttctgtaaaaagttgtgttcatttgtttcaaactgcccatacatccatggtctcatttcattttccctatagcccgctgagttaagaggggcaggtattattaactccatttcacaggtgaaagaactgagccctagagaggttaactaagttgcttaaggtcacacagcaaattagtggtacgacggggattggaaagcctaacgcctgacatccagcgtggtatgttttccatcatgtagtgctccatcacctgtcactcccaccattcctgaggggcttggagttgatggggcatgctatcaatttctcagggtaaaactgtcctatctgggtaggaaaatgcacacacacacacacacacatatactagacacactgtaattgcatctgccaaaatggttttataacaatccagtcaaggatacagaaaactcccaggctgcctttcagaaacaaagcccaaaggatcaatttcatcatgaaataggatttcctcagctgtaggtggatgggtaggtggggaggtggatgaactgcattaacaatggaacagtggactgcagggtaaaagctcatttgacattcactgctattaagcagtggcaatgtaaacctggggtagcaaagagcaatacccaggaaaaaatacgaagaaaagtttcaacttaacccttctgtaactttctatttataagtctcagggtattaagtctcattctttagaaataacaaatgcatattttgactcactctgtaagatatttataagaaataaagagcaagggggtattgattaagaaaaaactaggatgagattatagatatattaatatgtgttaatatacaacatataattacatataattaatatataataaatgtacaaatatataatgttatataaatgacatgtcaatatatgaatatatatatttcaagatcatattcttaacctgaaaccaaaaaaagtacaaatagaggtaacatattgcattgtctatttagcattgaaaccaggattttcagatagaaacatttgcctttcctaagctacgcaagccatcagatatttacctcagtggcactggtctcagtgaaacatcttaatgtctcttctctcagttggttagatgaatggatgtcataaggtaaaaagaggaactgcaagatttgaagctcatagaaaaaagactggcactgggaatggcagttaccgggagattgaaacaagaaggcttctaaatatgctgtcaaaaccagcaccagtgacctctcatcaagtgaggggcagcactaaaagctataccttctagaatgatgttaccttgaaaatcatgaggaaatctcaagtgtctttctactacattagcaaaaggaagtttagggagtttagacaccaagagactggaccttctcaaaagggaatttgccacagaatcatagatgttcaaaatgtgaaccaagctttctttcaaataaaagtgaatatcagggcttaaaacagaaagacacatttcatcaaaaatgattaggggcccacgagtgttgactggggaatgagaatagtgggtaaggttagggggaaagccagaaaaaaaggtgaatcaaatatacttacactaaaaatcctggggctccatgtgatccagtcacggtaccttgtcacagagagaaatgtaatcagggatccaggaagttctttacaggtttacttggtgtgatgcttaatattaggtgtcgactagattggattgaaggatgcctagatggctggtggagtattgtttctgggtgtgtctgtgagggtgttgccagaagagactgacatttgagtcagtggactggagagaaagatccaccttcagtgtgggtgggtaccatccgatcggctgccagtgcagctagaccaaatgcaggtggaagaaggtgcgataagctggcttgctgtgtcttctggctgccttctttctcccatgctggatgcctcctcccatccctcctgcccttggacatcagattccaggttcttcagcctttggaactcaggaacttgcaacagtggctcagactttggccacagtctgaagcctgcactgtcagcttttctggtttgagcctttcagactgagccactaccagcttctctctctctcaatttgcagacagcctatcctgggactttgccttgtaatggtgtgagccaactcttcctaatatattcccttatatatatacatacatatatcctacttgttctgtccctctggagaaccctgactaatatacttggacacatgaaaaattattaagaagagatgtctattcttaatgcattaagaatactgtaaaattattctctcctcattgctgcctttctgaaaattcttcatgtggttggcagctgactcaggagcactctctttcctggcacttatccaatggctctaacacccaatctgggcagcctgtccggcttactgtctccatctctccactcttgcttatgtacttcaacacagactctttatttctttacttttatttctgttttctttactttagggaggacctgggagtttaccaggaagctcaaattcttcctgtatagaagctaggaaaatagtgaagattgtgactatccatactcgaataattttatcctataacatctcaacagattttgtctctaagaattctattgtctcaaataaacccagaagttagcactttaacatgggagccttttcaaatggtagagtctcaaggccacatctgactccagagatcatggtgttcctacaacactgagatgatgataggaactacagttgaaaacagatctttctccccacatcaccttgatcaagtcaataaatgttagtatatgccaggtactgggctaggtagtaggaacacagagataagcaagacaagatccttatccctgaagaagtcacagttcagtgtagtatttctaaaattgcattccttagaatgaaagtgacccttgtaaaaataatccatggaccaaataccttttggaatgtggcatgctcaatctccttttggacatttttcatgctcatcctaatgcgaaatgattatataaacttcagttctttactccagcatttcccacatttaactcatcgctgacccatttggcttgcaaaacttacgtcttgaattgagcctacaaatgttaacagaaattctaccattagcttaaaaaacagacaaataacaggcattttaaagataaaataagaaataatgatagcattttaatataaagtaaatagtatttcaaccaaaaggcaagtgaatctgtatgttgtcttaatggagattatatttgtttgctcactacagtttataagaacagagaggatgataaagacaccacaatgatgaccatgcacagagtgtttctatcagcaagcctatattgtgggtctttactcacaatattttatttaattcttacatcccttctatgaagtaggaacttatatttcccattttcctccataaagaaatcaaggttcagagaatttgttaatttgtctgctacgatcatgtgcctggtaagtgatggaagtgagattctaatccagactatttactctgaaaacctagtggctcccaattctagttatatatcccagagaatctactgttaactgatttaaaatgtccattagcagagaaacagattaacaaaattcggtgtcttcacatgatagatgatcagatggctatcagactatctgtggcttctgaacagaaataagaaagaggctttggcaagctctagattagaatcaaagaaaggctttccctcttgttaagcaactcttgttctattgcgccccaacaagagacagaatgtttcaagataggacaccaggtgactgtgtggcctgagctgcccaacctgaattgggtgttgttttatccactgtctattacattgggtgcactcagcagcagctgtctgtatcaaatgaaagtagattacacgggattgtactattaggcttactctggctatccctgttttaacccaaacctaagacttcatggggcattttttatgtagttacctgaagaaggaaaaaaataaagcctactttacagacaacattgcacgataagctagctccagcctgaagtggaccctgaatattataaccccactcaaggtgagtagccctaaaggacattgaagaagaaaaatcccatcagtgggcaaaacttcaaataattacctcttgtggtcaacactgcctggaaaaatagttggcctgaggtattgttccacgttaattcatgggctcatgaatgaggcattaggaagaaaaagaggggaagactgaaagggaagggaacaaatacacagtaaggcttctcaaacttttaccagagtgtgaaaatatctgtctatgtgaatgtagactagaaggtccccactgtggagaaggcactcagtagctaggtaggcaaggcctctttccctgccaactcagagcttaatcagcatattcataaaagctatttagtatctacggtggccaaatacagaggtttgcatgggctgaccaataaggacttcaccagttctggccactgccactcccaaatgtaccacttgctagaaacatcaataaggaaatctgttggagagttagttttttgattcagtgaataccaatgtgctctcccacatttcctctaccttttgtggtaaggtggggccatgtgactagtgcaggccaacgggctacgaggaaacagaaacctgtcatgcctgtgaggggccctggcaaggcataccgcctgacctgcacaccaagtgatgaggtcagagaatgccagattgctctgcattctctgtatagaggaaaattgccccgcaaactgcctgattaatataccaatcctgaatcaaagatacagaaaaataccctgactggaccctccagccacctgggggcatgctgtttgtatggaccccatctatcatagaggagatgaaaatgtatacttcttggaaaagacatatactcaataagaattatttccctgtttgccaggcttctgtgaacaacctcaaatgttttattcaccttgatggtctcccacagaaccttcttgactaagaaactcattttatatgtacatatatttatatgtacatatattaaaaagtaaagcaatttagttggtgctcatgggattccatagtctcacctagtaccccatcctcaacagtggaatggccagttaataacttggctgtggttccagttaaaagacaacaccctgaaaagctaaaggactatcctacaggctgcagaatgttctcttaactagtgattaattatagtgctattttcccataccaagaatatatatgtccaggggtcaaaggggagaggggagagcagtgcctttcaccattacacagaacaaatcactcattttgctttccttaccaggaaatttgaggtctgctgttgtagaggtcttacaactcaagtgaaaaatgcttccaacaatagatatgataaaagaaaaacttcagccgagttaaatttaaaggactttaattgagcaatgaatgattcacgaatcgggcagcccccagaatcacagcagattcacagactccaggggtgcctcatggtcagaacaaatttatagacaaaaaaggtaaagtgacgtacaggaatcagaagtcgggtatagaaacagtgagattggttacagctcagtgtttgccttgtgtgaacgcagtttgaacattcagcagtctatgtgtggttgaagtatggccgctgggattggccaacactcagctattgttacaggtgcatactattaacttaggttttcaattttgtctgttaagctaggttacagttcatccacaaagactcaaatatagaagtatggccttttcaggccatatttagtttgctttagcagatgcaagagtgtttctatgaaattggaagctgaaactgtccagtggacattttggacacctcacaccccactcaaactgagtaaaaagggagttattgtgttgggaggggtcattagtcttgattatcagttgggaaatgaagttcctgctcagcaatggaggccatgaagagaatacctaccatgcaggtaaatcctctggagtattcctgctactgccgtgtgccatggtaaagggttagactccagcaaccccaaatgagcagaagcattgagggtttcctggatagaattactgatggactgtttgttcaagggtaagttagagtatgttaagtcagagcaaggtattataacttgaaagttgaaacatggagaaaaaaaaaaaggagtattattgatatttggtaccaagaaagggatcagagcgaaatttgtctcgcgtggctgcccaatatcctctggatattcttgctcataataatgtttgctccacatcatgaattcttccttttcaaagggaatttcagaaaactcatatcctttgcagctaaggagcaggcatgcggtctgccctcctcttctcaggccacacaagacttcactgtggaagtgagcaatgaggaaaaacaggctatgtgtggacattcatttttccagtataggcagtgagaaaggtatccagatttggggatgttaggataaattgcaataaaattaaatccttcgtatcctagatgttacagtcaggaaaacattgtggtatccagtaagtagatggtgacaattgcctcataagcccagttctaagaaaatgttctgcagtcaacagcatgtcaatggctgttttctgaccagaccagttctgcaacatagttttggacattgttcccaaaagcttagcctcaagcttatttctctgggtctacaatgattcttccaaatgccccatatcctttaataaattccttctctatttaaattagagcccattctattgtttgcaactaatgctcctgaccatattttccttctcccactttcaatacccaggcaaagattgttttaatcattcacaacctaacagttctctctcaggaaagtctaatctagcaatatttttttctgtggaatctgcaacctactcctttacctttaagccataagcagtgaatgaaactgactcctatttccagaatcccacctgcattccttttccaactcaatcttctttcttagcctaaggctagcctatttattgtatgaaatattcttttctgtcagtgaacatggcaacatctttggctaagtcaaaagcctaactcttcatctagctttcaacttggaagcacatccctggacacacctatgctttgaaagtaatatttatctctctctctctctatcccactgttcaacaatcattttgtctgctttttttgagttacactttgcatatcaatactctttctgaaaactcctccaaagtgttaaatatctggcatagtcatttcaaaacaggaacggagtggtctgcatgttaaagaaggcaagaatgccagaaattgtcccatttcccatgttgatcagtgactgtgtaactcagacacgttgcagaggcctacatggcctacttcctgagaggggggtctcactgccttgtcaggattccagtttaagagcacagggcaagtgagaccactgaatacagtcatttaaaaagtgctacaggaaagtatttaaatagtcatcttatagaagggggtgaaaaagcacatttattgatgcagtaattaaaaaaagatttagatccagtgtgtcaattcccatagaatcccacttagcccccttatctatgtcaaagcaaacttagtttcacatcagcagtgcttctcatttatcttaatgctaaggatttatttcttatgcaaaattgttcattttcaccagcctggaactttaaaaaaattcacattctcttcttcaagaatttttattaagccaagatgtcatcaagctgaaaatctcagacacaattttggctctcttctgcaggaaactcagaggagtgcccaatccaggcaacagcagattagcactggcactgctgacaggttcttaaaagtgttggaaagagaagaacaaaggtggtgtacaatgattgacaaagatttctgctataaactaaagttgaaccaataaatatgtctagactctgccatgactatctgtggcctggaagctgcattcttcagaagaaaaaaaaaaagttgcagttggaatttggaatggttttgcccccatgatgtgcacacaggactttgatgagtagtctgatatgcagaagcatccagattatcactgagatagaaatgaaacatccagatgatagattaagtagattgttcacttctcatctatatatatatatatatatatatatatatatatatatatatttgacatcatagaggcataatcaaaatctgagtaggtaaagtcactaaccagaatacgaataccaagttacctgtgtggtttcatggaaaaataataggggaattgacatcatctttataaatgttgtatcaatgagaaaattatgacagtcggggagatctgatctagcccatctgcctcctgtctttagcattcaagctgccaagctagctttgggagacatttactttacagtttaaatgataataacccttccccccaactcaactgcctttgtaaagctaatgagggaccaactgagggaaggagagatgcctggatgctgctaaggtacagacatgaacaattgccagccattattccagagatcacaagatttgcaacttccctaattactcctgcaggcaacatcactattgtagattggccttttgagatactgtttcaggttttttgcatgtctggcacccatggctctacttggacccaccaactgatggttcctctggccagaagcaactcagtgtaagaggacagcttcaactccctatgattaaatctccaacccagccaatcggcagcaaacacccattgcatagccatccctacgccttcgcccaaactacctttgaaaagcccctaacctacaagccttctatgagattgatttgaataataactccatctccggcatggtgtggctagccttctgtcaactaaactctttctttactgcaattccatggtctctgtttgtgtagcaggcaggaagaacccactgggtggtcacagaatttcaaggctgcaaagagtcagactttactcaaatattctaggcaaaaaaaatagaatttaagggttacgatctgcacaatcatggtcaaaatcaaagacacatcgaaacagttaaaacgcaacagttatcccaaggtcaaaaccaagaatatttatttattagtgtaccctgtagctctgtacccaattaagcccaaacatctccctagacttcatctccataatcatatgggtatctgatacccgtcaatgcaattttcttgatcactaatgaaacattccttgttcattgcattagtctttataatcacaatattaaatcattttccctggtgttttcccctagcaacaatttatgagccattacagaatttctgttttttttctatgtcttctctcttctcataagttaaaccattccagtatcttgcaaatgaccagacaactactttaagactttggttgtaactagagcttcctaccaagctatgtaattaagccacagtatctttgctcttctagcttacaagataatcatctgattcccttttgttaaactatttgccctttggccttatagtttattcacttgggaactagattacagtttcccagactatatagctacagagaaattattgtgacttattataagtttaattcatgccaaacaataccagtctgatttctggcttaataccaccttctttcataaagctggaccatcattttgcctttaatcatcttcttgattagtatttttccaagtgtttctcaactcatttcttctatagaattaaaacattcctactggatgggctactcattttaaggatttaaaattttcagtctggatttggggttacacctttgatggatgagcttaaggaagatacgaaaatggcaaaattatcttcatgatgacatcataatggatagaacaaagtaaattttataaaatggtttcacatgccttattccatttgatacttaacagacttgagaactggacagagtagatatagtagttccctcttgtgcacagggaatatgttccaagaatcccagtggatgcctgaaatcctgtatagtcctaaaccctatacatactgttttttccctatatatacatatttatgataaaatttaattaatttattctttttgagatggagttccattcttgttgcccaggctggggtgcaatggtgtgatctcagctcactgcaacctctgcctctcgcgttcatgcaattgtcctgcctcagcctcccgagtagttgggattacaggcacctgccaccacgcctggctaatttttgtatttttagtagagatggggtttcaccatgttgaccaggctggtctcgaactcctgacctcaagtgatctgcccaccttgacctcccaaagagtgggattacaggcatgagccactgtgcttggccaaaatttaatttataaattaggcacagttagagatgaacaacaataactaataataaagtagatgccagcatcactacttttgtgctttggaatcattagtaagtaaaataagggttccttgaatataagcactgtgatactgcaacagtggatctgatcacagagctagctataatgtcactaacgggcaagcagcacagacatcacagatacatgggatgattcatacactgggaagggcagagcagggcagctcagatttcactgtgctgctcaaaatggcatgcattttaaaacttacaaattgcttatttctggaattttccatttaacatttttagatcgagttgaccacaggtaactaaaactttgaaacagcagataatggggaactactgtattactatgcccatctttataaagcagtggtttccaaactgtgttaatgcagaccaaattcatgacattgtttcaaccagtgcagctcctttcatattagttttttaaaaaaacacatctaagtaagatcaccatttgaaatgaatagagtgtatgttggcttttaaataaggaatgtttaaatgcccctgatagaggaagaaaccaaagctcagtacaaatggtaaactcacatctccacctgtaaacaccaggtaaaaattgaaggagcagggacaaccacccaagtctccagcctgtgagacagccaggtgaggaggggtccccagaagacctccaactggcctgtgcaccggggtggagcctcgggaatttcatcatgtttgcagcggggaggagcctggcccttccttttcctgtgtggaacctgggattcaagctgtgggcgggaagtgctctatcagggactcaagccttgggagactccctctttcccctttacttctttttcacccaataaaaccctgctcaccctctccatcggtctgtgaacctaaattttcgtggctgtgggacggacaagtaccctgtctttaactgaactatggaaaagtcctgcaatatttttggcgcccaacgtggggactcgagaaggggtaagtgagatgcaaaccaataattctttttccctctcccttctgagtcttctcatccccgtggccttttccttccttttttgggatggaccggcgagcagcagctgcccactgctcctcactccatgccggggctgggacacatggcctaagtgtcctgcacagcctgctggctggttccccgtcactcctggctgtcccagccttccccttccctggccaagggatgtaactctatcagacagtaattaagcttaaatttgtctccctggtggaggaaccacttgcaaagaaatatgaggttcttcctcaggcacttttaaactgtttcttttctttccccttctctaccccatcagcaagttaacttaaatttttttttcttttagaagatgttgtactaggctagcctccacccacccccaacaactgtcagtgtattctctgcaaagtttcggttgtgaaatcaagcctccatcttgttttatatcctgagggcatggctggtaattgtggcaaggatttgtttagcaaagccttgagaggatgaaccctgtaagattcaatgtctgcatgttttcctagccctttctcttaaagggccccacccagcaactgggttttcttctgcctgcctgtgtgtgtactgtacgtaatgtttgtcaagagaactctaattaatacagcctaaagaaagacaagtgcttgaatctaatattttttaaagggaagataaagtctggtacctttcagttcacatgactttaatctttaagaaatagaaacagtcttaaaaactattggtcaaatgcaggtattatcaaaatgtaaataggtaggctaaataatgcaggtcagatgcaaggtttgctaagtgttttgaggttacaaactgctttttgggttttcagaactatattgacttgccagcttcacaactggtaaggcctggggacacacggaactaaccgcacccttaactaagaaggcaaaccttggctgcagttagcacacaattaaagcaacttaacaagttttagtttacagttaaaaattgctaggagttaattgaatccactagaaatagatttacatgcaaggtgtatgagaacagtaaaatgtgtttttcagtaaaaggttataagaagtcatggaaatgtaaacttttgcctagggttaaggattgttttgagttacattaggaaaaagctgaaggttccaagaagtggtggaagaattgtggaaattaatcttgcagaagaggttctctgtgtgaacatactgactacattcaaccaagggtattatatggtttttctgtaaattgagcgttgaagtaaaagcataacgaggttttcctaaggtgctaatcttaatctgctctttggcaaaatttgtaaagggttataaaaggttttcgcttcttcaaaatttctgagtcatcattttgacaaaataaataacttttggtaatgttgacaaaaggagtcaaattctgtaaaatatttttacagacttattgtgagccacatatgagtgaccatggcccgtgacacagccctcagaaggtcctgagaacatgtgcccaaggtggtcagggtatagcttggtttgatatattttaggaaagcatgagacttcaaatatatttaagaaatgcattggtttggttcagaaaggcaggacaactcaaagcggagccttccaggctataggtaaatttaaacatttttctggatgacggttgagtttatctgaagacctgggatcaatagaaaggaaatgttcaggttaagataaaggattgtggagaccaaattttattgtgcagaggaagctctcagatagcagacttaagagagagcaggttataaaatgcttcttatcagacctaaaagggtgcctggctcttagttgattatctcctggatctggagagaaaggaatgaaaacaaagggggaaggggattctctataaaatgtggatttttcccacaagagacgttgcagggcaacttcaaggtatggcaaggaaatatattttgaggtaaaacattttgatttttttccttgttatgccacagtcagattggaaagtaagtcacgatatacagggttaaataaaacccatctgatgaaaatttatggtttgtaagccatgactccccaggctccttagataggaatttgggcaatattaaaaaaaaatcagagcttagtcctcagtaatctggaattccgtttcataacatcaagtgttttaaaccttgaacatttaacagccttcccaaagtcaaacttcagtttcaaaatcgtcttccctggtacatggcttttcaaatacttcagagggcccccgatgtgtccagaactaagagaggtaaacagaattatttgacatgtttaggtacatgggattgccaaaatgatgctcaatcttctttaggttatagctgggtgaataatgccaatatatgttccaaaattgtatgggatttctaaaattctaatgtctgagtatatgctatcaaccataattaaggtttttatgttaagttatagtaaaccacggagataactaaacttctttgtcagtcgtgtttctaattgtaactaccctggaaattttgctattcacagacaattgttgctttaattctttttcagaagatggtttataataagctataggactttgacaggtgctttcaaatacaggcttctgataactttggatattgtgacactgaaatacaggaaaatgtacaggactcaaaagctgaaatgctcatgattatcaagcaaaacaagagttagccaaatggactgaactcaggaagctgaagcaacctttttgacttttgcttggaatattgctaatccatgtttcatttttcagagtcaaggaaacttattttgaactatttacagcctttaacaattgagtaaggtatactcctatgaacaaagtttgaagcgtgtttgtttctctctgcctggttcctctagaatttggaaactatctgtgaatattgttatggcaatatagttgtttgcatcagtgccaataagaatccatttttcttttgcagcaggacacatttggagaaagtagttattttaccaaggttttgactggaatggtatgcttccctttaaggagtcaagctcaacttgcagagccaataaaagccccatggggaaactggcctcatactgttgtctatgcagtccctgtacagggttcctgacctgtggtcagtaaagaatgtcactttctagcaggtccaagagctccaagtttattgtgggaccttaagaggagaggatcacccaactcacaggtatttgaggatgcaaacccatggctaggctcagctttaaaaggtcttatctgtgattccttgtggaaaacatttccatcagtgccaatccaaaaagcctatgtagaaatagttattcttgctgcactttatgcaaataatcaggccaagtgtaagactaaagtctattttgcaaagcactcagtcctaccataatttttttaacaaaaatgaggactggagagacagaaattatgttccaaaatttgccatacatttgtcattaaatgctaaactcattagttgtttttaagttttcatctaccttttagaccaaccctgcttgctcctgtgaaccaagcagcaatctccagctgcagctcagaaagaacaggagggatgggtaatgtagaaatatggatcaatattctagctctgaacaattatcctgcaaaccctgccaggtgatggaataaatagggtgcccattaccaggaggtttcctttttgggaaagtaagaccaagtgaactaaccaaagccaagcatcacgtatccaaatcctggcaagcataactatagctaccagttatctgggtgtgtcacaagacatccttttctctctcttgttggaggagaactgggttccacagcttcactttagcatttgtcttatgataaggaggccatgcaatgccccatccgagatacatttttgtcccagactgaattccaagcttcacatcaaagccttaggaaggaaaatcggatcttagggatccagaggcaaatgacaacagaagttaaaaggcacagcacaggtgagcgtgactgattcctgctgattaagccaaccccaaacttcctgtttcatggataaaggccacgttaatatccatggcataaatgaggtctacggaactccaaggctactgacagcaggggagatagggcatacgtgggtaagagcggatgattcccacccctaggcccccctgcttcatgggtgcaagttgctttaacacccatggtggcacctaccaaggtcactggaacttggggatgcaaggatagaagatggaaagaggatgctcttccctctctacctcacatacctaaggtatctgctggaagaaaagggaaccaggtatgcctgctcccctctttctagatgggtagccattcatcttcagtctgtatccctttcaaatgcatcctgaacctctgggactcctttaaaaggcaccttctttttgcctttcttctcctctgttctctcttcactaataggtaattgtgtctccatactacaaggcactctcctcagatgcatcctccaaactagaaagagttggtttcccaaaccttaaactggttagcttaggattgggctcaggggaaggggacccagaagcccaacgtgccagcaaaagggtaaagttttttttgccagtcaggcttttggcctccctctacgtgtgcaaactggcaaaaggcctcaggatctttgagctgtccttaccctcccttcatttcgttttgatacatagtttctaataacctggtttgtctgttcttgccttcaggccattaaactctaaacaatcatgcaagcagagcctctgacaatggccctttctgctgtgaacccttagatgggcctctgccgtttccccaaaacagcgccccctctcagcaggaagcagttaaggtcagtcttcatccttatccttaatctaaacggcagctggatgtacctctttagagggaggaatgagacagctaggtgggagggggtccccgaaaaacctccagtcagcctgtgcactagagtagagcctcagaaagttcaccatgtttgcactggggaggagcctggtccctccttttcctgtgtggaacctggaattcaagctgtgggcaggaagtgctctatcagggactctagccttgcagaggctcccggttccccctttgtcttctttttcacccaataaaaccttgctcaccctctccaacagtctgcgagcctaaattttcttggccatgggacagacaaggaccctctctttagctgaactaaggaaaagtcctgcaacacctccaacaactaacaattgtttccagtgcacctccattctccaggagggagaaggccaaagcacataagtggagaatgcacacgttagcccattttcaatagtttaatactttaaaaaatagtagtgttgctgactttcaagctttagcatctacacgtgctagattcacttattgactcattaaactattcttttaccaatgagcttaccatatgccaaaaactatgctatactgggaacccaaaggcacacagaaaaactagaagactatttctgcaccagtcaagaagcacacaaatggacactcatgaagaaactatagacccaaagaaaaccattgacaatataggacaaatggcatatcaagtcctgaggaaagagattagtaaggaggttaatattttaaaaaaaatagaaaagggagaaataatgaatcactggaaatggtcccatcaacctgcagttcttcactatttttcaacttaaaattggatacatttatagtcacttgacctctctaggtcccaatctccccatgttcaaagtacatatcctattgctagctctctctactttgctaagtctattgtgaaaatatcacaatataaaatactttgaagccttttagggaagcttaaggtcttctacaaataaaataacaagaagtaccacttggctgaaaaatgaaagaggtaggacaccaatggtagtaaatcacttgtatcactttgttcagaaattatttcatttttttcattttattgaatatagacaaattatagttgtatatctttatgaagtacaaagtgatactatgatatatgtatacagtctggaatgattaaatcaagctaattaacatagccatcacctcaaatacctaccatcgattctcctaactgaatcattgtaccctttgaccaatatctccccatttcccctactcccagcctctgggaaccaccattctactctctgcttctatgagtttgattgttttagattccacttgtaagtgagaacatatggtatttgtttttctttgctagcttagctgacttagcataatgtctgcttggtccacccatgtggtcaaaaatggcaaaatttcctcatttttaaggctgaagaatatttcattgtgtgtgtgtgtgtgtgtatatatatatatatatcacattttctttatccatttcatctcacacctattaaaatggcaataataaaaagatgaaagacaagtcttggcaaggatatggagaaaggggaacccttgttcactactgatgggaatgtaaatttgtacagagctggttcaagggaaatccaagaacatggctgtgaggcaaggaccagatgagggtattaagggactatcattacagtggaaaaattaaccctatcttttttgagagaagccagttacaatgcttgatgctatccctgacacactctctctagcaacaagttccttttctttcggcccttaagtaaggctataagaagaacagaacaaaacagcaaggagatgaataccaaagcactggccacacttttcccctgtgggcctgtcttattccattcatgctgctataaaaaataccacaaactgtgtattttataaataatagaaatttaattctcacagctctggaggctgggaagtccaaggtcaaggtgccagtagattaagtgtctggtgaagtcttgctctctgcttccaagacagtacattgtttctgtatcctcacgtggacgaaggcagaagggtaaacaggcataaagggcctagctagttcccccaagcccttttaaaagggcaccaatcccattcatgacggctctgtcctcatgacctaatcacctcaaaggctccacctcctaatattatcacactgggttgttttttgttgttgttgttttgacaaggtctccccctgttgcccaggctgatgtgtagtggcacaatgtcagctcactgcagcctcaacttccccagactcaagtgattttcctgtctcagcctcctaagtagctggaactacaggagtgcgccaccagctaatttttgcatttttttttttgtagaaacagtttcgccatgttgcccaggctctcactgggtcttatgttccaacatacgaatttgtctgggggatgggtgacacatacattcaaaccatagcagggccttcaataggtcattagagagagagccaaggaacaccagtgtggctttttgcattgaacaacgataagttaatggaagtttaacatagcccacagtctgtagtcagaggtcagaggagtaaggccttacatgctacagatgcccacaaaggagataagaggaagccagaagaaatagaaatttgtttgtcagtggataaagaacaaggccaaggttttcttaaatagtgattgatgaggccctggtttactgtaacagtgtacttgtgattttttaattttgtaaaaattgtcccagtgtgtaattctctgtttatacctgagtgtggggaaatgaattttaaggaaaaagccctatatttcctgataaatcacttctataactaattggttatttaatgattcatctgtgtaaaaagggggactaatggttttaaaataaaatttcatcaacagttgtctctttcataaggtttgaaaacaaagaaaatggagatgatgatgcaggtgtggctctttaacagaacccacaggggagcacacaggctctggggagagcaaacaaggcaagggctcagaagactaggttctaatcccaatgcccctttctcccggatatttaatcatagtcaaattacttaatgaccccaaagtacagtgatttccttaatattttacaaaagaataaaagcactatggacttttcttcaaacagacatatcacccctggcctcaggagtttaatattcagtgactctttggcaggtcgtgaactgcccatcagtcccagtggttgttatgaatgtcctctgctcatccatccagatcccctccccatctttcttcatcctgactcttcctgggagggtgatcaatatagacctgccaataggctcctgcaccctctagcttctaattgcattctgtccacgggaagccctggtgagagttacatcattccaggattgggagcaacctgtaagaggccccggacagctgtgtccatcctctgaaaatgaaggctgttctcaggtgacctgctctacccagatctttttccttccaggttctttttttttttttttgagatggagtctcactctgtcacccaggctggggtgcagtggcacaatctcagctgactgcagcctctgcctcccaagctcaagtgatcccctgcctcagcctgctgagtagctgggactacaggcgtgccccaccacactcagctaatttttgtccttttagtagagatggggttttgccatgttggccaggctgatcttgaatgcctggcctcaaatgatctgtctgcttcggcctcccaaaattctgggattacaggcatgagccacagtacttggcctccttccaggctctgataaatgtttcttcccctcatctcttaaagcctaggggaggttatggactgaatgtttgtgtccctcacaaaatttatatgttgaaatctaatcccaatgtgatggcatgaggaagtagggcctttgagaggtgattaggacatgagggtggaacccttgtgaatgggattagtgcccttataaggggctgaaaagaccagaattctaccccttcaccatgtgaggacacagcaagaaggcatcctctattaaccagaaaatgggcactcattagacaccggatctggacttcacagcctccagcattgtgagacagacatttctgttgtttatgagccacctggtttaaggtgtcttgttttagcagcccaaatggacaaacacagggaggtaagagcccctaccagcccctgtccaccagaaagatggggatctgaacagaagccagaggtgtaactggaatggactcaggtgttttcctcacagagcagataactaaagctagaattcttgataagaaaaatgggataaagaaataacagttgcaaaggtaagaagcagagacagagttatagtccagaggccaaaaggataattttaagaagaaggagtaggtctgaaagtgatgactgagactagcccttggctgtggtgattaagatctttggtgacaatagaaaatgtaacaataggagtggtctgttgtggtgatagaatctgcagaccggtggaagtccatgggcccatttaccatgccacaggcaaagagtatattaaactcccacgaagagaagtgcctctggattcattttgccaacattcactgtactgatattagccatggacttgcagagggtttatttactattgcagcctggctctctgctgtgtctgaaagttgaccttggtgtcctctaagttttatcccagagaaaaagacagcaattgagctattccccaggcacagggggcaaaatttgaaattgacataaaaccaagattccctgtctgacttgggcctctgggattgtattgctgcatcctgtggtggcaaaaagagtatcctgggcagtaagtgatttcaattccacttaaagcaacaagtatttgctgaaaaccaaccatattcttagtaagaagatgggtgctgtaggagacagagaattaaatgaaatcattccttccctccaggagcaaacagcttcatgctagaaataaagctaactcaaatgcaacaaacagaagacacacacacacacacacacacacacacacacacacacagagagagtacttttcaagattagtaacaaagagattatctacagagataaagacagaagaatccaatgtctgcatgttttgttattcatgtgtataagttttctaactttcctacattcagtgtgaattagtattgaaatcagaataaaaaagcaatatttttttaaaagcctaatttttagaaattgatagtaaaaaatgagacagccctgggctgaagtcccaggcgtccttcttcctaacaacttgaacttagccaagttgcttaactacttggtgcctaaatgttctcatttataaaactgggaagatggcatggagaggcaatgggcattttctggcaagaaactaagaaaaaaggccataaccaataagtaacttatggaaatgaaaaaatcttttaagttttataatcttgctttagttgatatcttaaaacaaaattttgaaagttattaagtcactcataaggatttcaggaagcactgcagtgtaatatgcttaagaatggagatggttcaaatgctagctcggctacttagcaatacctgtcctcaaataagttatttcaccctacctgagtctgttacttcatctctaaaatggagataatcctaaaacgtacctcacaggaaccttgtgaagataatgcatgtaaaatgctatcacagtccttggcatggaataagtgtctaattaacttttatatataattataattatcatctaaaaagtttagtggtgtttcagacaaatctaagagaagataagcatgaataggtatatgtctttttcatctttgtatttcaccagtgctttgcacagggcctgtcacaaagtagggatctgagaaatacttgtgaatgaagaatgaatgaatgaatgggctgattttcctatttgatcaaaagccacatccatatatgactaaatctgagtatataaaagaagataaaacttgtgtttcaattcaatctagtgagttaaattaaaagaagaaagggaggaaggcaaattaaaagaagaaagggaggaaaagaagcaggaaagagggaaataagacaaaaagaaaaaaaaaaaaacaaaacagaagttggccaggagaaagggtgtctccatccttaaatattttactccttattgtgtgatatattattttgtcagcttcttctagctacaattcccaaggaagggatagagagcagcagcttccaagtaatgacccatgtgggtataaagagaaatttttatcatattagaaaaaatatatttatatacatgctaccaactttacctagaagagaagagcaagggattggaaaacaaattagcataaaatccctgctccagctttttacacatacagatgttttcctgcatatttatccatccttctgagcactgctcaaatgttacatcctcagagaagctctcctggacccctcatcctgggctggatactctgtcacatgctctaatagtgtctgatacccttccactagaacagggatcactgttgtaattaggtaattatttgggtaattaattgtttaacatctgtgtccagtgtcagtatgcaagcaagctccatgaaggcagtgttcctgtctgcctgttcaccccaaaatcaccaacacttgcatatgccttgcatgaaacaggtaagtgaacataaatgtgtataaggttggcatccattctttgtgcattctgtgtttgtgaatttgcccactcaataaaatgcatttgtaacctcaacatcgatacttgccacatttctgtggtcatttttgggcatcacagagaagtgaaaaatttgtcacccaacatgtacattccccaagtgaagcagaacaaagcaaagctccaccttcttgctccatctctcatactgtaaacaagggtctttttctgatctattaaatgccaggttgttggggtgggttttcttttgcatttttgtacataatggccccaaaagaacagtgctgaagtgctgtctcttgttcctgagtacaagaagaatatgatgtgccttacagaggaaacatgagtgatagaagcttcattcaggctcaggttaaacagctcaggctgtgtcccatgacttcagtgttaatgaattagctatatgttaaataaggcatctttaaataaaagtaaacatttaaaaagtttacatattaatcaattaacaaaaatgttgtgaagaaacagccagtagcacgtgcctgtagttctggtttctcgggaagctaaggtgggaggattacttgagcccaggagttcgaactgcagtgcactatgattgcaccactgcactccagcctgggcaacagagtgagaccctatctcttaaaaacaaaaaaaatattgtaatcagaggctctcaggaactcaaccctggatttcccctaggggcaatggttcattatttgctaattcagcgtttgtggagactttatacaacaatttcctatgaaaaatcaggatcaactatatatatacatagaatgtatatgtgtatatatattttacatatttgtgtgtatacatgcacatgtgtatatatgtatgtttagtagtttttaaccattttggtgttatacacctgttgtaaaaatttaaggaagacgtggatactaggggctgagggttgccacaaagggaggtatgtacatatatacagccctgtgctatgcatctccagggcaggagacagggtgttgacattcacagtatagcctaagtgaatattcctactccatagaattgttcagtgtggtgacacttcatgcaaataaatacatgtatacacatacacatttgcataagattctgggcatttgtggcctcctatcgtgtacctcaggtaaaaatcctgacagagaaataatagatacacaaatataaatatatattatatatggcacattcaattttacttcaaatgttttacataggctaaaattgaaactaaaatgctttgcatttcagccaccaccaacagggactagacaattccaaaatatatgtatccccagaagaaagataatttgttgtgaaacactggctaaagacattccctaaggtaaactaaacacaggcagaaaactgagagttgaaaaaaaatatatacatatatagagagagagatgagagttgaatatctatatgtatatatagatatgtatatatagagagagatgtgtgtgtgtgtgtatatatatatatatatatagagagagagagagagagagagagacagaggagagagagagcacaacaagaatacgaaggttggccaggtgctgtggctcaagcctgaatcccagcattttgggaggccaaggcgggtagatcacgaggtcaagagatcgataccatcctgggcaacatgatgaaaccctatctctactgaaaatacaaaaaattagctgcgcatggtggtgcacacctgtactcccagctactcaggaggctgaggcaggaggatcacttgaacccaggagacagaggttgcagtgagccaagattgtgccactgcactccagcctggcgacagagtgagactccatctcaaacaaacaaacaaacaaaataccaaggttaacctgccccgtttgctttcctaagagtctaagattctctggattctcaggtctgtatggtgggcagcaatgtaaatttaagcttctctgacatctaagttctttggagacagtaactattaaacacctgactctgtcccttgaataacagacatttcttagtaaagcttttaattagatctgttggttgaggatgaaaatagaaagacaccagaaggaaaaaaaaaattcatccctgtaaatggtcctgtggaaatagtaactaaaacaattatactgttaataattcaatgttggtttaaaactatacaattgtgagttatttatacagaccagagttggcatgtgttgtaccacaggtggatgtgaggtcaccaagaaaccacttcacagttttcccagaagtgtagcgtcaaaaaggtcacttgtggtaaaagatcttttggattagtcttttaaatcaatgcatgaattaaagacaatttacatataaataggctaatactctggctttgaaattaaatggatttttaaaagatttaagtaactgcagaaaaggtcagttaggcagtaagtgtacataatgtgattcttgaaaactgctgtcttgttggtttattaatattttgtattcattgtcagtgttgttctaaaattgtgtgcataattagcaatgcaccaaagtcaacggcaggtcccaaaagtaaggaaagcggaatttacaaatcagtgaaggaaggacaagtctagatttggacatgaaaatagtcaaaattaacctttgcctatatattaatacacattagattcaaatatgtcacaacatattctaaataagcatggcatcactcgctccagttaaatttaccttggcatttagcctcactgataaattttcaactcttccaaaatacaaaagctgcagtagtctcctgagttatcacaacaggatcatgattgtaatttgaaatcctgattccccttttagggaacagaaacctgcagtttttccaactgtaatgaaaggatagagcgaaacttccataggatcaaaccacattccattaccaccactcctctgaacattaatgtaccttaaaacatattgaaccataggatgaatatatggagcaggggcatttttaggagagtgaaactattctgtatgatactacgagagatacatgatgttacatacttgtccaaacacacaggactatgacaaaagattgagtcctaatgtaaacgagggatgacttcagttaacaatagtgtagcaatattggttaatcaattataacaaatgtgtcaatccaatgcaagatgttaaccataatgaatactgtgggcaaagggaggggatttgtgggaaacctctgtactgtactttctgctcagtttttcagtaaaactaaatttgctgtagaaaatcgtctgttttttaaaatagtgaaccaaatgtaataatgcactcaaagactctttttagacaaatggtttataaactatattcagaggagccctagtggtcctttgctggccatttggtttaggagtgtttgggaaaatagagtaggagagaagagggaacaatgaagaaaagactgctcaagctggccccttatctttcacccctgtttcaaacaaagcaacaaccttttcacctgtacatattgtttctccacattggagcccagtaaagaagggtttctcagctaaagagaaaaaaaaaacatgaaaatcaccaatgtatgctcaataaagtatcttgctacataaatcagcaactcaaagaagaaaaagttaaattataaaaaccttgctaataatgtacactaattccctcagctacttaataaacatttaactaaaactttctgcctgaccattattacttcctatgattgggctaagcataagctaaatgactaccttggaagaactccaactaagaagtatttatttcacatcaacaatgaaccagtactctgttagaacatgcaacatgctttggaaagacaggtgaaatacaaagcatcattccagctgtccagaagcttatcatcttacaggacagagaacatgaacacaacaaaatgcagaaacaatataatacacctgaggcacccagcacccaacttgatgagctaaaaaatagatttcaggtcttctgtcaggtgttaacaaattgtcaactctgaataatgtgagggccagtatgaatgagaacagtccaatccccagttaagccccacttttctaaatcttcttctctctttaaaaaagcaaagtgaatgctaacgtagtctatcagtaatggacagtgtcctcataaaaagacatatgtaaaaaggaggggaagtggaaggtaagcagtgcttactattttatcatattcaattgtatacacacctcctctcaaaattggtgtccccctatcagtagttactaacaagttagttcccaggatcttgcagatggtgggctggtttcagacaaaggcacagtggtccagaggatctggcaacctctttcaggggctgttgggagatgccctgacggcagcagaagcagcctccaatgaggatggcttcctgctcaagacctcctcacactcctcttgcataaataaatgatttagacaccgttttctcctctaatagccagcactacaccaaagagaaaacactccgctattgatgacaggagagggctttttttgtaagtgtgtatgtgtgttatgctataaattaccctgttggtgggtgtaaaaataaatatccatgtatatagttgtgtatacacacacacacacacttacacagagagaatatgttacagttaaaatcatgctgtcgacagccactcaaatctagagcaatttatggctctcaatgcagtcacacattcaggataaagacaggatgataataaatactttgaatattaccagcataaataaactgcctgaggagcttaaacatttgcaacatagccttgctggctcacactgacaaccagcagacctgttgccagtgagcgactgaaagatcaaacatgattaaaaatgcaaagatgctgcacccaaatgacatgctttatttgacaatgaactctggactcagaggcaccactgcaatctatgagcaaagtgctttttggtaattcatttgcccactgaggccagctactgaggaatcacaatacaagtcccttttaaagtaggcacagttctttacagccattagtaattccatcttgagactgcccttcgagaaaacaatttctttttttttttttttactgagaattgatggtttgtgttttgtcaaaatgagccccagaagttgttaagaacttgtgtaatacattagctatgagtagccgaataatggtcttcaagtaagtacaggaaaatgaatggctgtgatgaagatggtgggcaggtatccttttactgaaactactaaagcaggggctgaagtcaggttttaaaaaagattcttgtgaccataagacacaggaatgtccagtggaagaaagccagttctagcttggagttttaggaacaagccagtttccttggtgtctcagtatcatttgattctatagtatgttatttcttttatttacatacatatgacattcatgatttctttttaaatatccataaattcaaagtggaatacaatgtcacaatgtcttaagtctcagaataagatgctgagaagaccatgaacaagtgatttctttttctttttctttttttttttgagacagagtgttgctctgtcgcccaggctggagtgcagtgggcaagatctcagctcactacaatctccaacccctgggttcaagcaattctcctacctcagccaccctagtggttgggattacaggtgcctgctaccacgcccagctaatttttctatttttagtacagacagcattttgccatgctggccaggctggtctagaactcctgacctcaggtgatctgcctgcctcagcctcccaaagtgctgggattataggcatgagccatagcgcccagacaaacaagcgggggtttcttaaggaagggcttccaagaaaaactgcttacagcgtggcaagaagtagaacagggaaaggcaagaagccaagcgagggtgtgattcagggtagaatcctctgagggacgttttcccaccagaggcaaggaaactgggctttcactctcactcaccaatcactctgcagctaagagccatcctgggggttcctaaactccaagcacttccagctctcagcagacctagtgaagccagcagctccaattggtcctgcaaagaccattgccgaagcagccattggaaggtaaatacacagaagctggggcagggctcacagatatgttgaaaggtaccagggcagtgctccgacaccttctgctacagcaaagaagcaaatggtccaaaaatcaaaatgagggtagaataaggttggagaattcaaaaagtgcagaaaaaaaataaaagtcccccttctctcacccccaccttccactcacccttcacctagtccttctttccaaaggtaacctttgtttacagttttctataaatccttctaaggaaaaatatacacatatactatgtatctatttaaacattctttttaaaaatatgcagattggacaactgttccactgttctactccttgctttttctcactaaagaatatatcttgtattctagatattatattagatctatatacatattctaaatagagagatgatagattagacagataaatgcaaagaggaaggaagggaaggaaaaatggatggatggatggatggatggatggatggatggatggatggatactacacttcattgatttaaagataaaacagttttccacattttaacatttctgaaataggctgtcttatacttgacagcattttagatttgctaaaatgcagtagatagatatatagctatttatggatggattgacagttcacacatagctctgccacttgagaagtagtgcaggatagtagttaagagtatattaacacattgcttattaatgagatactttcgtacttgaggaataaggacctcttttgatggggctaatattttaataatctgataaattgtttattaactttaaattttcataatgagtccgtaaatgagtttgatttatagttttctattctgtgctgtctctctcagactttggaatccatattacattggcttcataaaaacacactggcagtttttttctttatttgtgctatgggcaattttgtttacttttataattctttgactatgtaatacatgtactgtgtatcaaattcaaaaagtacaaaagggcatgagtaaaaaagtatctctacctgtcttccagctgcctagtcccttcccccagatgcaatcattgtaatccgttgcttttgcgttcctttagttatgtatgacacatacacatatgcacaaggacacacacttttactcaaatgtcggtataatagacacaatgctctgcatcttgcttttttttcacttcatgtgttttgtagattgttccataactatacacagaacctccacatcctatctgatgacttcacagtattccattatgcagatataaaattaattttaccagttttcatttttaaatagaattaacattatcagttccttgaaatgcaaaattatttgcttctgaaagcataaagacctgtggctttttaagatctttgataactgcttcagatttttccgatgttattaaagttctctttcctgttgaatatgtttgggtaacttatttacctgtttaaaaaatacattccttgaagattttcagttacttttgcaaaagttctcctttgaatattttaatttctttagccatggttctttttcctttttcctttgttttttgtttttttttttttaagacagggtcttactctgtcctctgtctgtcacccaggctggagtgcagtggcacgatcagggctcactgcagcctaaacttcctgggctcaagtgatcctcccaccttagcctcttgagtagttgggactactggcatgcgccactacccctgtctaatttttgtattttttgtagagatggggtttcaccatgttacccagcctggtcttgaactcctgggctcaagccatccagctgcctcggcctcccaaagtgttaagattataggcttgagccactgggactgtctgctttccattttttgtttttgtactccctaactttttgagtaagtgaatttcattgcttggcattgttttcaaggtgtgttagtctgttttcatgctgctgatgaagacatacccaagactgggaagaaaaagaggtttaattagacttacagttccacatgacaggggaggcctcagaatcatggcgggaggtgaaaggcacttcttacatggtggcagcaagagaaaatgagtaggaagcaaaagcagaaacccctgataaacccatcagatcacgtaagacttattcactatcatgagaatagcatgggaaagaccagcccccatgattcaattacctccccctaggtacctcccacaacacgtgggaattcggggagatacaactcaagctgagattttaatggggacacagcgaaaccatatcacaaggagacagtatttgagcttatttatgattcttatggatttatttttaaattagaaaacctaatttcttatttttatctttattatttagttctttctgcattttttccagttttttggctgtccctttcttaagtcagatgcataattcctttatttttattcttttttaaatattcaggtgttaaaggctgtatacattttcttctaagcgaggctttagctgtagcccatagctcagatgtgttatattttcattatcaatggtgtctagatatttttcaagttgggtttaaaatgtttctttgaattaagagttgtttatcaaagagggttgttgtttgtttgtttgttttgagatggagtcttggtctgtcccccaggctggagtgcagtggcacaatcttggctcactgcaacctctgcttcctgggtcaagcaattcccctgcctcagcctccttcatagctgagattacaggtgtgtgccaccacactcaactaatgtttgtatttttagtagaaacaacgtttcaccatgttggccaggctggtctcgaactcctgacctctggtgatctgctcacctcggcctcccagagtatcaaagagttttaaaatatccagattgtaaggttttgataaaactgatttctaatttattgcattgtaatcaggtaatggggactttatttgtacttcagcttcttgaaatttcctgcaatttcttcataacttataaaggccatgtgtttgtattacattgttttattatttgatatattttgaaccacatattttagaggggctttcctatcacaaacatatttcaaagttgtttgcaaaatattttgcattttctaatcaccataagtgaagtgattagaaaacacatcagggcttctgtggctcaggatttggtgcttgcctcacatagacacaaccagtaactcttactcttgtgccaaatgatgtaattgccctaggaaaatgtttctacacctctcttgcccactttcattgaagaaatggtgactgaatctgaatgtcaggaagggttgtgggttgtggatatggcaactgcaaaactgcagacaatagagatgtacactgcttttgtggtagggacaggatttgagcagtggaaaggcataaataagaaaaagagaaattaattcatgattaagacagattctggcataaagaaattgcagtagtagtagtagtagtagtagtagtagttagtgctgaataccgtatctattttctttcatcagaatctgctggttccatttcatagttcagaggtctcacaaattcaggcaatattcacagctgtggacatagtaacttaggcatattttgcattattaaacgattgatgctatctttaaatttaggttgcaacataacatacatgaaatctgataccaagtcttcacattggcaactagatgggcattgaacacaaaactagaaattgttttatttttataaaatatttaataagatttaattaaagtgtcataaaaatccagctacattgaaatgtttgatttaaatgttttttattagctaacccattcttcattttgctttttaaattctaatgtataattttgaatattgtgcaagaaatatgactttcttaaaaacattaaaaattaattttaattttttcaatgtataattaatttatatgcttgaggaaaatatattcaaattgtatacattttaaatacaaatgcagtttaatttctaattctttagatcagggatcagcaaactttttctgtaaagaaccagacagtaaacattttgggctgttacaacgactcttctctgtcactgccctagcacaaaaggaatcacagacaatgcataagtgaatgggagtggctagagttggccctggggccttagtttgcagatccctgtattagatcataactgccaatagacaaaaagtatcttaaaaaaaaaccccttgattataacaacatgacaattttactgaaatgaagatgagaaaaaataacttaattggaataaatatataataatttaagaaatatttcagtcttttaaaaaactcactaaaatgtcatcagcccaataacagaacatgtacaataataatcaagagctgttgtctttgatatttggtcaattttcaatcacgtaaaaactagggcttcacctatacatttagattttgtccttaaaaaagttatctcatggcagaggataaaaaacacttctttaatggcttactagctggatttgttaatttttaaatatttagacagatggtatatggcctcctttttgccctgggccccataaaccttagatgtaggcctgaatacaacagtgatcaagagacaaaggccctactgtcttgaattacagtctagtaaattctagtgcacatccattgactctaatttagaccagtcaatcatctattctcacatgcactactgcaatagctttttttttttttttttttgagactgagtcttgttctgttgcccaggctggagtgcagtggcatgttcttggctcactgcaacctcctcctcccaggttcaagtgattcttgtgcatcagcctctcaagtagctgggatcacaggtgtgcaccaccacgccctgctagtttttgtatttttagtatagatgggatttcacccggcctcccaaaatgttgggattacaggtgtactgtacccactgtacccagcctgcaataggttttttattgctctctctatatctattcttgccctcaccaacctattttccacataacaaattaatatgttaaaaacataaactatcacctctttcctaaaagctcttcaattgttttccattacattccagattaaatccaaagtcttttatgattagtattattatttttgagacagagtttcgctcttgttgcccaggctagagtgcaatggcgcaatctcggctcactgcaacctctacctcccaggttcaagcgattctcctgcctcagcctcccacgtagctgggatcacaggcatgtgccaccgtgcccagctaattttgtatttttagtagagacagggtttctccatgttggtcaggctggtctccaactctcgccctcaggtgatccacctgcctcagcctcccaaagtgctgggattacaggcatgagccactgcgcctggcccaaagtctttttttataacatatgaaatcttgttcttccctatcttccaactttatcttgtgcacttccttccttgcccagtattatctggccttttattgtacttctaacatattgaggcatttcttgcctcgggacctttgcacatgcaatcatctggctacagtgtttctcctttccctactcctttttcggggctacttttttcatttttacatctctgcttaaacattttcacctccaagaagacttgtaagtccattcagtctaacatatatgattcttgctatattctgtcactgcatcctgttcaatttccttcacagccataggaagaaaacctgtaattctatatatttatctgtttacttgtatatttcctattctgtaaactctttgagagccaggataatttttattttgtttatcacttccagtgcccacaatgcctggaaatcatacatactcaaaagatagttgttaaaaaagtaaatgaatatcaattcatttgttgaacaaataaatatgaaatggataggcacattctggacctatcgaaccattctagcatgaagcctttattcccagagtgatagcaatatcagggtccccccaactaatgattttcaagcccactcagatcctttattcatgctgtatttccaagctgaatttccttcccccacttctctctgccttctcaaatatttatttctttcactaattcaaacacacttctctcaacaagtctttggtacccttttcagccccaaataataggtcttgatttctacatttattatctgaatcattcactttagtatcatcttacggtgcctaattctttctaaatctaagttccttccatagtgtatgtagtagagaccatgtgcacttaatccagccagcagcatggagtggaaccccaaaacatattgatatcattggcagccttagcctgtgttccccatctgactcttacatcccactcaggaaagcagaccctaaacaaaggcttacaactaggtagtttattttgggaaaagaaccctagataatcaaattgaggaacgagggagagtaaaacaggggaaaagggtatcttaaatcagattccctagaagtacactctgaaatgggtacgcttgtacaagaaattgattgaaatagtgccctcaggagaaacctatggggaaatgagggagtaggatgggccagggaagaagccacggaaagatatggcttcagctggagtccagccatggcccaaacccagagtatggacaagagtatggagtatgaacagcaccacagagttattccccttgacagcttctgttagtccttggctgtggactgcccttgaccaggcataggggatcctctaaggtatttctggggaagttcatttccctcaatagagggttaattctcctgagatgagttcagctgtgagaccttagtatccaacactctaagcagctggggcatgggtgtgttgacccactaatggtggtcttggtaggggaccaacagcatcctctacagagggaaatacaatataagtatacattctcaagtcgataacaactacaggcacctagggctcaacctgctggaatcttccgagaaaacttacatgcttcagatgtatatgtataatgtgcttcagacatgtctaaacaaggcatggaagagattatttatccaccaactcccagtccccaccagtcaggggttattccgtgggttaataactctcttatacttccaggttgccagtctcactcccaaggtggtagaaaatagggatgaaaatagggatgcccaatgccacttaggcaagaggcttcaggtcacacttgccctaacctggtttccacagcgacagccctaatacagaaagggagacaagaggatgtgagatgtgtcacaggaagtgtccaatccactaactacttgccctagatctttggagaattaaataacctgtcctactgctatgcatgacagaagccctaccagtgggggctagttggccttcacattggctcctggccttctcattggctcatcttaggtgtcttgggctatctgcctgatacacattttcagttaggcacgtcatgtgaccttacagaccaaggttatgcaaaagagaaatgaaaattaacttattaatcttatgacagtattgggctctctgtatttttctcagggtccctgacactgatggtattatctcattctttggtgatgattatgtgtggaatgtttcatttaaaaattccagtgttgtctctcatgaaagcctgatacggtaggctctatatacatactggtgatgatcgtaatatgtgtgtagcacaaagtagtccctgaacaacatttttaatggcaaacagtgattccttcccccaacaaattaagtaaaaatgataaattcctacattgaaagaaatcggcaaaacagaacatttccttcaattcacataatcattaagaagtatcattcataaggggttagaaacatataatatccaaccttcctgtttaacagagcccagcaaggactcaaatgcacagttcattactgtcattatgagagaatttctgccaacaagttacagtcaggttactatcattcaatcatgttgctaataggactaatttcatggtaattggcatattctagaccagagaagaactcaaatggttgtggaatcattaatgatttatgctttcatggtaaaaatgacaatctattagtttaccagatgctggatcaagccatgggccattaacaggagggtgttctcagaacgttttcagaacaaataccagctactttattttcagcttgcagacataatcacatgcatcccctatcagatccaccactatactgtcagatacatcataaattaaaggctccatgggctcattattggctcttattcgtaaaagcaacacgttgccctggcaagacccaaaatattaaatgggcatttaaagaaactgcaaaatgtgtagttttggaaaaatgaaatcttccttaaaactatttacagtactcaagttttcaaaatgtccttcatcctcgattttgcctcaatatttgtttttttgttttttgttttttaataaaagcaaagaaaaaagaaacaaattcctgccctgtcaggaaagcttttaggccgagtctcttaggaactgggtgtcatttattagtaaacctaatatgctgccttcagaagaacagaggtgccagcatcaaataaacaggcttaaaaaaaaaaattccaggaaacttaatgtacactacgttagtaaccaggacaactcttgtttcccagcaatctatggcatagatacgttggtatgagataaagcctccatctttcctgaatcttcaaaacaaatgtaaagctgattaaaattcctcttctgtcttgcctatgtacaaggctgctctcccaataccaagcaatcctatttggagacaatgggatgtttgccaaaccaaaccgaaataaataaataaataaataaataggagagtttctgttttcaactgttgatggcatcacccttgccatttgtggtgatcagattatccacctagaaagtgtaagaaaacaagtcttccggttagcacttactgggcaaagggctgagtttcaagaatcacaactgaaatcggtggggttgctctttgttaatgggaaaaagcaccatgttaaagtgaccagggcctggtgtgtgcaccgcatgatctgtgagcatgagttgtgtgtgcaacatgcttcctcgtgattaccgcctatacggacagtcactgtgcattagtgcattggtagccagccgccgccaaaaacaggatggcattcttccatcgtgattagaggttttgtgagcattttgggatgggggacactttctcagtaaagactcttccgccccattcacgttcattcagctctttctaggggaaattaaaagctgcagtgataatcccttaaggacaacttggaagagtataaaaggtgcagtgtataagcaattggatgagaaagccttttatgtggaaagttactgaatgggtggctgagggtggtgtgagtggggagaaagaggggcagcttttcttttctaaggtggggagcagcggggatatcatggcacttcagttccctttaatcatccagattcctacgctgtccctgcccctggtgtcaccttgttttgcagtgccagctagctcctccctgccattttcccctcaaagagggagaggggagcaatgcgatttttggtaaggacccagtttctcgctgaatgccaactcagccagctggcaccgaacaggccaagccttcttcagaagaggttagcaaaatccaaattagcatggtccattttaaaaacttgcttttatttaaagactgattcatgacaaacagtggctcccgtactgaggtctggcaccccaggggctggcatccaaccaaacacatgcaactaattgccaccctcggatgacacgcaactaacaagctccattttgaggcagtagattcactaagaatgtaaccccggaaggcagcggaggcagaaaagctcctttcataaccctgtcctaggctaaccatggcagcagagagcctgaaaaacacttttgtttcattgcaccaacaatttagctccacggagggctacaaacacggctaacttgctgaaaagtgatcaagggcactgcgatccccctcatggttataggaggcaggggctctgcttttctctttgctcaaggaaacacacaaaattgcctactatcttgaaactccgcatcttgcaccatttgcaaatctatcgacccccagtacttccccttatactttagttcagatgctctcaggcttcctttgtacaagcaagggctctggagccaggatgcctaggttcaaatcccagctccaccattcattagtaattggcaagtattttaacccatctatgcctcagtttcttcatctataaagtggagagaatattagcacctacattactacgagtaggaacgagtcaatgtaataatgtacataggacaatgcctgacatatcatcactctgttatgaaagctctttgagtctgagatagctcggccttatgaagaaaaaatttccctttgcataagctgcattttagtcaaagttcttgcttccctgtaaacttctagagattcaacctctaagcctttgtttaccattctttctcctctcaactgtccttcctccattgcacagccctgtatgactaaatctcatcatcctccaaaaccattcttcaatgccacctcctccgaggagacttctctgccatcccagctgccatgaatccctgcactcttggcatggccatggcaatttctgcaaacaaatgactgtgttttacttgcctgttatatttccttttctagactgacagatccttttgagcataatccacgagtaactagcacatagtagatactcaatgaatatttggtaaagaagtagatggtcagatgaaagaattgctctgcataaatgagtagctttatactatggttatgctgggcattactcaataggcaggatgggggaatcgtttcttaaggactttcatagttgctttggcccaaattaagagttgtatttaacttgtcatcaactgaggctcataaataaaatctatcaaagaaatatgtcaattaccaccttagtcagcttgggctgccataacaaaacaccaaggattgtgtggcttaaacaacagaaatttatttctcacagttctagaggctgaaagtccaagatcatggtgtcagcagattctgtttctcctgaggcctctctccctggcttgcgtatggctgccttttcgttcaccatgtcacatggtctttcctctgtgtgcttcctcccctagtatctcctcttcttcttcttataagggcaccagttgcattggattaggtcccacccttatgacctcatttaacattaattacctttatttttatttttattttatttatttatttatttttgagatggagtctcgctctgtcacccaggctggagtgcagtggcgcaatctcggctcactgcaagctccgcctcctgggttcgtgccattctcctgccttagcctcccgaggagctgggactacaggcacccaccaccacacctggctaattttgtttttgtatttttggtagagatggggtttcaccgtgttagccaggatggtctcaatctcctcacctcgtgatctgcccacctcggcctcccaaagtgctgggattacaggtgtgagccaccgtgccctgcctacctttaaaggggtaattaaggttacctttaaaagttgtctccaaatacagtcacattagggattcaggcttcagtgtatcaattcaggggaatacaattcaggccatcacaatgacatatacatatagaagcatgaatattctgtatattacttaagtgcataggaggaacttaaccataggaagtccacaagcctttgctccttaagtcctggcatccagatcttcattatgttagcaaaagttcagacaatggaaacaaatgtggcactcaaatacacaactattttatctagatgaaaaattaagctttctttggaatttgtgggattcagttggggggctcagttgcttctctcttagaggcaggaaaacatcagcaccccaggcagcagccacaaccctgtctcctgttaaagccattgcctctcccaagaacaaatgcaaattcccagctaaactcctgtgcactttctaggaggaggctcactttggtccttctaggatcaatttatctgaatcttttcttttgaaggcggacctgcagctttatgtagccctgaaactctgaaccagcttctcatgccagcaccccttctttagtcacttcataattcaaattgctgttatcagcatacactatttgtactgatttgactttttcacattgttttaaatcactaatttcctattaggcagattcctcacatcaataccataagctaatggctcccatggtatttgttcatatctttctcttaagatacttaacactttttacctggtaggaggatgatttatagtcatatgtgtctttcttgccagaccttttaactacttaaggttagaattgcatcaaacccattgttttatcccaaccagtgcttaacatgatatggcacacgtagcagagtcacagtaaaagtttgctgtaattcacatagactttgccaggagtgcatagaaggattaagcatcagaagcaatgcaatcgcaaaggtatctcgtaccatcaaggggtgaggccaacatcttagaaaattaagatcaaatatcatccttcatttttaatttaaagcttctagccagttgacccagaaacatcccacacctccaccatgacttaccaatttgtctgaaataataaagaggaaaatgagaggctattagcgccacttccattctccagtcaatcattgttctaaattattaatcagttgaagtattgccaagaaattttcaggcctctctccaaaagtgtaaagtagtcattttcaagtgaacaattaactattttattcatctagaagttgtagaatttatagacaagctgatttctgtggattttcttccccccttttggatgctggtggaggtaagagaggtctacatgaactacaaatagtttcctttccatcactcacttattaataactagaatcctgtttaaaaggaatgtactaaaatattttctaggctgaagcaggaggattgcttgaacccaggagtttgagactagcctgggcaacatagggacaccctgtctctacaaaaaaaaagaaaaaaaaaaagaaattaaattagctgggtatggtggcatgtgcctgtggccttaactacttatgaagctgaggtgggaggacgccagagcccgggaggtagaggctacagtgagccatgattgtgccactgcaccccagcctgggcagcaaagagatactctgtctcaaaaataaagtaaaataaaatatttcctgaccagttcagcatttataatattgttcctaatagcatgccactcctgactgatcattgctggcaaaagcaaagtgatcgattgtcaccaccctgtttgtccccaggattaacttggtaaagaagtacagccatggtttctgctttcgtggagcttacattctagaggagacagtgaaaaagaaaggtaaatagacaaatgaaacaactacagcaaattttactaaaaaaaaaataaaataaaaaaaggaaaaaagaggctaagataaagaaaggggaggtgtaccttaaataagatgtcgataaagacctcactagcaggaatcatcctccgtggatcaggagaatcctgaaactggggacctcataggcagtccaatccaaagtgtgaataggccatgaacatttttaaaactatatattcagttctggtcatctattgacctcagagacactagatttccagtggcatccactactatgactgcaattgctgaggggtaattttctgagccagagttgtagcatgcaatttgccttgtcattctcatctgatgctcattaatagtcccaacttttatgtaaggtatgtgctttcaaaggtagtgtgatatgtggctaaaaatattgatttttttcttttacacttttgtttcttttaaaaggaggaaaagtgagcactaatttttttatttcaactgtatcttttgaaggttcattatgcatatattttgataatcttgtctatgagaatgaaccctaggacaattaaatatcctttaattttgagatgtgtagtctggaaatacctacatggccgtcctaggctttaggttcattttctttgagaggctcaaccccatattatatcagatatatttacaggtcaaaaggcaagattgaaacaaatttagtttaaagatcttaactggcttttatttgtgattctagaatcagacaaaacctcactgtataaaaaagaatgagtgttccaatgagctgagcagaggaggtttcctttacagctggaaaagggatgaagaaagcagaaacaaagaaccaaaagcaaattggttgtttccaagttactttccttgtaaaggttaaagcagagggacatccttatcatattggctacaactggtctagttgaggatttggctactagttctcccccctgatttcttagaaggtcagatgaaaaacttggttttggcttggtggccaaaacttcagcatgagtaattctattttggtttggactgttgagcttggttcagtagttcagtccaaaccaatggacttctataaattttattcaacatacacgaaacagtttttgtatgtgagatctgtgaaaaatatttttatacttttgcatttaaaattatttgcttatgtataatttggttaatttaattttttaaattgcctaaaatttcccagtaatcaacatgcagtttcaggaattcttaagaactgagaaaagctaactcataaaatgtctctaagagtagacattttaataactattacatttagtaattaatcacaatagcataaaatttcatttattgacatatcattaaatatgacattgttcagattgtgcaatttctgcatacactgaaatcaaagtagtttttctctctctgttagttctgaatattttcataggcccttgaaaaatacattggccctagtcattagttcctggtacctaaagattaaagaggcaatagaatatgtgtgtattcccaggtcttacatggcactagatagtgggggtcttttccccctaaataaagtggatgctattataaccatgcatgactccagttagacccagatgaatgtaccaaaatcactaccatttaaaaagcataaaaaaccttgccctcaatttactgtgatttgcaaactctcctctgaagtttcactgaaccccacttataaatatcatcttgcttctttagcaaattctcaaaccttagtacataagaatcacccagagctcttattaaaaacagattcctgggccctgaccccaaagaatcttatttaatagatctaagtggagcccagaaatcagagtttttaaccttctgaaaccttaaaggttgtataagcctttagaaaacattagttgatgtgagcagggttgatgataacagctggtaagattagtcttgacttgagctactgaacaactcaagtccatttaggctagtctctctcaaccctggctcatactagaatcccctggggcttttaaagcactttacccccaaggattctgatttcttctgtatgggcattggtattttttaaagctaccatataaacaaattgagaaaccctaccagcctaagggcatttctgtcagaaaggattaacccacacactgcggtgatgataaggcctaacactcctacaaaatgcaaacactgaagcagagatttcgcaagactaaaatccatctggagctcttgattcccagtttgtgtcagcctcaacacacccaagttggccttaacagttatggcacaagaaaatgagcccttccctttagttttcatcagctggcagaatgatttagtagctctattataaaagcaactccattataattacagtgtttgaattataaacaaaacaagaaaaatacagaaggaatagtcctttagtcaaaactgtaaaacagaacaatttctggctgcagttaaaagcaaactgaaatattaagagtaagctctccagccctttgattcttgcctctttcccataggagcgacactacacattttttcaattaagcagtttgacaacctgaagaaacccacagtgcatgatttaatgagcatatactgtgtgcatggtaatcggcaagctgacagtttgctcatttcaaactgacaagagagcactacacattagtagaaaggtttcttgggtctcttttcattaaataagctttacagttgaggaacattccaactgtattggcaaagctgtcactaatggtccccaggcaaccttaactctctgtcactctccaagtcctcaagtcttgatgaagaaattgcttcttaaaaaacaaagcacaaaaacaaaatatagatatttaaagttctctggatgttgtcaggggcaaggtggagctttctgagccatgaatccactggtgatttcacagtacatgaattctaacccagtatgtgctggttcttcatgcagatcactttataaactggaattgtttttagaaataatgcccaaactgttaaattattcaatagtttagaaatgattcagtgtactggaaaaaacataggccttggtgacagagagataggggttcgaattctgactaaaatacttctctgtggccttggtcaaattacatcatttctcaggggctcagtttcctaatttatgaaacatggacaataacatctgctttgtatgaacaagatcgtaaaagtctttcgcacagttactgacaacacaggcatacttaaatagagactagtttacccacagaaattcagagtatggggttttaacaaagctaactatagtctgactgtcctgagatttctaccatgagcctttattggagttctataagaagaaaaacagtaagctaacattcactcacaaatgggattttatttaatcctactaagattctgaattttgggtgttattacacctgtttttataaaatctcgaaataagaagggttcttagaggtcatatgaggaatttctgacattttaacttttctgattacaagaatatgaaactactgtttccctctttgctctgcttgtcagaaaactcgagtgaattctcatgctaaatgtatgtttgcaactctgttagcagtagcggttagcagatttgtttcctgattttctatacatatgttagtaaccttacttaaaatagtttataagctaccctgaaggaagttgagatttcttagctaactagtaagatccataacaagaatccatgtcacctgactccaggctaggacacctcacatataacatggaaatgacatagaaaaccccagaagcaagtacagtgaagccatagcttattgcttgggtcctatgccatgaagatgatcaaacatattagccttctagttacgaggaaaaaatatggaagcttcagggtccttatttctaaaatagggataatatatatttctaagatcattgtaaagatttagagagaatattttcaaaatcagccagtgtggcattcgatacatagtaacattttaaaagtctgaaatgttgactctaagaaataattgtagttctactaattacaagtaaaacacaaatgcatagacccttaaacatgatttagaaatcatttatccctccaaacttcacgcactgatgtaaaattctgccccaggctaggtgaagatccatacttgctgtctttctctcatgtcacagagtacatggagatctggaaaagttgtccataaattccaaattcttaatataaacatgtctattggaaatacagactcttttttttttttttttgagacagagtctggctgttgttgctcagtggagtcatcttggctcactgcaacctctgcttcctggagtccagtgattcttttgcctcagcctcccaagcagctcagattcccaagcagcatcatgcctggctaatttttgtatttttagtagagatggagtttcatcgtgttgcccaagctggtctcgaactcctggcctcaagaaatccacccactttggcctcccaaagtgggattacaggcatgagccactgtgcccaaccagaagtacagaactttatcaagaatacacacatgtgacattttcaggtttaataatttatacttcagggtactcacaaaactgggccaaaatcatggtctacctctatgtgaaataccaagtttccctatgtctcacagccatgactccactggtgacttcacagtacacgaattctaacccataaattgactatatccagaatgtagccagacataccataaagatgttcatttatcttcaagggagtccacaaaaatagcactgtagttcctcatatgcataccctaacaaaaatgagtcagtggtgtttccccagagaaaaacgatgctgtgcagtggaagcagctttggaaacagacagattcagatttgaaggctggctctgctatccattagttgtatgacattggacaacatagtatgaacctcttagagccatagattcttccactggcaaatggaggaaacactttgaacttatataactattgtaagcaggggttatgttatgatttaaatgtcccctccaaaaattatgttaaaatttaactgccattgtcatggtatggagaagagggaccatcaagaggtgggaccactgagagatgattaggtcttgagagctctaccttcataaatggattaacatcattatgaagaaagtaggtttgttatcatgagtgagttattataaaaatgagtttggccctctcattggctcattttcattttctcctgcccttctgcttgcctccatgggatgacaagcacaaaggccctcaccagatgccagcaccttgctgttgtacttcccaacttccagaaccatgaaccaaataaatttattttcttttaataaattgcccaatctcgggtattctgttatagcagaaacaaaatggactaagacaaatgatatttaaaatatttaaccattagtatggtaaaggcaccaaccagcataggcttaatgcctgttctggtgcatactaattaaatatgaactccatttgaagaattttgaaggcatccaacttgatcctagatcatgggaggtgcttaaacatatacaacgcattaaatgaagcaaacacgtgttgtaaaacattacaataaaaaacttagcagcagttatactgagatctctatactctccaattacattttttcacctgtgttgtttttattccatgattttattaaatgattgttagcttaaagtgatgagccacttgcgtcttttgactcatgattgagacagtcgtcaaaaaattctagatttgaaaagacataaagtgatctcacttggaattttatcaagtctatattcatgtataatccttatgtcttcttaatttaatgactcctttattatgacacactcttcttctttatctctgataatattttttgtcttaaagttgagtttgtctgatattattatagccactctagacttcctatgctgtttccatggtgtatttatttccatcaatttattttaaacctatctgtgtttttttatttaaaggctatctcttaacagaacatagctgttcttgcttttttatacattctaatcatctcagcatttttttgaatatttatttatttttgtttgtttggtttctttgcccacaaaacttattcattttgtcaatcatttgaaagtagcttgcattcataaagcccttgggcttaggtctttttaaaaaaaattcattcatctgtttttatgtgtttattttttcaagtttcattttagattcagggggtatatttgcatgtttcttacctgggtatattgcatcatgctgaggtttgggatatgaatggtagcattacccaggtactgagcatagtactcaccatttggtttttcaaccttttcccctctcccttcttccctgctctagtagtccccagtgtctattgttaccatcttcacgtccacacgtacccaaagtttagttcctacttacaagtgagaacatgtggcatttagttttctgttcctgcattaaattgctaggataatggtgtctggctgcatccacgtggctgcaaaggacatgattcgattcttttttattactgcataatatcccatgatatacatgtaccaaattttctttatctgatccaccattgatgggcacctaggttgagtccatatctttgctattgtgaatagtgctgtgacaatgaacatgcaagtacatgtgtctttggtagaatgatttgttttcttttggatctatacacagtaatggaatcgctggatcgaatggtagttctgttttaagttctttgggaaatcaccaaactgctttccacagtggccgaactaatttacattcccaccaacagtgtataagcattcctgtttctcagcagcctcaccaacatgtggtttttttttgtttgtttagttttgttttgtttttgttgttttttttttttttactttagccattctgactggtgtgagatggtatctcatggtggttttgatttgtatttctctgatgattagggacaatgagcattttttcatgtttgttggccacttgtatgtctgtctccctttgagaagtttctgttcatgtcttttgcccactttttaatggggttggtttttgcttgttcaatcatttaagttccttatagactccagatattagacctttagtggttgtgtaatttgtgaatattttctgtcatcctgtaggttgtttactctgttgacagtttcttttgctgtgcagaagctctctggtttgattagtctcacttgtcaatttttggttttgttgcaattgcttttgaggacttagtcataaattctttcccaaggctgatgtccagaatggtgtttcctaggttttcctctaggattctcatactttgagttcttacatttaaatctttactccatatggagttagctttgtatatggtgaaatgtaggggtccagtttcattcttctgtatatggctagccagttatcccagcgccatttattaaataaggaaacctttctccattgcttttgttaactttgttgaagatcagatggttgtaagtgtgcagctttatttctgggttctctagtctgttccattggtttctgtgtctgtcttgtaccagtactatactggtttggttactgtagccttgtagtatagcttggagttggaaaatgtgtgcctccagctttgttctttttgtttaagtttgctttggctattcagtctcttttttgattccacatgtactttataatagttttttccagttctgtgaaatatggtagagtagttttataaactacctgtataaaacctgtagattattttgggcagtatggccacattaatgaaattgattcttccaatccatgagcatggaatgtttttccatctgtttgtgtcttctatgatttcttttagcagtgttttgtggttccccttgtagatatatttcatctccttggttagatgtattcctaagtattttatatacttctattttttcaggctattgtaaatgagatttccttcttgatttggctcgcaagttgaacattattggtgtacagaaatgctactgatttctatacattgatttaatgacctgaaactttactgaagttgtttctgagttctaggaggcttttggtggcgtctttgagttttttaggaatagaatcatattgtctgcaaagagagatagtttgatttcttcttttcctattaagatgcattttatttctttctcttgcctgattgctgtggctagcacttccagtactatgttgaataggagtagtaagagtgggcatctttgtcttgttccagttcgcaagggtaatgctttcagtttttgcccattcagtatgatattggctgtggttttatcatagatggctcttattatttagaggtatgttcttcagtgcctactttcttgaagttttttatcatgaagggatgttggattatagcaaaagctttttctacatctagtgagatgattctaaggctttttaaaaatcctatttatgtggtgaatcacatttgtatttgctcatgttggaccaaatttgcatgccagaatgaagcctacttgatcatagtaaattaaccttttgatgtgctgttgaatttggtttgctggtattatgttcaggatttttgcctctatgttcatcagggatattggcctgttgatttctttttttttattgtgtgtttgtcaggtttggtatcagggtgatgcacagaatgagtttgggaggagttgctcctcttcaattttttggaatagttcagtagaattgtaccagctcttctttgtacatcaggtagaattttgctatgacactgctacattttaattagtgattagtccactgacatttagtctgattactgatatgattgcatttagagctgcaagtttattatatgttttctgtttgctcctccacttcttgtttttctttttcttccctctgcaacttttggatcatttttttcttaatttaggattctattttatctttggattttcggtggtttttctaggaattaaaacgtatattcttgatctttcacagtctacttagatttaattttatactatctcatataaaattggaaaaccttgcaactgtataaatccatttgccactgcctccattctttatgctataaagtcatatggattacatctgtacatattacattataaacaccacaagacaatgttataatttttgctttaacaggtcctgtgtagttaaagatcttatcatgaaaaactagtcttttatatttacaatttccaaaattttttcattccttcttgaagacttaagattccatctggtgttatctcactttatagcctgaacaatctttcctttagcatttctgtggggcaggtctgctgataataaatgctcttagtttccttttatctgaaaatgtactaatttgcctttactcacaaaggatatttttgctacacatagaattccggattaacagtgttttgcttttttttttacccctcgtttgtactttaaaaacatcatttcactttttctggcctttataaattctgatgagaagtcatcgttcatttaaagcattgttccaccaaagataccgtgccatttttctctggctactatcaagattctctctttattgctggtcctcaccagttggaatatgatgtacctatgcacagttttcttcaaatgtatcccatttggggttcactgcatttcttgatctatgcatttatgtatttcaccaaatttgaaaatttgggcccattatttcttcaaatattttgttctgtttcattctctttctcttctccttctgagactccaattacatgtaagctagacattttaatttctgttacacaggtccctgagtctctgtttattttttttattcagtcattttaagtctttttttctgtctgttcttccaaaagaaaatttctatggatctatctttaagttcactaacactttcctttgtttcctccagttgctgtaagtatactcaatgagtttttatttcaaatactgtatttttcagtttcaggatttctatttggttctttttgcagtttctgtttactaccttcttattcattatgagtttattttcctattatttgtggagcatggttaaaatagccactttaaaatctttgttaattcccacatttggctcatcttggaattggtctcagataattgctttttgtcttcagaatgagtcacattttattgggtttccatatagcgtgtaatttggggttgtatgatatgcaagtattgatgttattgtatgaagagcttcaatcctgttatagttttctgaagggtattgatttatttgttttagcaggcaattagttatactcaaatttaaaactatcccctgggtagcagctcgaatctcagttcagttcttttatctttgtgataatttgtgtctgctccatcaagaatatacacatgacatatacctcagaattacatgacgtgatctcacttggaattttatcaagtgcatattcatctacaattcttacttcttcttaatataatgatttactatcatgaaatgttctccttcatctctggtaactctttttgtctgaaagtttagtttgtctcatattaataaattcaagggtcaaccagaaatttgggtagtgtttatatacagatttgggagcttcccctctctgcctctcttctttccaagattctgaattcattttcctgtggctatgattgccctgaaccctgttctttgggtcttcaaaccaaaaacactgtgagttttctattggaggatggccacccgaagtgacattaattttagcctgttctcactctaaaagttgtaaaatgggaaactcactctggaccgacctgtgcttccaagttttgaatttcagctcccctccagaatctgtctgcttaattttattctctaatgcttccaggtaatttcttttttcttttcttttttttttttttgtttttggtcttttggtactttatagttgatatctgtgagaatttcggatccagtagaacttacttagccatattggaaatggaaacaagtaaaaacatttaggaaacattcctttgcatttcctaacacctctcctcaaaatacttaacctccgtccattccctcatttagtgacatttgagtttggttttaagtagaaatagaagccaggctcagggcttccttgatcatcttgccaagtacatgagaagacttggaatgaaaacacagcataaagttaaatgatagaatgatagaacatcaatcaattctagctcttagactggtggcatttaatctcaaagcaatgaggcttatacagaatcatgactaccagtgattatctacatggtactttgccacgttattttaccttatttctttggtctcagatatctctaaatcctgcctcattgaaaactgcaatagataatatgccacgagaaacagaatactgaaaatcctaaaatgccaacccagagttggtaattgcacaattccttctaatcataatcattatggcttccacttcttgaaagcttctgtataccagccaccttgctaaccactttacattaattgtcagttaatccttcacaactattctttgagcagttcccataactagcttcattttacggaggaagtaaccagagttccgagaggttgagttcactaagagcacacagcaaacagtagaactctgagtcagtctttgtaaagagaagaaatagcaaaggggttttggagacatcaggcacatactctttactattaggagagaagatagaagtctttctaggagtaagtagggtttctaaaacttaaatagtctacagtcctttttgtcagtaattattgatattaaaatgccacccttccagaaacaatatattttatattgacagcttttatgtttaaaaagaaccttctagccgggagtgatggctcacacctgtaatccctgcactttgggtggctgaggtgggtggatcacttgaggtcaggggttcaagaccagcctggccaacacggtaaaaccccatctctactaaaaatacaaaaattaggtgggcctggtggcgggcacttgtaatcccagctacttgggaggctgaggcacaaaaattgcttaaacccaggaggtagaggttgcggttagctgagatcacaccattgtactccagcctgggcgacagcgagactccatttcaaaaaagaaagccctccttcagggcttaaaacactaacccaaacaataacaaaaggatcaaataattatatgtaaaggctcatatgaaaaggcacataacaccagtgctccattttacctcatttcatttactgcctttaaactttgttttccaggtaaaccatctaaacaggcaggtgacctgccagagaaaaatctggcacattaggaagtaaagatgcctgcctcatcccacaacaagatgcagcaatgtctcacagttctacaactctaggggcaatcctgcccaactttgcaaattttgcataaaccatgggtttcaagtgactttggaatgagagggaaagggaaggcagcacgaaggataagctggctgacattgtaaagtggatacaggaaactgggacttaaccggaagcaggaaaaggaatatagtatctttgtgttctggtacataggattattcaatatacatatttattatacatgttaaattgtctgagacccggaaatgagagatactgttaaaggagtaaagatgagatgaggtaacagaaaaggagaggagtaaatatgagtcctaaggaggggttacatgagcacagtcccctgacgacatgctagagattaccagattagtgcattgctcctactttcttgctattattattattattattatgggttttttttggcagggtctcactctgtcgcctaggctggagtgcaatggcatgatcttagctcactgcaacctccacctcccgggttcaagtgattctcctgcctcagcctcctgagtagctgggattacagacacctgctaccacatccggctaatttttgtatttttggtagagatgaggtttcaccatgttggccaggctggtctcaaactcctgacctcaagtgatccacctacctcggcctcccaaagtactgggattacaggccctttcctgctgtttttaaaaatacatattcaacatatccggtgaaatcattcaaagatgcatacagataagtgattattttactctaacgtaaagcctctttgtaagacctacccttcactgtctgtcccagcatatgccctaggacttcctctgaccatgaacagtaccatgccactgaaggagatctgtttcaacagagcctcctcctgctgctcctaactttatttccattccactagcttctcaaagtcatgcaaaacataacaacctgactttgtaactgtttaaccttactttttacacgtaaaaattattaaatatgtgtaactgctggggggaggataatataatggcatgtcagtcaggtaacaggtaagctacatttcatggaaaagaaggggaatgctttcttcagaaagtgaagtcatcattcttttatttaactgacataatatttataccccaatttttaaaatggcagctacaaatagaagtcgaaagagggtaaattctccaagggaatctagccctgaaattttaccattttaaaagttctattttacaagtacataggaacattactactattataaggatactcacagcaggtcaattatttcaaactctttgaaaaaaaaatcaaaattaagtaaacctacctttcagaagactgctacctcttcggagtcctcagtggcaggatgcacagagcttttatagagggtctaagcaggcaggtattcctaggatacctacaccaaggacaagaaattcagatgattatttcagcagtgatccagatggctctaggtacaatttcattaggaacgttcaccatgaatactgagcattgccacacaggtactgttaaaagcgcagaatgaaggtacatatgtgatttttgcaggcattgtcattaatctgtacattggagactgtggctcaaaagggtgtaagtggttcatacatgatcacacaagaaaaggggcagaaccatgccttaattattcatttctgattcctagtccagggttgtttcagccacatcatctgatcctcctcaagaactggaaagtcctggcactggggctttccattttgcaaaaagatgaggctgacccgtgagtctggtgggaagagtctttctctggttttctggtggtctatgccaagtcacctgtctgaagtgtcctgtgtggccagtttactcactttcccttgaaactctggtgtccacagaatctgaaggaatctgacaagcaaagaaacatgggtttttttggtcccactggcctgagtttgaatcctagtaatgtgtttactacttctgtgtcctatgtagctgctcaacatcactgaggctcactttctatctctatcaaacgggtataataatatttgaagggtacatttatgaagaggattttttttttctaaatgagaataaagtatcaagtacagtttctggcacatgttagatgctagggcaaagtgaaagccccatgacccaccttacttgcagggataaccccaaagtggacaagtgacagggaggctattgagaccttgctgctcataaatcactcaatgacaatgcactaatcccctaactggctggttcctcactgctctgacctctacctctgggtttccttcatgtacacttctttgaaataaaaatatcataaacaccaattcattccctaggatctcatttagaggtaatcgtttccttttttaatctaataatcttggtctacatcatgttacatggtcagctcaatgtagtaattgaaagcagatgatcattcatttaacaagtatttattgagactctactaaggtgtcaggcactattctctatagcagtggacataatagtccaagatcaggccatcatgctgcctaccttctggtagaggagacaaacaaacaaaatacatatgtaaaatacatgagtggttaaatagttctaaggactctggagaaacacaaagtaggaagggagatggtgagtactatgggttgaattctgttcccccaacccctccccatcaggaaaaaagatatgttgaagtcctaaccctcagtacttagaatgtgaccttatttggtaataggattgatacagatataattatttaagttaagatgaagtcatactggagatcggtgggcaggcctctcatccaatatgattggatataagaggatgaccacgtgaagacacagagacacaggggagaaggaacgccatgtgagaataaaggcagagattggagttacatagctgcaagccaaggattgccagcaaatcactagaagttaggaaaaggcaaagaaagattcccctgcagatttcagagggagcatggccctggtgacactttgatttcagacttgtagcctccagaactatgagacaataaatttcggttgttttaagccactcagtatatggtacttagttactgccaccctaggaaatcaatacagtgtgtttggggagattgttgcatttttgagcaaggagatcaggaaagatctcactgaaaaggtaatgtctcagggaagatttgaggtgcaggggacaaccatgatgatggctctggatgaagaaattctaggcagagggaacagaaagtacaaacctcccaggcaggtgcatgtttgtatgttagaacagcagggaggccagtatggctggaatagccaggggagagtggcaggaaaccaggtcagagtgatgacaaggagctggagggtgctagaccttatgggccactctaagaacttaggcttttacttggagcaaggtgggaagccattgcctacttctgagcagaggtgaaccaagatctgacttacattttaataagctctctctggctattcggtaagaataaactgaagaacaaggccacttaggaggctcctgcagttatcctggtgaataaaggtgctagccaggtagcacacaggagagtgaaaactggtcagtcctatgcgaaatattttgaaagcagatccaaaaggatttgcaatagattgcaggtagagatacgcctgacttcttgatagtacatagaattaaattagaaaccgtaacaacttaactgtactgatcatctgaataaattatcttctcaaatgccagaccagccaaagatattagcaacaggtttaacagacagggaataagtaaccagaatatataaggaactcctaaaatcaacaaaaagaaaaaggtaaacaaataaatattttttaaaatcatgattcaaagaaggaacaatggaccatggacataagaaaagcagctcaacctcactgatatggtttggctgtgtccccacccaagtctcaccttgaattgtaactcccacaattcccatgtgtcatgggaggaacctggtgggaggtaattgaatcatgggggtgggtctctcccatgctgttctcatgagagtgaataagtctcgagagatctgatggtttaaaacatgggagtctctctgcacaagctctctatttgtctgctgccatccctgtaagatgtgacttgctcctccttgccttccaccatgattgtgaggccaccccagctacacggaactgtaagtccattaaacttctttctgttgtaaattgcccaatctccagtatgtctttatcagcagcatgaaaactgactaatactctcactaaacatgaggaaaatgcaaatgaaaataatgggattctactttatttctatcagactagttaacatgaaaaagactgacacaattcagtgttgtccaagatatgagaaaaaatagcatattattctagtttacttccagcggaatcatgaattggtatattattctattgagcaattttactgtattatcaaaagtgacagtacacatatgccacggcatagtaactcttcttggggggtataccagggctaagaaacatacacataaggggacatatattaaatcagtataacaaaacttggaaatgacctaaaagtcacccttaaaggcaaatcagtaaataaaatatgctatatttatatgattaaaggacatatggctgttaaaaagaatagattggttttataggcatcagtgtggatgtttcataaatgtcatgggcagaaaagcaacacaaaggaaaatgttaacatacaaacacaatagtatgtattcattgtaggtcggggtccccaaccgccaggcggcagaccagtaccagtctgtggcctgttagggaccaggccacacagcaggaggtgagtggtgggcaagcgagcattaccgcctgagctccacctcctgtcagatcagcggggacattaggttctcataggagcaggaaccctagtgtgaactgtgcatgcgagggatctaggctgcctgctccttatgatgagaccctaacgcctgatgatctgaggtggaacagtttcatcccaaaaccataccccccacctccccatccatggaaaaattatcttccacaaaaccagtccctggtgccaaaaagttggggactgctgctgtggatacacatatatgtatgtaaaagtataaacaacggactagtcaaatacatcccaaatttatggtagggaattttaggcaggggtacaggcagcaaagaaagtggagggtggagggaaggacaggacattattggtgaaaatgatttggttttatcaataacttctttaaaaaggaaaaaaacaacactggaagcaaatctgaccaaacaaaaacagatactcgttttgggatagtgagagtacagatgatcattacactagtttttgtgctcatctgtgcttttttgttttctgcgagtaaagaaaggaggaaagggagggagggatgaatggatggaaggaaggaaggaaggaaggaaggaaggaaggaaggaaggaaggaaggaaagaaggaaggaagggagttaccagttctggactgcacttaagctaatcgctaatcatagatggggatagatgaggttagtttttttgttttgttttgttttgttttgttttgttttgagatggactttcacacttgttgcccaggctgaagtgcaatggcacaatctcggctcactgcaatctctgcctcccaggttcaagcgattctcctgcctcagcctcccaagtagctgggattataggcacgcgccactacgcctggctaattttgtatttttagtagagacggggtttctccatgttggtcaggctggtcgaggttagttttttaaggatgaaactcaaaactatgttttaataatcagcgtgaccattggtgattcctagcagactgtctcagcgtggagggctgaatttcagttcagcccgcagagggaaccatctgtcatttggaatgacaaggagctctctgccaggggaacaccagaacaccggaagcagccatggtcttcactgcatccccactggccctggaaccaccaacactacaggacacaggaacacacaaagtaaaccaagggtacaccatggacatcttttcaacctttttaaaagcacattgcaattttctagaatcaagggaacaatatgcttgattagttcttcagcagatttggcaattttgcttgtcatatttctctctttaaagcaagttggtcattaaccttccatgttctaggacttgagattaggttttccccccacaaaatgaaaactttgcttaaaaaaaaaagagtttgctttaggataattcatttttgctgctaataactgcaagatcctctttgagccaaggaggtcattcttgaaaggggctagaattgtgaagaatgttccttctcttcctggagagagagtctgtgaaggcaaaaaagtttgcaggaaagttcagtaatcatgaagtgaaagcccaaagtgacctgaatacttcctcctgggtcaatattgtatgtttaaaaagaaacaaccaaaccttcaaagaaaaatctggccatccccaaatcccaatacatgaaactagaaggcaggaggcaccagtagaatgctggctttgctctcattgcttggcctccatcacagttacaatagttgcatatcatccttttgtacgtgtcatcctaaaaatgggatttggattggtttctaacaataaaacgagcaaggtagaaaaggaatattatgaataagttaccaatgtaaatatgctattttgcgcctttgaatttgagtgttgataaacatgattccacacatggaaattagacttttcagagctactacactgaatcatttaatttgtctgagtaagtacttataataatgtggctgctctgcactgcaataaacatcgggttttcaaatgaacaaatgaagtatgtgatactccttataaatggaactgcagcaaagggcgttcagctagggagctgtgcactaaaatgggatgggtgataagaacatctctctccagctccactgatagtgaaaggaaagaatcatatggcctctgctgctacattttctgttcctggacagaagcaaggctgaagcctcactgtgaaatgatgggggactgttgctattttgggttgtcacagggtaacttgtcacactactcaggacacatgaggacagataattctgttcctccagattgtggacttgagaatgctttagtaaaatagcacagggatatattttggatagtggttaaggacatgggtttgaatcctgggctctaccaaccaaataggtgcatgattgtacccaagtaatcatcagtcttctccatgctcattttcctatttggtaaaataaggataataactttggcttcctcattaagttattagggggattcagtgagataatttatgtaaagaacctggcacatgattagaattcaccttttttaacattatcattttaacattatcatcacatttttaacattatcattcaccttttttaacattaacataaccattttaacattatcattatatatgtcatcattattattatatttaaccttactttcattttaatccattattcaattttccttcaacgctcattaaaagcacaactcactacattgtttagtaattaattacttttgttcatttaacaaagtatttatactttgttatatgtgccaggcacatatgctaggggctagggtacataggtgatctaatcctcctggaagctattagaggagatgggcatgagtcaaaggctcccataggaagtgaaacctttgaaactcagggaacaggtctaaaagaaaggagcaggctaggcatggtggctcatgcctgtaatcccagcacgttgggaggtgaggtgagttgatcacctgaggtcaggagtttgagaccagcctgaccaacatggcaaaaacccatctctactaaaaatacaaaaattagccaggcatggtggcgggtgcctgtaatcccagccacttgggagactgaggcaggagattcagttcaacccgggaggcagaggttgcagtgagccgagatggtgccactgaactccagcctgggcaacaaaagtgaaatgctgtctcaaaacaaacaaataaacaaacaaaaacaaaggagcagatcactctaagagatactaaaacaaaggaacttaaattaaacctgagacctgaaggatgagaaggagaacaagggatggaatgatggctttcttgagagaaacacaacaatattcaaaggcatggagtatacagcactttatcattgttatcaaaagtcattgcaaaatgatctactgaatagctcaattaaatctaacaactatgtgacaagcacctactatgagccaagcgcagtgccaaactctagaaacaccatagtaaagacagatatgatccatgcctgcatccttacctcccaacacctactactatgtttgaaaaccacaccaaagtcaatatttactttgtaaccaataaattacccctctgggtttgatcacagagagatttcacctgcatggaaaaactggaatgctttctctggtcagacaaggaatgttacatatgccaaataattccctttcttcttagttgctggatatctacaaccaaatttagtttattccatgggcctaccaacttatactactaaagatggccatgtttctctttcatgattaattgttctattatttgtagactacctttaatttagtaaacagcctcagcctcaaattatttggaaagttattagaagaggagaaaaaagtaaaagaaaacaaggaaaagagatctcaagtttcttgagatctgggaattgtccaatgtgctttctgtagtattcgtggtacctaacatggtgctggatggaaagcatttaataacttctgattgtcagatggatgaagaatataaagctttcctggttcaacttgggctccattagaaggagggaagaactgaaactcggtagatcagaatatgcctccccacaacatccttctttagcataaggattattttgagctgattattttgagagactgcagctacaggagaagatctgaaaacagaagagaagttacctttttgtaaaaggattttacatctataaaggaaatttctactcataagggtgtctccctttctataccaggaagagaaggatgaccaaatcactagagactcttaccaatggagaagacaccaacttaaatctgcataacaaaccttactcatgtttaccatacttttcctgggcatccctccacaactgactatcccccatacccttcttttttttctttcagtggacaatggtatttgagcctgatctcaaagccacctctttgagatttattcatatctctgggtatcttccacgtgtacatgagatacacatatttttaacttctgtttgtttttctcttgtttctgggtctatcccaacctaaggaccataaagggtaaagagaaaattatttttccttccctacacttacttttctctagtctccaggttcagaggaaagaactcaaaaaagtggctgaaaagtttagcatgattttcattgtaaagcagcccaataaccaaacagaagcaccacataaaccaaaagaagagagtggtaagtgaaatataaggtaccattagagatttctctcagggaataagattcttgtaacaaaatatttacctttcttattctggtgctagtaaaaataagagaaatgtcacaattttaattaatgtctaagcaacagggaaaaatattaagctactttatgacaaaatggaaatatatttgtaattctatatcctaatgttctctcagttattttggaaaaactattagtcctttggtctcttctacattaggagagcaaaaagctataatatggcctatctggctaactatcgggaatcggagaaatcaatttaaaagaaatttggaagacacctacattatcgatattagagcaaagtagagatctgccttgttcacagcaaagcaatccaattcacacacacacacacaaaacaaatgttgcatttatggaagtattaaaacatctcatccttgtccttagcttaacatattaatgagaatttctgaattaatctccaatcgtgaactgtgtctaggtgtgatataagggcagtaaatactgtgcagcttgcttcaggcatgttttatgacagattctctgacagatagaaaatctttaagattaaattatttctgtattttcctaagaaactcatcagtactaacaagcataccacttccccaactagttgataaacagaaaagaaaatattattaagtgatggcacttgaggaaatagttaaaaggagaaactcagaacataagattgtgattatatataatgaggagattctcaaaatggcacagaaaggaaaggaacgagttgaagctgaaaaacgtatgtttttaggaggtaagttattccataaagcaattactaaaatgtgagagttcttctcatggttctcaaccttatactctgaaagagaacttcttataatgcaagactaagagagccaattacttcagcaccaaggtacatcctaaatctctggacttggcagttcaaaaaaactcttggaaaatgttcttctaaaatcttcactaacagccctgactttagaaatgtagactctaaaaggatgaataaaaactaaccaattagatagcaaaatggagaagagagagcactgaataaaaagacctgccagagttcgggttgtacctctgccaccagcctcagacttagttcatatttacaataaaaccataatcataaaaattaataattatggaacacttagtatgccaagaacttttcatatattatctaatttaatcatcctaacaacctatgagggagacaccacataagagaaaagcagttgaagagtttgtccaagaccacccagctgctctgagtgatgggttaggattcaaacacgatttttttggaccccagagcccaacccttaaccactcactctgcagaatagttcagaaacctcctaggatgatctaaaaggcttctttcaacaatagggcgctaagatttatgagacatgattgtataatggaaaaaaatctcaggtttttgaagtgactttgtagcccagttgagcagcttcttctctaagcctcagaatcttagataacaacactacttaccttacaagctggcctaaggatcagagataatactagagcccttagccccaagtaataataataataataggcagcatttatataatgctcattatgtgctgggcaccatctaaacatttttttccccacattaaagtatgcaatcttcacaatgaccttaaaagtactattattttgtactttttatctaattgtataagaatacaattagataaaaagaaaaaaaaagagttctattgttttgattcctgttttaccaatgaggaaacagaggcaaagagagttaaattacttgacctaaatcacagttactaagttgcagatcttggattctgatccagacagaatgactcactggacaacccaaaacatattggaggcactcctactgatacataaagaacctccttgccatgcccaatgtctgtgtcactctcacccaaagtaacaaatttaacataaacttgggaggatgaaatacatagggatgcccagataacctgcctactgtcattccgcagattgtgcctttaaaaaaaccaatttcaatagaaaccagcaagaaagagatacatcaggtatgtcagacatacgtggtcacaactattttttctccttcctggctaatcactccctttgtgttgataatgtgctgctttaaatcaattcataaaaaaaaaaaaaagcacagaggcaccataaaagtcgtttttcctgttttcaatctggaagaaattcagtctcttattcattttaaaaactattttaataatagcttttacttaacccaatatatcaaaaatattatttcaacatgttaataaaagttaataagagattttacgctaagcattcaaaattcagagtttactttacatttaaggcccatctcaaatcagactaacctgattagtctgaatgctcagtagccatatatgttgctagtggctaccatattagacaacacagttctagaaagattggcttagaaaagccctggttgttgatatttataggtctctttccttgggctggtcaaattccccagaaagatatctttcaatctcctgccttaggggtataagcctgggtgccattgttctgagatttaagtatgggaaagagcagaagccccatcatattgtctttcacttaagccccgattttcatcattatacccatcctcagctatgcatggtgactccaatcacgagccctgtagttggtccaacccctccagtcttcctcctggggaagtagggagggaggcagttgggagaggcagttcccaggctatgcgggttgggcaagaactctggggactggttagcagttatttgtcattctttcaatgttcttttaatattccttcattcccactttcatacatttacagtgccatgaattcctgacacgttctagaatctcagtttagattttaccgtttctctccccttttaaatcagtccctggccttttaaggcagcttctacaattgtattctgtgaccttctcctctatgatttttgttcatattcccctccccttttttaactaacattttttatttgaaataattgtagactcacatgaaggttgtaagaaaaaatacagagaaggtccatatgccctttatccaattcccttcaatggtaacatcttggaaagctattacacagtaacacaaccaagatattgacaatgacacattcaaaacacagaatgtgtccatcccagggatcctcttgttgctctttaatagccacacccacttccctcccactccaccccttcttaacttttaaccacaaatctgtactccatttatataattttttcatttgaaaaatgttatacaagtggagtcgtacagtgtgtaatcttttggttttgtgtttttttcccctttaatctattccctgaagattcagtcaagtagtttcatgtattaataattcattgctgagtagtattcgatggtatggatggaccacagtttgcttaaccattcacccaataaaggacatctgagttgtgtccagtttggggctattacagataaagctctatgaaaattcatgtatgggctttggtgtgaacataagcttttgtttacttgggataaatgcccaggagtatgataagtgcatgtttaattttgtaagaaactgccaaaccattttctagagtggctataacattttacattctcaccagtaacacaatttctctgcatcctcaccagaatttgttgttatcattatcttttattttagttatttcaatatgttcatagtgataactcattgtggttttgatttgcatttccctgatggttaataatgttgaacatcttttcatgtgcttatttgccatctgcataacctcttcagtaaaatgtctggccatgtattttctaattgagttgcttggatttttttactgttgagtttgaaaattctttatatattctaaatactagtcctttgtcagatatgtagtttgcaaatattttcttccagcctgtagttattcttttcattctcttaaaagggtcttaggccgggcgtggtggctcacacctgtaataccagcatttgggaggccgaggagggtggatcttttgaggtcaggagtttgagacctggccaacacggcaaaagccagtctcaactaaaaagaaaaaaaaaatacaaaacttagccagccacagtggcatgcacctgtagtcccagctattccagagcctcaggcaggagaattgcttgaacctgggaggcagaagttgcagtgagccgagatcgtgccactgccctccagcttggggaactgagtgagacactgtctcaaaaaagaaaagaaaagaaaaaaaaaaaaaaaaaaactctttcacggtgcaaaagcaaaagttttaattctgatatagtccaatatatcaccaatatatcatttgtttcctgttatggattgtgtttatgtgaaatctaagaactctttccctagccagagattccaaagatttttctctaatgccttctccttctaaaagaagggttctttattctgttccgttgatctatgtttctgtcactccatggatagccacatagtaactatgcaatacttcttgaaactgggtagactgattgctcccactttattatttctttttcaaaattgttttagctactctagttcctttgtttctgtataaattttagaataatgtcatctatatatgaaaaaaatcatactgagatttttgataggaactgctttaaacctgtatatcaatttgggaagtatcggtatctttactacgctgtgactttcaaatcatgaacacaacatttttctccatttatttacatttttaaaatttatttcatcaacattatatagttttcaacaaacaagttttataaatgttttattggattcacataagtatttcatatttttgagctaaggcaaattgtactatatttttaaaatttgtgtccacagattcattgctagtataaagaaatacaattgataatttaaatgtctatctcatatcctgccaccttaatgaactcaattattagtttttcatttgtttgcttgagatagggtctcactctgccacccaggttggagtgcagtggcacacaggtattggcacaaacacaaccttctatagcctcaacctcctgagctccagccatcctcctgcctcagcctcctaagtagctgggatgacaggcatacaccaccaggcctggttcatttgttgttgttgaggagagatgaggtctctccatatttcccaggctggtcttgaactaggctccagcaatccacctgcctcggcctcccatcgtgttgggatgacagtcatcagtcactacacccagccacttactagttttaagagttggttttgtgttttttcgtctttgtagatcacttagtgttttctgtgtagaaaatcatgacatcagcaaatattaacagttttctttctttccatctgtatgcctttcatttccctttcttgccttattgcactgattagaacttcctgcactatgttgaataggagtggtggaaccagccttgcactgctggactagactccatttcgtcgtggtatattattcttttagcctgaatcctgtttgttaatattttgttcaggattgttgtgtctctatttatgacagttattggtatatatttctcttttttgcactgttttttctgtttttcatatctgagtaataccagcttcctaaaatgaattgcgaagtgttctctcctattttctggaagagactgtataaaactcctattaattattctttaaatgtttggtaaaattctccagtgaggccatctgggcctaaatatttattttcagggagtttttaaatgattaattcaatttttaatagttatgggcttttaaatattatctatttcatgataggtgaatggtaggaatttgtgtttttgaggaagtggcccatttcatctaagttatcaaatttatgtgtgtagagttgttcatggcatttctttattatccttttgatgtctacagggtcaatagtgatatctcctctttcattcctgatattgtaaccaaatgcaggtccagatgcccactgtttacagagtccagttaacaagagtgaggtctagtagaaagaaagtcattttactaaaaccagtaaaggggaaatggtcagattcccgcccaaagcaatcactttgattttgggggaaggcaggggtttaaaaagggaaaacttgataaggaaggcatgcaagaattgtactaagtataatatctgtgtgtcttgttctggtagctatcttgggtctcagtctacctggatggtgagtcaagacatctgggaatatctttacttcccctttattcctgaggatattttcacgggctgtaggacactgctttgattgttgattattatttcattcaggactttgaatgctttaagttcctgagcagccatggccaggtttttaactagccactttgaagtaatctctggaattttgcagctgggtctccaagcttattccgcctgtctcaagattagcccctggaacttctaagaaggcacagtaattagatactagtatatacttagacaaatgtgaagggagtatatatggtgaaaaagggagggacgtggagcctatttctaggctgaggaaaaggcttctgcagtttttcaaggttgtatcttgaaaaccaagagaagagaaaaaaatgttttaaaatgcatttggaagttaagttgcctagttacaatattggtaattggtgtcttttctcttttctttgtcagtcttgctagactgtcagttttattaaccttttcaaagaaccagctactcttgttttcctttgattaaagtttgcatgatacatcttttcccattattttactttcgtctattgttatattgaaagtgagcttctcatagacagaatatagttgggtcatattttttaaacaattctgctaatctcttccctgtattataagtggtatatttagaccatttaactttaatgtaattattgatattttagaatttacactgccattttattttttgtttattttctgtttgttctctttgtggttttctgttttctttgcccagacttcttataagctatttgaacactttttggaattctgttttgatttatctaaagtgtctttcagtgcatttctgtatataattttttaaaggtttctctaggtattactttatatatttataactaaacagtttactggtgtcatcattttaccagtttgagtaacatatagaaaccctatctccgcactttgcatccctttatcttccccatttataatataattattttaaatacttcctttacatgcatttacatccacatcagaatattgcaatttttgcttcaaacttcaaacacaattagagctctcaagagtacaaatgtttttgctatgtttttttcttcctttctgatgttgaagagatccatttttaattgtcttctttccaattagataactcttttcttttctttcgaggcagagtctcaccgtgtcatccaggctggagagtgcagtgatgcaattatgcaaattcttttagttttccggctgggcgtggtggctcacgcctgtaatcccagcactttgggaagccgaggcaggcggattgcctgagctcaggagttcgcgacgaacctgggcaacacggtgaaacccgtctctactaaaatacaaaaaattagccgggcgtggtggtgggcgcctgtagtcccagcgactcaggaggctgaggcaggagaatcgcttgaacccgggaggcagagcttgcagtgagtcgagatcgcgccaccgcactccagcctgggcgacagagcaagactccgtctcaaaaacaaaaacaaaaacaaacaaacaaacaaacaaaaaacacaaattctcttagttttccttcatctgataatatttttacttcccctttattcctgaggatattttcacaggcaataggatactggcttgactgttgattgttatctgcattcaggactttgaaagctttaagttcctgagtctcagcagaaactcaaaaataatacatgtaggaagagctaaaaaaatatacaataaaccggatcctatcgaatttaaatgtcaccaggctacaagaaactgattctggcagaaaaaataaacatgtgaaaaataattacaataatgtgtgataagtgcaaaaatgcaggtatgtacttgtcacgatgctgacacacagagagaatcagcactgcttgagagaatcagtgaaaacttctcagagatgtgtgaaccaggttctgaaagttaggtagtaaaaggacttcctgggtgaaggggaacccagcacgaaagccctgagaaaagcggaaaagatggtacatttgagaatctgtgagactgaatgcctggctgaggtatagaacacccattggaacaagcaagagatgcagtagaaaagacagctaagggaaggatgctgggctagagggcctcatcctctactaaggagtaaactttatcctgtgtaccacgaggagctaccgaacagacgaaaatggtgagtgtaatatttaaagcaatgattgctactataacactctttttaaagtagcttttccatgaattattaacattatctttagtctaatacgtatcaaaatttagtttatggactggtaggatgtgttaatggccaataaaagtaaaagactcagccgattccctgccttctacactccattttacacacactccatcctgcctgccgaatgacttcagtgtctctgtgaccagtgagtgaagcagcatgcaatgagatcatggctagatggcagcacattcagtgaagtgcttcagctttcctgttgcttctgattccctggcatttgtcagtgtctgtcaaaacattaacatttcttaatgtatattttgcattatttactaaatgaaaattttccaatgacagtggctgagaaaaaaaaatcagatttacatacagtatgtcaagttcacattcgatgccccagaaatgcccagtccccaaagacctctagggactgcagctcatttgttgtccctctccctctcccgtttattatgctgaccctctgcccagccacatagctcaccccacccccttagaagcatctagagttggctctagacatgaaatggaatagatttctgcatttacataactgctatcgcacttctggtgaaaagtagtttcagaaaaacacagaaaaaaataaacagaagaataaaaagtgtctatgtgataacataagggcttatttaactacgtctttatttcctttacagtccaactattttttttttaaaactgcatgccaccttcatgctgcctctcggaggggacttgatcttatttagacccggtggcgagggtccttcagctccgtgaggagctctctagcactcagtcctctttagaggaaagatatcttcagagcctaaaggccttgaaagaaatgacacatttttaaaaacagaaaaacaagcatgaaagtggcccatcagaaatgaaggtgtgaactagaatacaatagacagcgaggaaggagccaaaaatcctcacccaggcaggccaggatatatgcagatagggaggaaattgggaggcattcctttgctaataaagatgatttttcttctaattttcacatctttcatgatgtatcttttgttttttgttttctctctatgactgctgttctaaaataagtgggctttaagaatatgaactacagtccgcatgtttgccagccccatattctgcgatgaacttgacatgtgaatgaatcaattctgcagaggtgaaaagttattcctacaaagtccccagttttccttgtgagaaagatccctacttacctgtaaacttgttaattaaatgtcaaaggtttttatatcaaggacaataacacaagccaacctgggaatctgcttgtctgaaataggtaaagagtgtctgtgtttatttagaattgattgtacactttccttcattctctacatagattttattttctccccacattcttctttttctgtattgccttgagggctttctcttataattatgtgacaaattatatctgaattatgttcaaataagcaaggagactgaggttttctgttaaaaacatatggcctatcagtaatgaatgaagttttgcccatatcatgacatgactttattgaaggcaccatctcatatatgcagttttcaatgtggtgtctaacagatttgtgtaaaatgtctaaaattaagcaaatgcaattatatgagttagtatcatcttatcatgtacattttgcttgataatagaaaagcaaatgaaaagtttattagcttattacaacagtctgtttttgatttttactttagactctattcctctttattttctcctcttctgtttcgggtcattattttatctggagaacccaaaatccaattcttcatctgtatttaccacatagatctttagattctcttaccaatccaacagatttctgaatatttaactaccctattgtaagttgtcttgtttagaagaaatggaatctaagattgtggcagtaaaggacaagctgtcaatgtgttaaataaattcctgttgaaaagtaacggcatgcactgtgtgttaacataatttattagaacaattagaacccatccttgttgtcttttaattagattattccctgttctggtaattacactagacaagggagaataatagtcttgggattctaaaatcatctgtagactatgtggaaagagaataaataatcaataatgctaatgtaccggaaaacttaaattcccagaaagagatcttttatcatgagcaatcctttgtataaacagcattatttctcaatgtctatgcttatcttgcccaaagttgaaaagtgaagacactggacaaataacagatatttattttactgtcagaaacctggttgggctgggccacctctggcctctagtggctcagacattgcttcagtcccttgcaaaatgccaacaagaaaccgcaaatgaaggatttaaaattccatgcagagcagcatatctagcagtctgaatgcctaagggaaaggatgcagggcttttaagttctggtcctaggtgaggaatcataaagttcctcaatttaaaaaaatatatacaaatggacaaaaatgtcttagaactgagaaggctactaaatattaaaaaaaaatttctgatatttccatacatgaagatgttatttgcagaaattaataggcaggctgtatgtcaggaaagtttctggctctcagggatgggctgaggcctttagatgtgaatcgaactacatctctggttttatgtttggaagaccacagggaattccagtgctccaaggacgctccgagggcctacacaactgtcatcaagcatgttaggacatcctagagagtagttcccaaaacttctaggcttcagaatcttgacaaagtcatgggtgggcatatcctgccctcacggataaccctacagttgagtagaaggatgctggaatgcacagaattgacaccagtgaatctggagttctctgtagtaatgagcaacacaaatatctcaccaacagtcccactgttatccgagtctgccttagtcaatgtaaactcctaatgagaccatgtctagacagtattgatctcccaccagaaaaaaaaaaagaactcagagtgtgacttcttttctagcttagcccaaatgacaccctaaaacatgctctttcattcactcattgctaacacttttcataacctgagatattttatcaactaggcagccaaggacccataggcttcttcgcaaggtatatgtgatattttttatatttaaaacatctttgatattcaaatagcagataagaaagttacttaagcttattaaagaacctagagaaattaaatgagtgtatatatatatatatatatatatatatatatatattttttttttttttttttttttttttttcccttgctaggcaaaggagacaggcctttaaaaaatgaaagtccacataagattaaggtgtgatcattcaagttaatgtgggcaagatatctaaaggagaaatcattagcttaagctatccaaaggattttacacacagtcctgtggtttaggagcagaggatcacccgtactactgtgctatccatcccagctgggaagacatggttctttatagaagtaccccttaaaattgtcaggggtgctattaagtacttagggttccccactattcttatctccagactggtcaaatctaccaggcatctttctgatatatcagatagatacaatctatcatagatataccaaagatttatttgcatctgagtgtcctgtggtgaggcattccacagcaggctgtgcatcaggtctgtctgcagaaagtaagaaagaaaggaatacagtttaaaattcacgtaggaatggagtttaaaaactccccaggcaatgtgaaggtgagttaggactgggaaccacaagctaaaaaggagaaccacagagaattctttctgactttggggctgaaatgaagctgaccgaggcattcaggtggttccagaggctggaaagtctcatacgacaggtttttttctcacaaaagagaagtgaaataagtaccttattatgttccaacaatatcaagatacaaatctatcttttagaaaaatgctaaataaaaacacagtcagagagagacttccaccactataaatagtttcttataaatgccacctagagacaaaattatcatttctatgatcctaaccaaaagagccttgcatgtcttggaaatactttgccctctaaagcaaccagaagaacattccttcagtctatgtgttcttgtgctggattttgaaacttttgagcatttgctcccaaagtgaaatttaaaaggctaacagcagggacacctggataactagaaaacttacctattgatatcacaggctgcttctccaaatggactgtatataatttcttgcaagcatagtaaaaatcctatacttgcttgaaatgaaatgaaggaaagcctatcatgaatttctttttctctgtgttaatgaaagacacgagcacaccatgataagcaggagagaatgacctagtgttcatccttctcttcttgtccaacgcaggtaactataggtgggctctgggtagagtatatgattgctgcatatttctaagaaataaagttaatttacaggctacctcaatcctgacactctaggggtaaggcaagcatgcatgtatgtatttctggtaatcaagagggagaaatagcagtgaaaaatagagcttggatatatatcttaaagacatgccactgatttcaaaatagggcaagagcacttatgatttaatataattttgttggaaaaagttaactctctccaaggaaatacagagcttagcaaataccttataaataatacaaaggcatactatagtgtttagtagaatcttattcacccattctgatttggacaaatgttaaatgagacaaacaggagaaaagtttattgattaggtaaccgattaaaattttggtgaaaagcagaagtagtaagttccagaaacaagaaataaatcatgtatatcaacaagaggaatgaaggcattttgtgcaatcctggggaatagattttcttaggtatttcataaaatcattgactctagggcaggaaaaaaccctacacacataaacccacagcattctttttcctgcctccacagttgtaaaggcccgatgataaaacctgtttcctaagacttccccagaatgtgattcaacacattttctatttttttaaaaaaaaatttctgccacttaatttcatgtgataattttccccaatgactaaccaaatatgcttcactattatataaatcaattctttcttaatgccacaagtgaaagtgcaaaggtagctaatggttttcttctcataaaaatcacactttggctttttcctttcatatgtaattaatcatatttgtgacaatcttccaaacttacttgaaatttttctgaatccctttcaaatcaggacaagaactagaaatgtctatacaggtttaatatgaagtaaagaaaatgtttttcattttcttgatttatttctgaattcagcttgctcttcattagcgctacatagctgmcttattattcgtggtcccctatgaccccctgatcattttccctgagggtgcatatttattcactaactatgttacaatcatgtgatctgctggattttttctgatagtctactctagatttgttctaaattaataaatcccattatttttggcttctactacttctatttattaaattcattctgaatatgaagtttattttcaaaggaattcataattctttactccrrgcttggttctaacaatgaatttaataagaattgtatttaatcaatgtttaaatatattaagggcaaattttgtaaaaatgttagtgttccaagctttccatttccccacaaattaatttttttagcctttccccttaatccactttcttaaaaaataaaattttttttgtgatgcagaattatgtgaacaataagaaaaaaataattagaaaggtaggagtaaactaaaaacaaacaaacaaacaaaaaaaaaaaccaaaaaactaaggctgcagacttaatagaactaccatagctacttaagggtaaatgattaagagagagacaacgtctggcttctgagcagagcacagagagaaagatcaccaggaagaaaaaagataacagggaattttaaggacagttgccatgtgtaatgcataaaatagttttcaaaattcttggagaggtaaaaataaaatttagatttattttttaattatttcacttgcgatgctatcttaagattgaaccacatggggccccagaatttatttaggttatacaaatatcctccaattctgatgctgattatttcatatgcagacttcagttacctttacatgtcataaacacacataccccagaaataaacttgatcatcccataaattttcaagagctctcagcctgctgtaaatgaaatttcaccattaactcacaggtcgatgtctgggacaacctcaaagactgcttgagtaattaataaatttatatgaaaacattggagtgaaaatgtctgtcagtgtcaaatacataagaggtaatggctgatacatagtaatgcagttttaaaccattggcaacatatctaaacaaaggtatcagagaaaaataaaagaaaaccttgtaacttgtatgataagcctcttgcataagattattaagaaagtcataagcacttacggctttattccttttctatatagatagattgcccagaaaaacgtggactgaacctcagctggaatctgagggctctgcttgtctttaacagcttagctacattgttagagagcaacactacataatacagcatgccctattcttaaggcaatacataaaattttaaaacctgaagctaaattaaaaggttatcacccttctgcctaatgtattatatatttgtaaatgatatctgtctctaaaaaagatgtaccacaaagcaagagcatatgtgaaacaataagagagaatgtaggagttagaaacacatttaggtatgtaggaaacacaaacttcaagacattcccaaggatctaaataacctatacacaaatatagcaaagtcatatcctaagggagaggatttgagttctaaagccggagcctaaggtaaatgttgcatatagtcaaacttaccattgaagatcactttaatcacctgtagggtgcaagttacattgctttgtgtattcaagactgacagtgaatatttgagaaaatcagttgagttagaataaagaaggaagcaaagaaaagtccacctacagatattagggtattcaaacaacctcttctttaagaaactagcaaatctccacctctgagtttttatcaggtaggtgatgaagtgcaaagctgtaaaccctccaacagggcttattccactgttttaatattcacatttcataacttggacatatgcattaatggatgtatttgtcattgttaagattaagtaacataatctttctttttttttttctttgagatggagtcttgctctgtcgcccagcctggagtgcagtggcatgatctcagctcactgcaacctccgcctcccaggttcaagcaattctcctgcctcaggctcccgagtagctgggattacaggtatgcaccacaaagcccagctaatttttgtatttttagtagaaacaaggtttcaccatattggccaggctggtcttgaactcctgacctcaggtgatccacccaccttggcctcccaaagtgccaggattaaaggcatgagccaatgagcctggctgataaccttatttcataagcaaaagcatcatccacagggtctggtccagagcagatactcaatagggtgctacattttaatctaactcttgtttcatcagacccacaaacacattgctctttaaaatcctgtagagaagaatatgacaacctgcaccttttctttccaagatggcatttccagttagggtacctctgaacagctgttgcttgcacattttaggcatggtgaagatctacacctgatgctgggttcctaagtgggcatatggtgaatccactgcacacagaagcacttctttatgcttggatcacattgcagaagattggacccctgactggggctacctttcccaagccttaacagcacatcaggctcaaatcacagggctatcaaatgaggagatccccttttccaaaaaaagcatccctatcaactctcccaggaaagcacatgaactcatgttatccattcattcttatcttggaaaatacacccacaagccccttttactgccacttacagtaggatgccacaaaaattcagaaactggaatccttttccgtcccttctcctttccttcctccctttcttcttttcttcttccttaccttgaaatttctgcctgtggtaaaaccacaggaagaaggaaagtcaaatgaattttcctattagtcgacatttctgtgatacactcattttttttggtccccgtatgaactccctccagggtatttctttatgggaataaagtatgccaaatgaaataaagaacttgaagcacaattttatccttgacatatgtagagagaatatgttactcctgaatttatggtgcaatgcaactcagtcacttccttttcctctttcccctagtttgcacttcctacttattgctgcataccatcacaaatttatggagtgccaatggctgtggcctctaggcagctcccaaatgactgaatccagacatcattgtcttcagttcccctttggcattagtctattttccatccctcttcctttattgaaatctgcttccaattatttttcataagatggtttagctttcttttatttcctttaagttgaaactcttttatttctacctttcatttctatgccctcctgggccttaagcacagttcttctacatttacaggggttttcatttagaaactattgagaactttactatcaaattgtactttttaagataatttttttgcaattttaactaaaaggagatttttagacttttggaaagtcatggctccaggtctcagatctcagctgtaggttttatcactttgcaagatgatgactagagttacagcacattctttcaacccatgcccaaaacttcaaagatggccacccttcaacccctgaagatttcaactcagtgttttcagaaaattggaggtccaggctttggagtcagacagatatgggttcaaatccagcctctggcacttaatttgaatacaacctagagtaagtcatttaactttcctgagctttgatttccttatctgaaaaataagaatatagatacttacctcaccatattgttataaagatgaaatgaggtaatctttgtaaaatatacacaatgtctagcaggtggtaagcattcaaactggtagctattttttattgttatgagttaaaattttgtatataatggattttttttccaagaaagctcatcaagctgaccttaagtagatgttactcccaaataccacccaattccatgtctacatacttgagaagttactaaacactttaaaattgaaattgaaaactagggacaaacatagatttgaaaccaaaggaataggtaatcagttataaatttggatataacattatgagcctctatttcagaaaatacattccttttaaagtatatttactatagttatccatgcagactgaatatttttatcaatagttgcaaaaccatttcctgaaagggaaaaccatgtaattataactagattttcacatgttaaccttttatataagggaagaacaagaagtagatatttgctaagagactgggaagaaagggaagagaagggagagagggagagacagagagaatgagaatgaaagcaaagaaatttgacaaggaatactatttggcttttggcccttccgtgtaccaacgtagatgtgtgattataccatttaggattgttgtcaattctttccataggaacagactgaacaatgagacatctacctctcaacccaaagagaataaaattgtcatttccctacaggacttttgttaatacaaaaatgaaatatatatatatatatatatataaaattattatgatttcaaaaataaagccaaatatctaaatgaaaccatgaaaataattagctccgatccaacagagtaagtgaggtttttactttggaagataagtaaattctttcagagcatgagaatgaaaaattgattgattccgatctgatctctaaaaagagcagtctgatttactttggtatcaaacagacctgcttctaaatgccatttctgccatttacctgttgggcaaatttcttacctatgcacttggagtcttcacccttaaaataggtatgaaaataggtagaaaataggcttgccatgctttctctctctctccctatatcccatgtctctccaaggagcaattcctaatgtaattgatcaaattcaagcatatggagtcttatttactaagtggcatggtcactatacaataaacgtgacttcccccacttctacttcttctcttctaagttgaaaaaactctaatctctcaggtcaggctaactatttccttccctctttcctgccttctttctaatttgaggcaatagcatccatgagcccaggcgatgtcagggattcttgtttttatctcaacactttcattcttccccatcccctcacaggcccccattcagaattcttaagcatgctatttgcttgagggggcatttaggaagtcccatttaagacctctgccagctctaatcttatctcttcagagaggccttcgctgactatccaatctaaagtacctacctttatcagtgttctacactggaaggtattgggcacaggtgcaactaataataaagtgggtggtactttgttgccatttccatgttagggcctttgtgtctgcacttctctctctctctctctctctctctctctctctctctctctctcatgctctgcatctttaaatcactaaggtctcagctctaatgttatctcttcagagaggccttccctgactatccagtctaaagcagactcctcattcccaccaactcactccattacattaatcttttattttgttaatagctctcattgcatcccattactttcttctttatttgcttgttgcccatccctacctccttcccaaacacacttattaaaacaccatgaagacaaaaaggtattgtgctcaccacttgtttatccagagccaggtgcctgtccaaagtagatgcacacctgccatgtcctatggccaaccaggtccaatgaattcctttataaagctcctctcctcagctgacccagaacaccagctgctatactgaaggctttcacactttcagatgaggtgtctttatcttataaatttcttttctctaagcagaatttatataacctactcattactttgaatagcatcttattcagtataccttattggtatttttcagtaaaccctggtataaggcacacagctaagtgaatgtccccacatacctataagagagtggctagatgcctttcttacccacagggatggtttcaaagaaaccttttacactcactcccatatacacacatacacaaaggaaagctcacatttgcattccagatcatctccaggaggagggaggagaaatactcttttaaaagagcaaacctaaaattataatgctcttgaaaacattagtagttaacatttactgttaagaaagccacaatcccagaccaaagatagctgagtggcatcttaaattgaagatagtttttaagtcagagcttagaaagtctcttggaaatctctttaattcccccacagaataaaatatggtacagattctcaggaggtccaatagaggctttcctctagcattagaacagatccttctttgatcaaggatcagatgaagtcattggtgtgaatttactaggcatatattttttcatatataacagaaaatgtcaacactggaatctcactcagcactaagatgctcacactaagaggttcaggaaaatgagaatgactcccagaacccatctcacattttctaagaggcatatattcattgaggggaacgtctaacagaatgacctatattatttacatcagtacttcctactctcacttttttggccaattctgtgtgattaaattggcaaaagttcaatgcacacaaggtgcaactcaattatatttaagatcactcatttatgtcataaagtctttctcaaaaaacaaaagatgccagccccacagaactttatcatgtcacatagaccccattaatgcagtctatcaacaatatagacagattattatattcagggaagttccctcaagaattgccttacaagttcaatttaaaaaatcaaaataaaacaagccagtactgagtctttctatggtatagttaaacttgtaatattttatacatattttttgaaagtagccttgatataaatcctgaaaaaagaaaaaaagcaaagtccacatttctataagtgtcacgatgataaattttatgtatcaacttgactgggccatgaggtgcccagatatttggtcgaactttattccgagtatggctgtgagggtgctttggacacacttttaatatttaaatcaacagatgcagtaaagcaattgccctccctaatgtgtgtggacttcatccaatcagctgaaggcttgattaggacaaaaaaaagctgaccctcatgcaagaaagaggaaactcctcttacctgatagtcttcagctgggacactgattgtgtcctgcctttggactctaactgaaacactggctcttcctgggtctcaagcctgttgatcattggacagaaactacaccattgggtctcctgggtccctagcttgccaatgccagatctggggacttgccagcctccatagtcacaagagccaacttctcataataaatctctttctatacatatggatacacacatcctactgattctgtttctctggagaaccctgactaatacaaatattaaacccaaataaaaacccaaatgcaagtattaaacccaaacccaaatccaaagatgaacaactttcttcatcagtctggcacctaactgcatgtctctttatgaagtatgtaatattttttcatgagctgccatatgtcattccatcactcgctctagaactcttttaggcacttaaaactttgtatattatattaaaatttaatgtatcaagaaaggatatagtgagaataaactgaaaagagtagttactaatgccaaatataaggcagtcttgaaaaaaagaaatattcctctgtaatctcagtactttgggaggccaaagtgggaaggctgcttgaaaccaggagtttgagacaagcctaagcagcatagtgagaccctatcccctaaaaatcaagattttttcaaaaaaagaaatattccattttttcagtaaaaatattaaacaaatttcaaaaggcagaatggacagcttatacatataaacatatagggatatgaaacacatagttaaatatctacctatactttttatttcattaatttaattggatacttaaaaacatgtactttactcaaattcttatgtgagcatctcaacacatggtttattcaaattctgatgtgagcatctccaccatataagagcctcctttttagccctccaactgagttttccagagttttccacaaaactccaactgagttttcttcccttggttcaaaacaggacactccttgaatcatgtatgatggtgtttctgaaagttgtctctgaaggcacaagtacctatttatataatattagcagctttttcttctaaataaaaatatttctttgaacaggtatatattttgatgtctatgatgtatttgtctcttgtattgctttttaaatagacttttcaaaatcgctgtttggaacaacatccaacagttggaattgtgaagtcatagcccctggaatcatgactaactgtgttcaatttccctgctcctcttttatggatcctagcagatgaccttcacgagcacccaaaacaaaccttgggtgaagccacttcagcccactgtgacttcctaaagcagtatttgaaaggacccaaatataaagcaaggtcgtctcttctgagggataataaattcagggggaagcaaacctcacctttgtatttgaggatatctggtgtattttagtgcaattctgcctttaagataaagtgccagctgacttaatggcagttgtgatctctgcttcatttcatcttttatctaatgatccgctagttagtaaacctgcaaatcctgaaagaaacataagtactctttttctttgcagtgtaatcaccaacaataaagctttatttttttgcattaacattcaactgcaatgtatttaaatgttccacatacacaaaaacacctgatttttcccaagatttgttaaacatagtccctttggtgtccttagtaacactgcaaagatgtcttcatgtaaaacttaatttgagtcctgattaccttactgtgaaaaaccgtaaacaccaaacaaaagtaagcataatatccaaatgcctaaaacataatacccaggttgaaggaagtgtaaatgttcagattcaccagtgggactagaatgtaaacttcttgggttgtggttcctccaaatcatctggccacctgggtatcatatcccacaagcatatggtaacactgatagagtaagctcaaagtgttccaacaccaggacatttcatggccacatcagaccaattgtatttttcacttcctctctttccctaacttttctcatacaaagcttcctacatttcctttggcacttagtaatacttaaatgcatcttcactgtcttattcagtgtttttagctttggaaggtgtatcacttgggattgctttcagatgcattaattgcaatctagctaaccaacagcccaacagtgatttaaacacagaaagctttcttttccggatatgcatgtgtgcatattttgttttgtttttcatgcaacaagatgtctgaaggtataatctgacactgagctggtatctcatggtgtcatgaatgccccagcctacttctattttttttttttttttcctctgctgtccttcagtgaggctttcactttcattgtcatagacggctgctggatctccaagtttgacacattctccctaggcaagaagagggggaaaggcaaaggggaaagaggatgccagccaagtcagtctctttctaaaagctttccagaaagttccatccagtgacttccacatacatctgcccagccacaaatgggtcatacagtctttcctaactgtaagagagtgtgggaagctggatatgagctgagcattgctgctccaaacaaaatcagatttctgttaggaaagaatggatgtaaagtggatcttaggaagggaacaaccaatgcctaccatacacaagtatttgtggtgagcagacatggctaagtgcctcttcctatctagggaggttcagggaattactcaagatctcttttgtgccagggaactagggagtcagtcatctcatttgctttcatttcctcatctctgaaatttcctactatggtattcctcttagaacaccatttagaagtgttatggttttctgttcttaatccaaatgtgacaaaatgtattctccttcttctctgataacaaaacccaaattctgacgggcagcatgtgcttagccttagataatgaataatgactggtctaacccaatcatggcgatactatgttcttttgccattgattggtattcagtagtaggcatgtgacctagatctaaccaatgagtggacatacactggggggactcatgaaagatttttcacctttggtaaaaagtcatagttgcaagaggagaaagccttttcttcatatgcctcttctttcctgttttagatgctgtcatgttaacgctttgtgcttagagctgtagaagccgtcttgtgaccatgaggcaatagccaaaagaggaaagagcctgagtatgaaagacactgggtcctttatgatattactgagttgccaaactaaccctgggatcctctacctcctgttttctcatagtaataaatatccctgtgatttcagcactatcactttaattttctgttacaggcagctgaaagcattcagaactcacatactatcttaacatcatcttccatgtgttatgggccaagagtatattcaagagtgactacaaaactacattcattgtcgtatccctgtgggactcccttaaagttctagtgttctgtagtgtactttccacagcctagaaggatatatgtttccctctctccagccctaaggaactcttaatttaagactgacaagatgaatgagttacaatgagggtgaatccaattcaaaagacgtaacaacaagcaagaaaagcaaagaaccttgtaaacacccatgttatggagtgtgagagtgtaagcttaaggaggcttttattttggggagaagatgcatcacctctgtttgaatgagagaaattaagttgtaattatgatggtgtttcagttaaattatttgatgtggaagacaaggagaccattcccaacatgttatttagcaaagaatatggaggagaggcagaagactgtgatggaaaacgttcagaggccatcaaccaaaatggtaatgcattcgaggcagataaagttgcttcttgctagacagaggtggggtgagccctgacatacgtcttcaaaattgcaaaaggcacagatctgggggggaaagggggttgattcaccaaatctcagaatagcagaatggcaataaccctactccaaggcttccagttttcctcagtttaactccttttgcatactgcagccaaagagattttttttaaaatgaagatcactcagactgtgtcctcttcctcttaatctccccaaaggaagaaaaaaacaatgatcaatggcaaatggcagttgcaatgaagcaacaccaagaacgagcttcgtgctcgggagagaacattgcatatcttcctgtggtttccagtgctctacacacttggggaaactcctttaagtaatgaaccacagaaatgacccctggaaatataatcttcaaagtgatcttttaaagatccaaatatttcctgttcccactctgcccagagatcttcagtggctcactactgcttccatgataagatcctaaaaccttgtcacaatccacaaggccttcattgtccatccctgcctgcctcactgtctttatctcccaccacactctgccttctctatgctcccacctgacaacttcttcagtgcgtggaccctattgtactctctcaggcctcaaaaccatgtaacatcctggacttcctcttcactggtctaatgcctactcatacttggcttctgagattgtacttcactccacatggagattatccacaaccatgccccactccaaaaccaggttaccttcccaatgtgatatacttgccatagcactcagcttccttttttataatactcatcacacttgtgattgattgactctcttctcctttacattgtaagatccataaaggcaaggatcatgtctgtctctttctgatgtgtaacaagcctgaacatacatacaataaatggccaggtgtaatttaccattgtgtggatgccatcttgggaggggggattctaatagttcaagggcatgtatgaaaaacagactcatggtaaaataataagaatagaaaaaagttactcagagtggtttaatggctggggtataccttttactattttacttagacatcaaaggaaaatcagtgtcctccctatcatgttccatgattttgtacaactgagtttagagcacaagctaaggtatcagacagcatttgacagcccagcttcactacttatcagctgtgtgaggtgatataatccctctaatccctataaaccttagtttcctcatctttaaaatggggataatgacaaaagcttttcaataagggtttgtgaggattaaattagataatacatggaaagctttcatcccagtgcttgccacagagttagcatgcaataaatgttataaagagttctttattgttctgcccatcaacatctgagacagaatataaacacaactgctcctgggcctggtggctcatgcctgtaatcccaactttgggatgccaaagtgggaggatcacttcaggccaggagttcaagaccagcctgggcaacaaagcaagactccatctctacaaaaaatgaaaaaataggtggatatggtgatgtatgcctgtagttctagttacttgggaggctgaggcaggaggatcaactgagcccaggagttcaaggctgcagtgagccataatcatgcctctacactccagcctgggctttttaagattccatctcttaaaaggaaaaataaatcaactggatcactagcctataagagcttaacaattgttaggtagtattactatgggtgttattgttttgttatttgtggcaaaaagtactagtgctcacctgagcacatgacttccttatgatcaggtaggtccatgtttgtcttggtcactactccagcccagtgcctagcacagtgcttgacacatggtgtgtatgcaatgaacacttaatgagtacttaaagatctaaccagtatgatagtgcagattctcttgtaagcaaatgaatagagaaaggcagtattccacagagaaggagacaggaaaaaagaacaggcttgattttactaaaaagaaaaacacacttttaagcagtaaaattagaagttcccatttcaatggcacaaaatagagaactcactgagaattgtgtgctataacatggtcaaagcagaggccgataatgaagggagcagcattcagaaccatcacatgtatggtcagctttcagaccctgaaaactcgattaaaacattccaggaaaccgctgcactttcattctaaaggaagattgtgaactctgttcacatattacaccccttcatattgctttgtctaccagtgtggccttttatgaagtgagggcttctttcttctaccttgctccatgacaatcaaacccaaaatgccttccacccttaaaaggaagttttggtaagtgccttattataactatcacatatgacacaaggctcaccactaatcggagacagatgagaatgaattacttaaataggacagaaatagccattcacttcaagaaggtcccagtttcttgaaagtctgtggcattgagaccatttacagtttgctgtcaagattcctagcagtgctcattaccttggctagcaatccctctggactacagaaaacttatctgaaatatatataatcacaggctgcaatgcctaagtgcaacaggatgatttaaaaagcaccatgatagtgttcccccaggacattcatctctccctgtctattcatctttgatccagacaaaaacttggaatgcaatctgtatattgatattccctaaaaaggatttcaccagctctttaggaagaattgttttagcggctctggaagtctagaacattctgcatttgtggtatttacagcttttgtttctatttcataaaaataaagccccactaagagcagtattcaattcctatcccaataggagtatcgaatagtggttaagcacatgttttttggaacgaagcagacctgtgttcatctctgggctcctcatagacctcttcataaacttaggcaaggtattcaacctttttgagtctcagctatatcaggtaaattactatgcgtgcacagaagagcttaataaatgttagatgttaatggtattaatattgttttgctgctgttttcagtttttctagcagagattattagtattcacccatgtgcacaggtagaccgcatttccacccatgcacacaggtagaccgcatttccaagcttcagtggagttacgtgggtccaaatgactgagttccgatcaatggaatgtggcagaagtgatgtacaccctttcctggatgggcctacagaaatcctctagactctactcctcactctccttttcccttctcaggcaccctgaaggctacttgttaaagaatttagagctacaggatggaaagaacctggatcctacctaagaacctcctaggagagccacccttcagaaacatttgcagtggattctgaatacgatttttttttttttttttttttttttttttttttttttttgccgagcacggtggctcatgcctgtaatcccagccctttgggaagctgaggtgggtggatcacttgaggtcaggagctcaagaccagcctggccaacatggtgaaaccctgtctctactaaaactacaaaaattagccaggtgtggtggcacgtgcctgtaatcccagctactggggagactgaggtaggagaattgcttgaacctgggaggcggaggttccagtgagccgagattgtgccattgcactccagcctggtgaagaagtgggactacatctcaaaaaaacaaaaagatacatatatatgatatatctgatatatgatatatatatgatatatctgatatatgatatataaatgatatatctgatatatatacatatggtatatatgatatacatcatatgtatatatggtatacatgagatacatcatatgtatatatggtatacatgagatacatcatatgtatatatggtatacatgagatacatcatatgtatacatgagatacatcatatgtatacatgagatacatcatatgtatacatgagatacatcatatgtatacatgagatacatcatatgtatacatgacatacatcatatgtatacatgacatacatcatatgtatatatgacatacatcatatgtatatatgatacatatatatcatgtatatatgatacatatgtacatatatatgtatatatgatacatatgtatcatatatatcaggtatatatgatacatatgtatcatatatatcaggtatatatgatacatatgtatcatatatcaggtatatatgatacatatgtatcatatatcaggtatatatgatacatatgtacatatatatcaggtatatatgatacatatgtacatatatcaggtatatatgtacatatgtacatatatatcaggtatatatgtacatatgtacatatatatcaggtatatatgtacatatgttcatatatatcaggtatatatgatacatatgtatcatatatcaggtatatatgatacatatgtacatatatatcaggtatatatgatacatatgtacatatatcaggtatatatgaacatatgtacatatatatcatgtatatatgaacatatatacgtatatatcatgtatatatgatacatatatacgtatatatcatgtatatatgatacatatatacgtatatatcatgtatatatgatacatatatacgtatatatccatatatatgatacatatatacgtatatcatgtatatatgacgtacgtcatatatatcatgtgtatatatgatgtacgtcatatatatcagatatcatatatacacatatatcctatatgtgtatatatgatatatgtatatatgatctatatacatatatatcatatgttctatgatatatatgatatatatcatatatgatatatatgatatatatgatatatatgatatatcatatcatatatgatacatatgatatatcatatcatatatctttcttttttttttcagttaagctactgggttttgacgaagctcattacagcagttagcctacttcagggtttctcagcctgggcactactgatattttggactacagaattctttgttatggagggctgtcctatgcattgtagggtgttgagcagcatccctggcctctatcctgctagatgccagtagtaacctctccagtagccatgacaaccaaaaatgtctcctgacattgccaaatgtcacctgcaaaatcgcctccgattgagaaccagcagcccacactggccaaaacatcaccatcattgctatcatcatcatcataggatattgatagtctagtctctcatgttccccttgaaatcactgcaaaaggactcaaagttccaaaagaggtccagcccagtttttttaggagaaaaaagtgaaatgacactaaaatttaagaaaaggtaagggatcaagcagtaaactcaaagttataggagaccaaaaaacaaagtaagaaccaaaataaatataatccttttttaaaaaagctagtttgtgtagtcccagctactagggaggctgaggcaggagaatggcgtgaacccgtgaggtggagcttgcagtgagctgagatcgcgccactgcactgggcaacagaccaagactcggtctcaaaaaaaaaaaaaaaaaggccggtttgatcactttggtaacctagaataaaatgattaaaacaaaaacaaacccaaatatctgggtctaggaatttcaatgtgtctaacaaatgcttatagaatatctaccatgagataagcattgggctgaatataacttggtaaataaaacagatataatccctgccctcatagagatgaaaggtaaataaaaatatggagttttttgtttttgtttttgtttttgttttttaagacagtgtcttgttctattgcccaggctggagtgcggcagtgagatcatagttcactgcagccttgaactcctgggctcaagtgatcatccgtactagctaggactataggtttgcaccaccatgcccagctaatttttgtattttttttatagagacgcggtctcactttgttgcccaggctggtctcaaactcctggcctcaaggaattctcttgcctaggcctcccaaagtgcttgggattacagtcatgggccattgcacccagccaaaatatgatggatttttcaaacagcttaaacacagtcatgaattgaccactgcaataggcagacttctaaagatgtccctgcaggattcccatccctgggccgggcatggtggctcacgcctgtaataccagcactttgggaggctgaggcaggtgggtcacttgaggtcagaagttgaagaccagcctggccaatatggtgaaaccccctgtctctactaaaaatacaaaacttagccaggcatggtggtgagtgcctgtaatcccagctacttgggaggctaaggcagcagaattgcttgaacccgggaggcagaggttgcagtgagccaagactgcaccattgcactccagcttgggcgacagagtgaaactccctctcaaaaaaaaaaaaaaaaagattcctgtccctggttatccaattaaacactagattaggtgctgccatgaagagacttagcagatgtatcaaggttactagtcaaccgactttaacataggaaggttatcttgaattatctgggtatgcctaccctagtcacatgaggttgtaaaaacataagtggaaggtggaagaatcagtcagagtgagaaagcagaagaggatgcaggagctatgctgcagagggaaagtcagattccaaacacaagaaagaaaaagataagatgaatcattgatggttctaaaatgtaggaggctctgtgtgaggaccagaaagaggcctgagggagctaagggtggagccctgcctaacagacataaagaaaatagggacttcagtcctacaaccacaaagaaccaaattctgtcaataacctgaacgagtttggaagttggtttttctgcagtctccagtaagaaacacagcgctgctgatacctcgattttagcccagtgagacatgtattgggcttctgactgccagataataaatgtgtgttgttttaagtcactaaattcatcatagtttgttatgacagtaatagaagactaataaaccattatgcattaaatatcacagaaaagaaagggtttaagaaaataggtattaaagtatgccttatcaccttatcattcatcaatctgaggtttactaaacacttgatgggtgctcattagtggaataaattaatgcactcatattttcattcatttgttaaaaatatgcatacagtgcctcctctttgatggtccctgggtgaggtattgaggttacagtagtgaaataggtattatcctctgtttataacagctcataatggaagtggaggacagaaacatgtacattcaacaataatgcaaagaacataataaagatattaacatcatcattataaaactatcagtaaaagtgtgaataagggagtacagaataataattacagctgacatctattgagtacttgtctcatttcccttcacaacaagcctatgagactgtattagtccattttcatactgctatgaagaaatacccgagatgggataatttataaagaaaaagaagtttaatggactcacagttccacatggctgagaagacctcataatcatggcagaaggtgaaggaggagcaaaggtacatctcatatggtggcaggcaagagagcatgtgaagaagaattgccctttataaaaccatcagatctcatgagacttaatcacgagaacagcatgggaaaaacctgcccccatgattcaattacctcctacccactgggtccctcccatgacatgtggggattatggtaggtacaattcaagatgagatttgggtggggacacagccaaaccatagcagagacagacccatgattcataccatcttgcagattaagaagctgaggtacaggcaggtgaagaaaccagcctaaagttactatcggtaagtggtggagctggaattttaacacaggaggtccaactttagagcccatggttttaaacacttcattgtgctgtctctcattgcagaagggtgaggaggcctcacagaagggctgagatttgggatgaataccttcatcaagaaaaggaggagccagtagaagaaactgcattggtaaagccagagattcaggaagaaggtggatggtgtggcatattctggaacagggctctgtattggcaaggaggggtggcagatgaggttggagcctaagttgtcctgacttgaaagacttgaacctctcagcagtttgaatttcgttctaaagctatcaaaagaacctattcaagagcatgatacggtaaatcatcttcagcaactcacatatcatttttaacattgtttcaggggatattagtggacactcttaggaacgcagtgtatagcccacaagtataatgacacttattaatacaacttagaaaacaccctttgaaaatgcatcaaaaccctaaaagattcgattaactctatggaaatgaggataaagggtagatgcatgtaagaatccagctgtcttctatctacaaagctcttcatatccacaaccacagagacactgctcagcttctgaatcgccttagttcacaataaaatagaaataaatcataataaaataaaatagggaataaatctatctgttggctttgagaaaatttctcagtagcaacaaaccaactgctcaaatcagaatcccccaaaataaataaataaggtacctaagagggaatgcatgtgttgaccaaaaaactaaaaaattctcccatttctgtctgacgttgaaaaaaatcataggtatttggcattttagcctatgctgttgaatgtggtagccactaattatatgtggctatttaaatttaaataaggtaaaattaaataaaatttattttctcagtcccattagccccatttcaagtcctcaacagccatatgaggccactggccactgtactggtcagcacatgtatcagacatgtccattgttgcaggaatatctgttgggaaaaaaatgaactacttatttagataaaagtagtgatttgttagacatgcctaataaaattcagtttattttaagattatgtaattaaattcagacttacttataagagtctgaattttcattttaatcgtttgtatgtatttcattcctcttagtatgaagagagtctatatcaagagactctctatggagacaggagccagtttgtattaggccccagctctgtcttgggctctgtgctaggcatttcatatctgttatgctacttaaggctcatgactccctgtgagataggcatgcttattctcatttttccctaaatggggggctgtgacaaggctgaagcaaagagagggcacaacatcttttcagggttaacacttgagaaacatctatttcttcttaagtagctctactgctgcttagagaagtagagtatgtagacaagacagttaaattttccacagatggggtttacttagagggagataagatttcttttgcacacaattgtagatttttttttaaatggtcaaaatcctcctgttctagcagtagctaagaagtgactcggggaagcattcaacaagtaggaaagaagtctgctcagatggaggccctgaatcagagatgcctgtcatctgttcccaaaggctccaaactcctgccacaaatacactgagggttcctctctctataacttcttctctttattttctctggaaggaatgtacttgatacttatttttaatctgagtctccttccacaaaaagtgtagaggatgtgctacccagcccctaaagttttgcctcttggtattcacacttgtgaagtcattttccatgtggaagagggctgacctgtgtaagcaataagatgctgcagaaatgtatgacttctgtggctaggttagaagagccatgagtccttaaagctttcccccttttctctctcttgagtggctgtctctggaggaagccagtcaccattctatgaagttactcaagcagccagtggagaggcccacatggggaggaactgaggcctcccaccaatactctccatcaagctgccaggcatgtggtaccttagaagtggatcttacagccccagtcaagccttcagatgactatagagccagaaccactctactaagcctgtcccaaattcctaactcaccaaaataacatgagatagtaaatgtttactgcagttttaagcagttgagttttggcataatttgttatgcagcaataggtacctaacccagagggtttttccagctttgcctatgggcaagtctacagatgaaacaagctgcttttcatatttagtgctctctctcacaattatcaggagatataattatcttaccatccaggctgtgattcttgcacacaagcaccaagtcatccattattgcagtctcccttcccatgcttgatgaataactgggttcctgtgatttttcctcttttctttccccattgactgttgaaattgtttgcctcaactattgagtcccttctcttcagtttgcctccttttcttttcctcctacatgagcagaagccaggaaattgaatgtattcgatcacaaagtatgcatgaccctcagcaacatgagcctacaatagtctttttaatgaccagaggaaggttgtgaggactcttagttaatttgttatgaacacccactcccataaggaagctgctatgtatttgtggaataaattaaataaaatcagcaaatttgcttattatctatttcctgccctttgaacacaggtttacccataaactacatttgttacacactaactgaatatggaaagcactatgggtaatgcaaaaaatatagcttgtctgttttcagtgtactcataagcaaatataggagacatcacaaagatgcaaatatgtattcatattcacatacatgcttaagtagacatttacatatcaaagacagtgaaggctaagggccaaatgaatggtacacacaagtgttaacagatcttcaaaagaagatgttatggctgtgagctgaattgatcagggcagcctttatgcaggaacaaagtcttcagaaggtttaactatggcagatactattacagatactacttgtttcatccagttctcctttagccccaagcatagagactcctgcacatctcagcctcttatgagtgggcaggatcatgtgactagctctacttagtggggcacgagaaaaagtaacatgtttcatttcttaagtcaaagaaaaaactatgtttaattctccaatctttctcccccaaaagttcacatgctctggggtaactagaggatgttagtggctccctcagcctgggtctatctgaatgactacaataagcagagccccctgacaactttttttgggcatgtaccattagcaagaactaaacctttctttgtgataggccactgtgatctggggactcatttgttactgcagcataacttagtctctcctaactaaaacagagattcccaaagatggagaaaagcagagcacagtagaggtagcttataagtcatgtcttatatgacctttctcaatgacaaacctgtgtgctcaccaagacatagcttgttatgacatatctgaatagaattgaaggtttttaaataaaaacataagaaggttggaaaggcagcagaatgagctactgcctgtgggtgatctttacacatctcagaataacaggattattgatgccttggccagaagcattcctttccctctgttttctttttctttgagattgcaagccatatatttccatttggaaaacagtatttcataacctctaaacctaacatgagtcctgtgaaaccctagtctacagttgaatggccaaaaataaagacttgaaattccttcaaagctatcccattttacaaggcaatgctttctctctctaccaagaaagtgttcctgcttgatagattcccctctcttgctgtatattacacttactgctctcctgtcactccctattctcttcctagttgtttgtgccttattaaattccacattttgaaacaaccaataagaatcagaaagcctgaagaagccctttctcatacaatcagagctccctttttatctaggaataaattatattttccaatcaattcatgagtgggattcattgacaatatactctctttgtaacatatttctgaatgagtagtaaatggtcttcaataaggatatggcgatacattttagctaaactgtttcataccgacattaactcccctgttaacttacttaggagtctaaagacacaatcaaatagctgtttctgactattattctcaaagcgaagctccaggccgtaatctcaggacatgcatgaaaatatcaagtaacaactcaaaggcccatttcagcttcaaatacctttgaaaattcgtgagtttgaggagcagagtgggatagcaggcgagtggaagaggaggcttctgagaaacttaattatctacattttagaatgtttcagtctttggccttttaatactgtagtatagcctggcttctgtcattctgaagggatttcccagcttaacaaaatcccaaggaaccaacctcagattggtctcttacctaaggaaagattctggcaacacaacaggaaggatttggaaaatttaatgaagattttgaaatacccctaacacacttaaattaaagataatacctatttcacccaaatctcctaaccccctgtggaagatcaattctaatttttgaggacaattattcatgtgttattggcttgaagtacagaatgtattagtaagtctcttcagttctaagtaacagaaaccaaatcaggctaggttaaaattgaaggggcatcattagaaggacccaagagtgtctcaaggactcagaggcaaagatgcagccagttccccccagtgccgggaaccagaaggtgggcaggaactcagggaatacagcccccttctatctctgcttctcaattctcatagggaaatatggttgtccacagatctcaggtttacctgtcatagttctagccacatgcaaggaatgactgcatatctctgaattccaaatttcagaaagtgagaccttggggtgggagatggggcacgcttggattcggtgtctaactctaattcaaacaacttttgccacggagccatgtagtagccaaatatgtttctaaggcccaagggaccactcttacaaagatggaagatagttcactaaaaagaagacatgctttctagactccacagccaccccagaagtgccaagataaataatagggagccagagtttaagcaagggccaccatcactgcaagttgtctcatccaacttctccctttataggaattgacatgacttcaaatattcatgtctgacaccaacgaagaggaatgtctgttcttgagctctttttctcggttcccaaggggccctcagtaccctgctttaccatttagtgtggattctgacaaaagaacaaattaagtactttgatttgattcttaatttttccttataaagacttgcaataaatattgtgggtacctagaaataatccaccatagtgcacaacacaatctgttgacttaccttagcttccattttccttcttggtctgacatataaattcaccttgctgctcaattctgtcacctactattttcagcatgtatgagcaacagtaaagtgcatgcccacagaactcagaaatgagaaaactaatattgctctgttatatgcataatggatcaatacagaggtatttaaacacacaaagaaaaaaaaaaacaggtcagcaagacttgactttcaactgatagagaatattaacatgtttatgggtagaaaaagtggtcagttgtagaaaaatatacaaagaaaagctacaaagagatgttggcagtggccatttaagctctgtctagggaaaggaagcctttagttaatggccttcaagtattctaatgtagggacacggcacccctactgtggaaagagatgcaggaggtggaaggtagctaaggccttggagtttcagttccacaggcaaggctatccttatcatgagaactgagcagcatgaagctatctgtagtctgacagtcatattgtatgttgtgtcaaatgaaaacatagcatcactcaattccttttgttctcttctcttgctaaacacacaactatctgatgctctggcttcccatggacctcaggcctgcttagaggatggaatgcaatagtcccactagtctgtgcagtgggccaactgctggttgtaaaatcacaaaggggccttctaggttaccgcgtctcacaaacttgggtaatgtaattccgtcttgaagagagagtcccccatgggtaagaccatggaccatggtaaatgagtgtaccccaggagaactgcttgggaaatagtcacttagcctattctcctggtgatgccccagacattgtcaacatggaccccttggagcatttcctcgttgatgtctacatttgttaccttactcttaattaaattttctaaaaagatggcacaataggagcactgagaacatgatttttaggaagaaaaggaatcccatgtaaacccgtttccatctgtggttcttgcctttctgtccttatccatagggcagctcattcttgcatatctgcagctcttgcatgcctgccattttgtatcttcctttttctcgttatatcagaagcattataataagttacattagaacccgttttgcatattttaacattgccttcacagtgaaactatagagagctttatggtggcactctagtgaatattctgttctgcttctgttacatgactaccttaggaaaagtctccgagaactcctgtctcccatgattatctctcctaatcaggctttctactatcaaactactcagcaaaaggaactcaccaacctatagtgctaccagaagtctaataacataacactgtcaccacaactttttcagcactaaacatgatcatttttaaaaatagtaagtttattaggtatataatgatactttccaagttccagcctgtttataaaggactctgtataaataaggaaggggcccaggaatggtgacatatttaacgtgtaagtcaggatgctaaatgtctgactgtatttgtttatttttttctgaaatggagtcttgctctgtcacttaagctagagtgcaatggcacaatcatggctcaatgtagccttgacctcccatgctcaagtgatcctcccacctcagcctcctgagtagctagaactataggcacacaccaccatacccagattttttattttttgaatgtatttatttatttatttatttattttttgtagagacgaggtcttgctttgttgcccaggttggtcttgaacttctggactcaaatgatcctcctgcctcagtctcccaaaggattgaaattacaagtgtgagccactgtgcccagctcctattatatttttaaaaggaatatactgaggaaaatacaaatggagttcaactgataaaaagaaacctctgtaatatgagcaggtgaatacaatttacaagatcatacttcagtatgaattcagtaggaattgcatgttttgcctgctgtgtgtccctaagggtgacacactcctgaatgggactttagtttgccataagcctgctttgttttgtttgtggtagaaattccatgctatgaggaaatgctttcatttcttttgatatctcatgagcgcttgttgcaaaaaacatttgtaggcaaacagcttcacacatattaaaaacttgtagcagaaagttaattccctaacataagttgtccagctcagggctctataatcctgtaattcattttggttccaataaatacgtactttctgtgagaccctttggggaaagggtaattagatatttcacatcagtgggatatctttccttcttttgctccccctccttctttccttctccttttcttctctttaattcttctacccagaaaaattctcaaggagcaaaaatacattactctctgcatttttataagctggccagttttgcttcctggcttttgaacagaaaattatgcctcaaaaataatcccacattattctctaaattcattttcctcagtcattagcccataacggcaattttccttttgaaaataaagaataatgatcatttattgagacaaatcctcaatcagaatgattcaaagagaatacaaatttaatgatcaccctgagaacccaagtaatacatctcaggaaataataataaaatttatgatggccttaaaattgcttaactcctttcaggaaaccctgaattatagggtagtaacataaccaaggactggcaacaactcacaaaagtctagaagagttttgcctttgagttcatagacaaagatgcttaaattgttccccgttcaaaaaataaagattatttattatttactttcctgtgcaccggacactcctgcaacatgactataactcttgcgttcttagatttgatcttcaaggtctctgaatgatgaaaaaacttgtagggtagcatgccaaccaacttgggttttttgtctgtttttgtttttggaggaggggaacaaggcagggagagagggagagggagagagagagagagagagagagtgagagatcacactaccaggagcttcataaagaaacctgcaatgcagaaccaaagtggatgaaagcaaaaggatacaacttttccctccagatgattttactgggaggaagaaagatttgaaactattgagtgctttttctgataaccacctatggctctctccaaagacacacatgtaaagttgggcaagttgttttctgtcatgtcaggaaaatatttagtagcagtcttacaaaagtaagcactcagcgccgtcccagggagctgtggatttgctgtgcagccttgtttccttcaacaggttcctttgttgctttgtgtgttctcccgacaaagggcctgcccttcttctacagatgggtttaccattctctctgaatgaagactattcagaagtacacaaaccaacaaaccatccaagctgcctctatctgatggtcctggtatatccagagtactaaatagtggcctacaggatgggaaattcacactgactgactccacaggagactgagaaagcttaactggctgatagctgtaaagtcctttgaaggaacaagcactgtttaaaattctaagtagtaatcttataatttgctaatggaaagaaatataacccagctaatgtgtgcctcccatttcagagagtatgtttcaacagcaaagccctttacaatatttagataaacttcgatgtatagaaagtgcaacagcaaggtaaacagcagggcttcccgctatggcattttaaaatgtggtgggtgaaatttgtcactcctaagcaagtgcctatagtaaaaataaaatatcactatttatatggtatgtgttaaaaattgtccactctccccaactacaccagatcaaaacctcttgttttttaaattatgaaattattgaactgtattgagcacacccctacttatgagttgtgtaacctggggcatgatattgaacccctctgagtcatttcctcatctatctagacaaggctaatggtaatacctacattgtagggctgtcgttagaattttaaaataatttaataaaataaaggctagtatttattaaactctaaatacatgtttgctgctatcagcagcagcagcatcggtcggcaatcacgccaacactcctcaaagaaaacagttctgaaaaggctgtgtgcatcctaggtctgaagattttcttggtctaaagagtctcttgggctagtgaccaaatccttcattaatttcaagagctctgggaactctctgaaactgaatgtggaatggtataactactggtctgtgcacatttttctagaaaacctcacatctttcatcacattaagaggttaagaatcattgccatatgtagtcattagcttacctttatctactttctacttctaacggagaactagagtcctgtttagaacaagtaaccaggacagggacagaagaaggagactatgcatctgtcactcttgctgattagtctccaccctctcccagcttctgcgggcctcctctcccaagagttgcgatcctagacccacctcccatctgcagtctcaacctatcctcttctaaggactaatcatggcatatggcaggagagatttaagactagctaggtcaatgctctaagctcaacatcaagtcacctctgaggcagggtgttgtcatggaatgatcatgacctctgaaataggaaggtctgtgtttgatttggcttgaccacttactggacgtgtgaccttggaaacgtttacttaatcatgtcttttgtcacctataaaataaatacaataagatttacattgtgagtctatgagagagaaatgagataatatagagaatatttttaaaatgggagcatatgtcaggcaacagtagatgctcagcaatgttcttttcttacctgggcttcaacctggcacccttggtcaccttcccaggacccaaatccctctaggaataaactctggcccttgctggcttctttattcttcctcccacctacatacttgaacccatccaaagaaataggtctgactaccttggaaaccttttctgatgcttactacttgtccaacattcatttttctgtaccatgtgtgtagatactggattccccatcctagaattctacccacctcttgggctaccctgttacaatgtgtgactgactatcctactcccactttccaagttaaccacttaattgaatggctgcccatcaacatactccttaaatgccaagttagttctgtcaaacccaatccacagacaagccttatcctcaaaccttttctgccctctgccacagtgctaactggttcattgtgcttgttcagcatgcagggacctttaatttaatgggcctctcccatttttcacatatcatgaaagttatcaaatttaggttaattaagtttaagacatccatagttattcgagtgaaaacttgaaggcagcataatggataataatggtaaaatgataatttttgagctcttagtagatgccaggcatagtcctaagcagtttaaatatatttttttcatatgattttcataacaatcctacatagtagattatgatcattatctctactttataggtgaggaaactgagacttagagaagttaagcaaatggccaaaagttatgcaggtagtaagtagcagacatagaattgagaagacagcccccattctaaataagtatgaaaaatttcagggtgtcaatttttagctaaggaaaacttattcatgtgtgtgtgtgtgtgtgtgtgtgtgtgtgtgtgtgtgtgtaaatgaatagatattcatttacttatatatctatttcccaggcctcaatgcaatcagagatctctgaagaagtgaccatattatgaacataaatttttgacttcataactttacagtgataaataacctcaggttatcaggatcctaaccttaaaccacctgagattttatcactgttcctttagtaagcaagggatttttcaaccctgagacagataaaaaatagattgtatggtcaatgaaatccattatattcatactttttggttgagtttaggtaatggaacaatctgagaattttgtatcaagtatttgtgatgtttaagaggatttatcatatttaagaatctgacagattgcccctgcaattagaagtacaattgattactgacttctaattttaggttaaaaagtttaacagaatttgatgtttttaagtagtactgagatgtttaaataactgaatttattctttatgagtctagtatatttgattcaaaacatggcttcaaagcttagaaaggttttgcttgttaaggttgtgagcttgtactgccaagtattcgaagtgtttacaaagaaagtaaaattgttaaatgtgtaaagttattttaaaatattgatgaatacatttaacaagtaaatacaaaagtgtatttaagtagacattattcttttatggcattcataaattcataaattgcacaagataacctgagttgctctaaatgcttttcaaacttaagtttaggggagcaacatcagcaagatggctcactagaaactccagcactcatcccttccacagtgacagccaaaacaatgaataaacaactacactttaatgtacataactgaaggagagtgctagaatacatcaaaggagtaacagaaaccctggtgagcacagaaactcaggacagccacaaagagaatggaaggaaacatcacaactccaccaccctatccccagctgagatgagccagaaacccagaggaaactttccctataggaaaaaggcaagcaagaggattccagtagcctccaccaacaccttggacacccacagtcctcactactggagtccttgtagtcttcactggcactaagtccagctgagggagctgcctacaggccacacagccacactcacctcagagaaggaactaatactgtgctctattccctgtagcccacatggcaactgtgctatatcatcttagaactggaactactgctgaagtgtgattttctctgagggtgagcaggcttgacacccctgcctccataaggctaagctgcctccaaaccaccccaaaccagtggccacagccaagctgccagcagctgttaatgcctttccccatggagccaaacagtgaaaactgctctacctgccctccctcaccttcacctgccctctcccttcacctgccctcttgtgctagagatgaagcaatacattccctcctggggaaacagtgctttggcagaacagctccatctgcttctctccgctgcaactgtacactgcttctaggggtctgagccaaaatggcacagtatctcccaaggaaatagtgctttggtaggaccctgtatcccaggtaaatggtgcctgggccacacagaacagtcatgcctgagttaaagtgtcacattgccccttggggaatcattgccttggtcaagttaaacaactgtgcatcccagggctgagctgatgtagtatcttgtgtcccaaggaaacagagtagaacatgacctaagacagtctaccctactggacaatctagtaccctgctttcctgaagctggactagcccactagagtctgaactgctaagacctgctgtttcctggggagtggactcatcactgtgctactccctgccctccaggacccaaacaatacccatgctcagtcattctagggtacttgctgccactgcgcctggccacatggagtctgggatacagatatgccccaccattccaaggtctaaatttaccactacatagttcttcattctcagggacctaagctgccactgaaccctattggcttaggctcctaaattatagctgtaccatgcatgctgtgctcaaacccctaaaactctgcttctttcccagagctgagccagggctgtatcctattccccaggggtagaatcacagctacaacctgacccactgaatcaaagctggtaggggctgcctaacagtcatagattctggctctgtgggaaacctatatttgacccagctacagagagtgaacctgtaccccaggacccaagagccacaataggcttgtgaaactctgatattagcaccctgactccatagccacttcaagtaccaatccctggaactcaaagcaatggaactgcttgtaggccatgtaagagggatcctcttgtttaattatccccattgtgaggaaaatcagaataggaggaccccaaaagccctgccactgaggacattaacaacctatgttgtcactgccactaccatacccctttttttttaattatactttaagttttagggtacatgtgcacaatgtgcaggtttattacatatgtatacatgtgccatgttactgtgcggcacccattaactcgtcatttacattaggtatatctcctaatgctatccctccccctgcccccaccccacaacaggccccggtgtgtgatgttccccttcctgtgtccatgtgttctcattgttcaattcccacctatgagtgagaacacgcggtgtttggttttttgtccttgcaataatttgctgagaatgatggtttccagcttcatccatgcccctacaaaggacatgaactcatccttttttatggctgcatagtattccatggtgtatatgtgtcacattttcttaatccagtctatcattgttggatatatgggttggttccaagtctttgatattgtgaatagtgccgcaataaacatacatgtgcatgtgtctttatagcagcatgatttataatcctttgagtatatacccagtaatgggatggctgggtcaaatggtatttctaactctagatccctgaggaattgccacactgacttccacaatggttgaactagtttacattcccaccaacagtgtaaaagtgttcctatttctccacatcctctccagcacctgttgtttcctgactttttaatgatcgccattctaactggtgtaagatggtatctcattgtggttttgatttgcatttctctgatggccagtgatgatgagcaccaccatacacttttacagcctaagtcattcaggcatccacagttactgttgacactgaatgcagctgaagaaactgcatagatactataccactgaacctacctggaaacaaagtcaccacacttttcctaattagcacactaagatccaactacaggtgaaagtctttctctgcaaaagccactctagaaagtctggaagaggcaatttttccaccaaatgcatagacattgatgtagaaacacaagaaatatgaaaaagcaaagaaatatgtcaatgccaaaggaacaaaataactccctagtaacaaaccctaatgacaagaaaatcaatgaattgccagaaaaggaatacaaactagtactcttaagaaactcaacaagatacaagaaaatacagatagacaattcaacaaaatcagaaaaagaatttattatataaattagaaattcaacagagatagatattataaaaaataattcaattaataaaataaaaaatacaataggcagcttcaagaacagacttaagtatagaaaacaatctctgaacctaaaaataggttatttaaaattacttagctagagagaaaaaaaaataagaaagaaaaagagtttttaaaaaagactacaagacttataggacaccattaagtgaacaaattttcatattatggcagttccagaaggaaaagatgtattaaaaaaaaaacctaatttaattatctaatagctgaaaatttcacaagtctggatagagatgtgtatatacagatccaggaaactcaaaggttcccgaatagattcaagccctgatgcacattatagttcaattgtcaaagtcaaagacaaagcaagaattctaaaaacaacaagagaaatgtgtcacagtacatttaagggaatccccattagactaacagaagactttcagcagaaccttatagaccaggaaagaacagaaagctacattcaaagtactgaaggaaaaaaactgtcagtcaaggatactatatccagcaaatatatcctttagaaatgaggaagaaataaaacgtttctcagagaagtaaaaacagggaattcatcaccactagaacagttttacaagaaattctaaagggactcctgcatctggaagcaaaaaatgattatcactactaagaaaacacacaaaagtataaaactcactggtagaggctgagcatggtggcttacgcctataatcccagaattttgggagtccaaggtgggcagatcacctgaggttgggagttcaagaccagcctgactaacatggagaaatcctgtctctactcaacacacaaaattagctgggtgtggtggcacatgcctgtaatcccagctacttgggaggctgaggcaggagaatcacttgtacccaggaggtggaggttgcagtgagctgagatcgtgccattgcattccagcctgggcaacaagagtgaaactcatctcaaaaacaaacaacaacaacaacaacaacaacaaactcactagtagagcagatacacagaaaaaaagagaaaagaagcaaaacttatcactacagaaaatcactaaaccacaatgataaataataagagaagaaagaacaaaggatatgcaaaataaccagaaaatagttaacaaaacgacagaagcaagtcatgacttatcaataataaccttgaatgttaacagaataaattccccacttaaagacatagactgacttaattgatttaaaacaaaagaaaacaaaaacatgatccaactatatgctttctataagaaattcacttcactactaaggatacatacagattaagagcaaaggaatagaaaaagatactccatgcaaataaaaataaaaagcgagcaggagtagctttacttgtatcagataaaacagactttaagtgaaaaaactgtaaaaagagacaaagaggatcatcatataatgataaaggaatcaattcagcaagaagctacaacagttatatatgcatccaacactggaacacattgatatataaattaaatagtattcaatccaaagggagagatagaccccaatgccataatagttggggaccccactctcatcactggataggccatctagaaagaaaatcaacaacgaaacattgagtttatactgcattttagctcaaatggacctagcagacatttacagaacatttcaactgacagtggcagaatacatattattttcatcagcacatggaacatcctcaaggacagatcacaaaggccacaaaataagtctcgacaaatttaaaagaagtgaaatcatatcaagtatcttttctgaacacaatggaataaaactagaaatcaataacaagagggacttttggaagctctatgaatacaacatgctcctgtataaccaaagactcaatacagaaattaagaagaaaatttaaaaatttatgaaaatggaagcacaacatatcaaaacttatgagatacagcaaaaacagtgctaagagaaaagtttataacaataaacacatcaaaagagtagaaagactttaaataaataatctaacagtgcaagaacaaaaatgaaaacaagaacaaaccaaacccaaaattagtacaaggaaagaaataacaaagatcagaggagaaataaatgaaattgagactaaaacttacaaaagatcaatttttaaaactttttttgaaaagataacaaaattaacaaaccacgagctaaactaaccaagaaaaatgtcccaaataaataaaattagaaacaaaaagagagaccttacaactgataacccacatatacaaaagatcattagagactagtacaaacaactgtacacccacaaattggaaaaccaaacagaaacaaattcctagacaacctaacaagattgaacctagaagaaatagaaaacctaaacacaccaattacaagcaacaagttgaatcaataattttaaaaatgttctatcaaagaaaagcccaggacctgatagcttcactactgaattctaccaaacatttaaagaagaactaatgcccatccttctcaaactcttctagaaaataaaagagaagggaattctttcaagctgattctacaagaccattattaccctgataccaagccagataaggacacaacaaaaaaaggccaaaatccctgatgaacatcgatgcaaacatcctcaacaaaatactagcaagttgaatccagcatcacattaaaaagaacattcaccatgatcaagtgggatttatcccagcgatgcaaggacggttcaacatatgctaatcaataaatgtgatacttcacattaacaaaatgaaagacaaacaccatatgatcatctcaatagatgcagaaaaagaaaagaaaattcaacatcccttcctgataaaaaccctgaacaaactaagtatagaataagtgcacctcaacatagtgaaggccatatatgacaaatccatacctaacattatactgaacagggaatagctaaaagcttttcttctaagaactagaacaagaccatgatgcccactcccaccactgttattcaacataacattggaagtcctagccagagcaattaggcaagagaaagaaataaagggcattcaaaatggaaaggaagaagtcaaattgtccctgtttacagatgacataatcttaaatacagaaacccatataagctgtaccaaaacattcttagaatgagacaacaaaatcagtaaagttgcaggatacaaattaacatacaaaaatcagtaccatttctatacaccaacaatgaactagtgaaaaaataaagcaagaaagcaaccttacttacaatagctacagaaagaaaatataaaatacctaggaataaatctaaccaaggaagcaaaagatctctacaattaaatgacaggacactgataaaagaaattgaagatctggttacaaaaaaaggaaaatatcccatattcatgaattggaagaacttatattgttaaaatgacaatgctaccaaaaacaatttacagatttgatgtaaaccttttcaaaataccaatatcattcttcacaggattagaaaaaatcctaaaatttatgtggaaccactgaagaccccaaatagccaaagcaatccccagcaaaaagaacaaagctggaggtagcacattatctgactttaaaatatacaagaaagtgataataactaaatcatcatgttactggagtaaaaacaaacacatagaccagtggaacagaacagataaatcagaagtaaatcctttaattatagcaaactgatttttgacaaaatgccaaaaacattgagtgtgcaaaggacagtctattcataaatgatgctgggaaaactggatatccatatgcagaaaaaatgaaactagacctctgtctctcacatatacaagaatcaaatcaaaatggactaaataattaaatgtaaggcctcgaactataaaactaagaggaaaacattggggaaaatgcttctgggcattggtctgggcaaagattttttggataagacctcaaatataaaggcaacaaaggttaaaatagacaaatgggattatatcaagctaaaaagcatctgtacagcaaaggagacaatcaacagaatgaagagacagcccacagaatgggagaaaatatttgcaaactatccatttgacaagggattaataaccaaaatatataaggaactcaaacaactcaatagcagaaatgctaataattcagttttaaactgggcaaaagacctgaatagacatttcttaaaaggagacatacaaatggacaagaggcatatgaaaaaatgctcagcatccgtaatcctcagggaaatgcaaatcacaaccacagtgagataccatctcaccacagttataatggctactatgaaaaagacaaacaataacagatgctggagaggatacagtaaaagaggaatgctagtgtactgatagtgggaatataaattagtacagccattatggaaaacggtatggaggttcttcaaaaaaactaaaaatatctacaatgtgacccagcaatcctgctgctgggtatatatctgaaagaaaggaaatcaggatattgaagagatatctgcatacccatgtttactgcagcactattcataatagccaagatatggaatcaacctaagtgtccatcagctatggatgaaaagataaagaaaatgtggtatatacacacaatgaaatactattccgcttattttatacaattaagcctaaaatatattttaaaaaataataaaatcctatttgcagcaacatggaactggaggtcattatttttatgtgaaataagcccaacacagacaaatattggctgggctaagtggctcatatctggaatcccagcaatttgggaggctgagggaggattatttgagcccaggagtttgagaccagcctgggtaatatggcaagattctatctctataaaaaaattaactggctgtcctagctacttggaagaccaaagtgggaagatcgcttgagcccagaaaattgaggctgcagagggccgtgtctgtgccattttaactttactccagcctaggtgacagactgagaccctttctcaaaaaaaaaaaaaagaagaagaagaaaaataataagaatgacagacaaatattacattctctcactcctatgtggaagcttaaaagtgtggatctcatggaggtagaaagttgatgggtgctactagagcctggaaagggtggcaagaggggtgaagagaggttggttaatagatataaaaagacagctagatagaaggaataagttctagtgtttgatagcacagcagggtgattatagttaacaataatttgttacatatttcaaaatagctgcaagagagaatttgaaatgttcctaacacaaagaaatgataaatgttcaaggtgctggatatcctaattaccttgatttgatcattgcacgttgtatgcatgtactaaagtatcacatgagcctataaatatgtataattattatgtatcaataataaaaaacattaagtttaaaatatatctttaataaattaaacttttgttaaaagcccaaattatagtaaataaacccttctgcatacaaaaagtgatctattagccactgaaaatcttataagagagtttttatgacagacttatgagcaataataagtattttaaaatataaatcagatcatgtcatgccttggcctaaaactcttcattgtttaacagttactcttatgagaaattccagtctcccagccaaggtctatgaaactcttcaaaattgactcttgtccacttctacctcctcaccaattatcaacctcactaccccagtcactttggccttttttcctctttctgatacatcatgagcttattatggcaacaagtcttttatatttgttaacttctctacctggagtacttttcccaaaatattttgcaaggtgggctcttgcttgacatttaactctcagctcaaatatcacctcctccagatgcctcctctaattgtcctttacaccaataacctctgacacattcatatgttttacagtcttaggaatatcctcaatgcctgacttaccatattcatttattggctcccatatttatttccccctctcccaaataaaataaaagctcaatgagagcaatatcttgtctttcctaaaccattgcttggcacatattaaatgctcaataaatatctgttgcacaaatgaataaacttaaataaataaaacacatctttgccttaataccaagttatttttaaatcatatccttatgtaatatcgaatccataagactcaattatctggggtttatttgacaaatttgattatcttatttgggggttaataccatgaatggctaaaaataggccaattgccaagcagagcacacaagcaaatatgatccctccccaggatgcttgccatccaaattacaagcattgaaaaatcttggcaaggcgcctatgctaataagaaagtgatccaatattcatgagaagaacttgaaaaactattatttttgcctgcaatcttcttggcttttccataattaatatgtcattatcatcagaaggctaagagatcaagagtggtaaaagcaacctttcatgtaatactcatagggacaatggtatttagcaaatatcacattgacttctggtaagagaaataatccagaatctgtggttgctagaaacctagtatatggaaaaaatagaggggcagttggcatcaagacagaaaggtagggttttaaagctgatctagaggtagaaaaaaacacattctagagattcctgaagaaacaaattccaagtactcattgtcatgaaaaacggtatgatggagtcctaccctctgtctgtattgttcttttttaaatagatcttcctggttaggtcaggaagaagctattcttgaatgccagttaatacattcctccatttactcaacattctatccctacaccaaattagctcagtagaaaggctatctagactatctactacctaggtcataatacattagcaacctgtacaaatgtcttttcagagtttcagtttatagcatgccgtggtttgttatccagggtgaatctaggaaacaattagatctataatctcacagcaaacttcatttgactatatttgcaaatgttatcaactatgttatttttttaccatcatatatataacgattgatataaaaagtttttcttacagttaggaaaaatttgtctctcctgacaaagtggtattcttccttttgcaactaatggcagttatgtaacttgcttctcttagatggccttggccatctaagaagctcagagcagaactaacttgtttaggtcgtctagaatgacttcttccgatccctatttttctctgcttaaacttgttgttcagttctgttaggacttttgttttgttttgttttttacatatatgccttttctcattagttggttaaaatacgcttttaaagtgtataagataaaaatagtagagccagacacggtgccttacgcctgtaatcccagcactttgggaggccaaggtgggcagatcatctgaggtcaggagttcgagaccagcctggccaagatggtgaaaccccatctctactaaaaaatacaaaaattagccaggcgtggtggcacacgcctgtaatcccggctactcaagaggctgaggcaggagagtcgcttgaacccaggaggcagaggttgcagtgagccgagactgtgccactgcactccagcctgggcaacaagagtgaaactccgtcccaaaacaaaaaacaaaaaaaaagagtaaataattttgaaattttaagctcccttttaccaaaaaagggttctgacttctggccagaatgtagtaaatgtcaagaaatcagtcacagctgaggtagtgccaggaatttggtgtgggggacaggaggagacaagcaaagactatttaaaaacaatgaattttagcctgtctataagtactcttttctatgaaaacataaaaggaaatttcccttacaaatgttgattgataaacatgaacgtctatatggaaaataatgcgatatctgagctaaaaggactcttagtgaactctgatccaatctccttgatttgaggatagggaaaagtgtaatccctaaaagattaaatgatatttccaaagaaacaacaagttggtaattaagtccggcctgaaatctggggcttctgcttcccaggttatgagctttctaacactccaagaactgtgaaccctggagggaaggttgtaatctgactttaactcctgaggacatgtggatatgcccttcagggtccagggacatttgggttgcacattaacagttaaaatatgctaaagcaccgcattttctccaactccattcaatgcctaaggtttattgtttgttcagttttagccaactatatttcctgagtgtttcaaaaggcagcaaggtggcgaggatacaagggaaagccgctacacattcaacataggaatacaaagattatagtagaattctacgcatcaaattccaattcaaatttcttctggggtcagtgtcagtatctcccacttcctcctgacacatcctgagctgaagatcccttttaaattttctttctaagaaaaaaaaaaatataggtttattgatctcctttaaatgatagctttagaataacatgtcaaattatttctgtttcttgacttattctaggaaaaaagacaaagaaataagatattcatataaatgaaaagtttcacagccggcaaccaactaattggtatatatttaaacacatttaagatattacttgattacattcaataggcataatgtccatataagaacaatggttttgtttggaacatataaaagtgatagttctgtaacatgtatttatttaactttttattttgagataattatagattcacttgcagtggtaagaaataatatagacagatcttttgtatccatcacccagtttctcccaatggtaaatcaagatattgacattgatacaatccacctcagatttcaccatgttagatataagttctaaatttctcatcaaagaataaatatgccagtatgttcaattctttgccttctacttttaaacttaacttcctcgtaaagtaacctttttcgattacctactccaccccgactcattccaattcctactccaccccaactcattccgatcacctactccaccctgactcattctgattacctgctacctgctctgccctgactcattctccacgctgcataaccattttttttccctccaaagcactcaccccctcactctctttaaattagccaattggaattagtttcgcctgcgtggtctaatcctagccaacaggggaacgacacggcagcaggggccatgtgcctcagggataagaacaccttcccctcccttgtccaagtgtgcgctcaccattgttccatctgtaagggcgtacccttctgtagaagtaacttgccttgctgagaattaaaagaaaattttatattcgatgccgtttcttttgcggcaccgaaactttatatataacaaccactttgacattcatttatataaagatcaatttttaatagctacaatctatagagcacttctatatgccagaccaactgctcactgatgaacaaacattcttctagttcattcctacaaaaaacaatttaccagtggaggcaatagtgaggactgtagcttagaagctttcatgctacaatgtagtatatgctacagtgtagtaccctatagctgtatgggtggttcattttaaaaattgtatatgcagccattcctcaataggctcaaaataaatattgacagaaataggtaagtaaatcaaaagagaaaatcaaagccaggaatcaaaagaagaggcaaattgggttaatatgattcaatttacgtctgggcttcttggtagacaggacaaaaaggtaaacagaatgagatatgcaatcctttttgtcaaaaggggaaactcatattgatcctttaagatatagatgtttaaaaatatgtctatgtctgtgcacatacccttatgctagctccagctcagttttttaaaataatcttttcagtcagagtttatgaacatccaaataaaactgtgtcaacacatgcttaatacatcagtaaaactatttttaataatgtactctcctattgaatatgggttggttttctgacttgctatggcccattgagtgcacagatgtcacagtgttctacttccaggtagtccttaacaaggctggcagcttctactttgaaactttccaaaaaattagcttccatgatgtaaaaaaaaaaaaaaaaaaaaaaaaaaaggccaatccagaatactacatgataaacacttgtgaagagactgaggtcatgtgcacagcaccaatgcacagatacgagtgaatccgttgatcttccagggcagcatagccgaaagctgaatgcagcctagtgattgacccagcctacaccaaatggagcggaacaactacccagccaagccacgccccaattcctgacctacagaaccttgaaaaataatgaatcactgttggtttaagcaacagaagttttgaggtagtctattacacagcaatcaataactgaaacaataacccaaactgataacctgaaaattcattttgtaaacctgcatctaaacttggtacaataattaaacattttctgtgcaagtagtccctcttatatgactagaatgtgtggaatgcctaggagcagcttttccaaatgaattcatcaataaacataaaacataaaatgaactgctctagttttcccagagattctgcctagaacagactgccctaggacagatgattaagttagtttgggtccaattcatgactacataacatggagttagttatgtcttaggctacgtcccttcaggcaacttggagcctcccagggttaaagaagctctgccaaaactcaaaatcaatagggccatttaaatgatgacatccccagtgggtaaagatatttgactccacacatcaatggcatgagctactgtcatgggcattcgtcaataggttgaagatctcattaaagctttttaatttctgcttagtggtattaggatttaattgatgccaaagacactgcctgtcactatacagtgatgttgtggcagtcagtagagaatgtcttacacacagtcctagaagaccttcctagaaaggccagggcagttctactggctgcatttcctggcttgacaggctactgctactttatagtagctctctctatgttgttctaccttcccatcatccgtgcacccatcttcttttaccagcaacccaattttctgaaaaactactccatctttattcttagtccatgttgctcagaagggtttgattctacccacagcttcaggcatgggcacaccacccagatcaggttgatcaccctggacatataactcaagacagtgtcaatgagatcaaaactttgaactctcaccaatactattggaaatgagaaactctattgtttcccactgggttgctaaactggtagaatggaatgggtatatataactgacagcctttttgccattccagggagataaaccctaagaacaaacaatgcatagatcacttgatcttctggatccagcagttctagaagtcatacgtgtctatattttttcagtatataagccaataaaatatcattttcatctaggctgttttgagttgtatttgctatctcttgcaatcattctcagaaactgccaaaagatgggctgctgcacaactatgggatgatggaatgccatttattttctgggacagtgcaatttattacaatttattacactccctttctgagccatagatcagaaagtacccgggcgttaagacaacagcacttcaaaaaacaatatcatacttgatcttcataaagttaagtgagcaaacaaggaaactaagacattaatgagacatgtggttcaaaagtcatccatcaaatcaaatatggcaccaagactggaaaccaagtcttcatgaaatgcgaggtttctgttgcttgaatcaatggaccttaaaggtgatttggtcttatggctccccaatgtcagtccatggattgggatctgttgccagagtatgttcaaatcatcaatagtccacagagtaatgagaaaaataaagaaactttgataggttttaatggagcaatttcatttcacttttaaagcctgaaatttcatccttccaggtttgtttggttttttcttttggtgttaacatatcctctttttgaaataatagcaatagtagatgtaaatcatcttttttggctaaatataaagtaagcaagcccatagcctcccctggaaggcactgccattgtttccaatactctcagctttaacactgacagctacccttgctctctttctcactgacacccaccaactcaaccagccctctcccaccacacaccctttctcaggtcacctctgtgctctccacccttggagctttacctctgggtaattcccttgtcttttgtaatgtatattagagtgtatattagagtgtaatgtatattagacgtctataactcctgctattactctgctcagcaccttcttaggacagaagcagctatcctttctcctgagaaggtgggaaaaaggcaaattatgcatacttataaataaatatttgttggtctcaaacaagtaaatttataaacattgatactaacattactggaagcataaaagcattagaaagacattaaatgccctacagtagagtgaaaattaaattctgccatctaggagaatagtatttagtcattaaagttatgattataaatactttgtaataatatgcgtaaatgcatatgatataaggttaagtgaaaagatacataactacaaaatacaactatgttaaaatatccatgcatggattaaaaaaatacagctttaactgcatagtggagttaccggtaatgtctacttttatatttatagaaatctctgttgtccagattttctgcaatgggtacatatgacttttgatggggttcagaacatgctaccacaaaacatggcaccttggcattttgaatattttaagctgaaggagtctgagaaacagcatgtgctggaaggactctctgaagcaggtcagaagccccttgtgtgagaggtccctccctaaacccagagaaaaggagcatccttatctctgaagatggagggacacacggagaagaaactccaggaaccagccttggtaagtttcccctagtttactacacttagttcatatgcttttccacaagtttccactcttcatcaaacctagtataaaagcactcaggtttaactgattcatcagattttccttccttatgaatgctctagtgacacataaaacttgtattaaatacatttgtatgcttttctcttattaatctgtcttttgttatagagccctagccaagaaactaaaatggttaaagggaagatttttcctacactttaaagtgtacaaatatatatttattaaagttagttccaattattatgtagccaatatttactgattactctactctgtagatgccaagaaagccatactctttcctgatagtttcctttgtgtgacaagatttgccacagatgtaggcaatgttggtattatacttttcttgacagctagaataacttctgctaagctaggcaaccacatctctccaagccatccttaatgcctaatgactgccactgcacctgacctagctccagggctgaccctttcatgtttaccccaaggccatgcccatctgggaaaccacctgggcaggtaccttccaaccaaattaaagtcaaggattccatccactatcactaaactagcacaaaccaagagagagaaatcaaggcaccacataggggttaggacaagtaatcaaagtcaggtagaaatcccagaagggtggtatacaatttatatttccctagtgaggcccattctagaataatgggaaaggttcactgttgtcagaatgccaagaatgaattctctgaatctggccttccctgaaatcaacacttaggttctgacaacctctaaattcatcctcactaactacatcaaacatttagcatgctttttattgtggggatgggggttgcttttgtttgatttggtttatctggcatctgaaacaaaagatgggaaaggatgacattcattcttaacctcgtgtatagttaaccacatcaaaaaaggctattgttagatacaaataaacgttaacatacattagttccaaaaggctaaagcctttcaggtgaacattattggacactttctcccctgtgccagacaaaactatgcatggcttattcccagagtcaccccgtcctttccaaggcattctatgctgcctcagggatgcaaacaattatggtacttccaggagagaaggagcacataaattctgtcaccccttgaccccaggatccaatttcacagcaatgggtgaaaggattttttagtcaagagatgatgtgagacgcacagataccccttggagtcatttgggtgacagcattaaagagaatgaaatgagctatcttgaaatggaggccaagtgcagtcactgcatctggaaagttaggctccttgatattcaaagctctggggctcggcaaaaaattcaaagagcttttagtattcaaaacaaaacaaaaaaaaacaaacaaaaaaacaaaaaacactctttaaaaaattaaaatattcaaaactgtggaaaacttgcaagaatcatatcatgaacatcccatactgtcttcccaagattcatccatttgctattattttgccatatttgctttatctcttcctcctcctctgctccccttccctcaaacaaacaaatgaaaagtggtttttgctaaaccatttcggtgtaggtgtgaacattaaaagcttctaggaattacagtagtctctcacacatacaatgatcaaaatcagggactttaacgttgatagaatactatcttacacgtagtccatatttacttttcttcaatcccgagtgtcctgtatggccactttcctccagtctaggatcgcactggcttttagctgtcatgtctctttagcctccttgaagctggaatactttctcagccttcctttgcccatcatgtcattaacattcttgaagaggacaggcctgtggcttttcagagaatctatgctggtctgactgttatatgaggattagattcatagtacatgtttttgaaaggcatactacctaagtgatagcatatccttctcattgcattacatcagttggcacctgatgaaacttggtcccattcttgatgtgttaaccttgattccttaaataaggtgttttctgccagattacctcactgtatgtgtgtgtatgtgcaggtattcctctttttcccttttataattaataatgtatgggaagacttttttctgactgtgtaaacaccctgctaatcaacaagctttcactcaatggtttaacacctattgacaattctactctgaatcaattattactataatagttgtaaaaaagtgatttttctaactctattatttctttcacagcaattagttggttttctagtgcaagaaacagctgccctttctcccttctttccttcctttccctccttccttccttcctttctttctttctttctttctttctttctttctttctttctttctttctttctttctttctttctttcttctttcttttggttatatcttactcatttgattcttaagtgtcccatttcaagctggttcctgtgtcattcagacaggtcctcattttttttttaatcagtttttattttctggcacaacaaaatgttccaggcttttcttgtcctttccctgctctgaaactgcaattagtcattgctctaagcaggggtccccatccccaacctccaggctgcagactggtaccagtctgtggcctgttaggaactggctgcacactaggaggtgagcagcgggcaggggaacctaactgcctgatctccgcctcctgtcaggtcagctgcattagattctcatggcaacattaaccctattgtgaactgcgcatactcattatgagaatctaactaatgcctgatgattttagatggaacagtttcatcctgaaactatccccgctcccctgccaccgatggaaaaattgtcttctatgaaaccggtccctggtgccaaaaaggttggggaccactgttctaagggcccttatttttagtggggaatgctatttagaaagcaagagctgggcactcagtgtgttcactgctgctaggagtgttattgcttgcaggccctttaagaggacaagtaagaattataaatatatattgagtcatgtcttcctattgatacttctaatctccatccaatagctcaggctcttccttgcctttccccaatccacagttgtactgccctccttccacagtgataagcctgactccccacaaaataatacatttacttaatcctacaatggatacaaagtaatttcagaattgtcccacaaataacacaaccaagaacaaatgtataaagttcaagatttctttccagtacttctgttgtttgattgaaggccatgcccatctgggaaaccacctgggcaggtaccttccaaccaaattgaagtcaaggtactgcattcaaaataacttgaatcagtatttttttcctatgtgtaatcatgtcatccatttgatatatagttaggttcatttactctgtactcaatttcccccatcttgttatttaatgttatttcggaatatacaaaccatgaacatggtttcaaactcaaaactatataaaaaggtattcagagaagtactacatcactgtcttccttccctaactcttctaatgctattcccaccctgtagatgaccaatttcatatcttctagtttatccttcctgtgtatccttttgcaaaaataatcagacacatagataaagacatttttatttccccttctttctacctgaaatgcagcatgctatatatagtcttccacattttgctttttgcactaccaatatcttctggtgatcactccaatcccgattcacagggatcttcctcatcctattttacagcacactactgcattaatgtattatggctcattcaaacaatctcctcattacaacataaccacgatgatgctgcacatattattatgagagaagttgaacatattttcatatacttaaggacccttttttatcaatttttgtgaactttctaggtctttgctgcttttctatcggatttatggtctctttagtctcctcaacgtgtagtaactttctatatattagcaatattagcattttatcagaaatacatcttgcaactatttcctcctggtttattacgtgtggtttatggttttttgccatgccaaagaggattttgtttaatttctaactttacacaatcagattttactacatctgaagtttgaattgtgaaaaacctttccttgtgcttttcctttttgttataaagcaatttcttatactggctaatttttaagtatccctcattacactatacatgggaatgtatgtaagaagaaaatcctatttgcctactgaccgctgggcaacttcaaaactgcatgacctttatttctgcaggcccttcatttcctagctgcatccctttcattttccctaaccccaggtttcctcagcaggccagcttcactagagagctgtaaactaaacctaaattactaaagaacacattactcactcatcataaccataggaatctttctctagagcaaataagaattagtagtacaaatctgttttataatcacatactttcacaaagcaagaatcaccaatagtatactttattgtctctcattgatgggtacattttctcttattatttttattatcaaataatccatgtttattttaggataaaattaaaactacagctaggcaaaaacaaatcaagatgttggaactgttaatattttagggcatatatgtaaacacacacctatttaaaaactctcttctttttatacctattaaaaaaaccctctgttctctactatacttgctattttgtaatctgtttccattttcatttaatataaacatctttccatgttactaagttgtctgcaaaggcattttaaaaggctacatggtattatactgtataaagacataaaatattgaaccaaatattgtgctcttaggatttaaaaaaaatatcgtaaacaactctgagaaaatttactcagacacacaccttcatgaatttgttcaaatgcttctttaagataaatacctaaatgtggaattgcaggattaaatagtacacaagattttcagggttttgatatacgtggtcaagttgccaccagcagtgtatggtgggttccctttacccacactgaacccacattagtgttatctttctctgtaatcctttttatctcctgatttagcaagactaaacaacagtgtaaagttctgcaaaagcaccagataagcaaatttagaacaaaacattactgatgtctgcccaaaactctgtaaacctgttcctaggctctaagctgtctattgaaatgtcctaagaaaccatttcactcagagaagaacatttttttcactcttcctgcacagctcagtctttacgatgttaaaatcctgtacaacttcctaacagcccttcacattcttcaggagcccgagtttggttctggttataaatgcataggatagatcccatacgggaagcatagacctaagaaatttatggaaaggaatttatgggaaagcttctctcatcagggctgtaccaattaaaaatccataaataattctcccttgtcagtttctgtataaacacattggccttagaaatttttacttcaggttctagtctaatggcctacacttctaaattatgcttttaattgaaaaacaataacatgcattttttttccagaaccatctgtgctttcccaagaacatgtaactactacagataaatccgctactttgaacaccctaattatccagtttagggttccaaaagcttaggaaaataatgccattcctgaaaaacagtacgtgatcagaaacacttgctttaaaattcgatatttggtgtgtgaagcttcttaacaagtgtttattaaactgcataatttcaaagcctggagtggtatattgcaatgttttcctcggagttgatcacatttgcatatctttttacacttcctgtgaaattaatattgccttttgtatctcgaacttagctaatataacttgccatttttacttttcactgctatgagtaatataaagtgaacccccaaagggacccctgcaacgcctacataagctttattctctcactgttgtattttttcatatgaatatattaaatcaagattaataaacctttgcagaatccactggtcctgcaaaaaggcaagattcataacggtaaaggctgctcagcaaataaaggaaacctgctcctaaaactggagccaaaggccggggttcatggagctcttgtcacatccaacagtgtgccagagactcttcacctcacaagaagtctttcaacagtcactcaataatatgtgcaaaagtggcttaaccaccaggataccaaaacccagccggtgattatcaggctgccttggctcagggatacatctttgtgagatgccaaaaactgaccataatcccaggattttaaaaatttcagctgggcttatggggatggaatgtgataataaagaaacaggatggtaggggctgaggaaaagtggaacatgatgagaggctcctaaaagcaaatcaaacacagaaaagggaaatctctctgaacactgcataccgcactgggcacaggagtcctcagttgagcatcccccactcattgggccccagcagctactttgcctagctaagaatctgctcaaagctcagggaaacctaaatggcaatacaaagaaagagttgggggcagcttcaagatagcaggctactggtacaaatactttgtgaggtcagaaaggctcactatcatgacttgtactgctgtcattgattctcctacttcaagatcatctccaacttggtcaagaggcagagtaatggggattcagggccacagttagggtgcagcaaatgaggtacaaaatttaagtagaactaaaaacaacctcagtagccaggtgtggtggccatgcctgaagtcctagctacatgggaggctgagataggaggatcacttgagcctaggagtttgaggctatagtgcactatgattatacctgtgaatagtcactgtactccagtctgagctacatagtgagatgcccatttcaaaagaaaagaaaaaaaaaagaaaaatcctcagtaatcaagataataatacttcagtgcaatctttttagaaaccaaaaaaatcatggtgaagaaaacacaattttaaataaatattaatgccctgccaaccatatttgagcctgcatggacacttctacctacatttttaatatattttaaaaattaatttttttggagaaccttaaagtcattgaagaaatactgaaaaattggaaagtaggtatattaaaacttacaatattaaatgtaaatattttatttatactaaaatcagaattcattataatttcactttcctgactctaatgggacaaagtaattttatttttatgttttgagatagagtctctctctgtcgcccaggctggagtgcagtcgtgcgatctcagctcaccacaacctccacctcctgggttcaagtgattcccttgcctcagccttccaagtagctgggactacaggtgcatgccaccacgctcggctaatatttgtatttttagtagagacgaagtttcactgtgttggccaggctaggggacaaagtaatttaaacatgttttcaaaacttacttctttgtttgtcttcttttcaatggaagaattaccatgtttgacattctcttatcacctagtgacaatcataaatgatttttaattaaacaatttactttctttaaattaattttattttgtttttccttagctttaggctccaaaatggcttggcactgtactaatccttatttaaaacttcaatgttttgttcatcatggatttttctggcatttatttgatttttgaaaaaaatggaattaaactatttgtcttgatcactaagtatgttgacattctcttaaactgtgcattaccttgttccatccaaatcaaagtcaaggatgtagccatctcagacaaataacataacaatgactttaagtgtggaaagaagcctaagatcttttattaagtgaaagaagtatgtggcagaataatatgtatagtatgggctcacttgcacttaagaaaggccagaaaaacattttaaagaataactctaagtcattacacatcaaataaacattgacggcaaaaggtaaaaagtgtagttactgaagcaagagtttctaaatcatggtgctgcaaaataatacactgggtgtccaagtagcagtaacaactaagtattaccctctgctaacatctgatatctttgaaagattgtctctacaataatgtcattctcattcacttgtagctaggtactttttttttctagagaaagagatgggatttcagcatgtgtactaggatgacaagcaaacactgtaggttcaaggaagttcatgggcatctcaacaatatgtgtggtggtgaaaaatacactgagaaccactcatctagctgctactgatcctattccataagctaggaatacgtcataagtactgttttgtcctcgcgttggggatttttgttttgttttgtttttttgtacctcctcagtatcctcctctgttaagtaatagcatttttgtttgctttttagccaggtttatggaggtataatttaaaaatagtaaaatttacacttttagtatatatttatatgaattctgacaaatgcatatagttatataacaaacaccacaatcaagatacagaacatttctatcatcccaaaaagttcccatgtactttgccatagtcaatctttaccctaattctccagcctctggcaactgctgatttgttttccctataattttgcctgttcaaaaacatcatataaatgcaatcataaaccatttatgtctgacttcttagtgtaaagcatttgagattcatccatttgatgcatatctcagtaatttatgcctttttattgctgaatggcatcctattttatggatataccacagtttatttatccatggtaataggatttggattatgatttcacaaatcacccatacttcctttcaggtcatgtggtttataaagggctgacccgaaagttccagagatgcccatagccaggcctgatcaaataacatattcagtcatcctgataatatggatggtttagagctgggcacatggtttgatgtaacaattttcgattcaagacaactgacagaactattggtaagaagttactgatggtataatggaaactgtttctggtagctattgcaccaccacaagggagccccaacttgaggataataaagccaacaggaagcaaagtgcaactaagtggatgagataccttcctaacctagtttgagcacctggatccagacatgcctaaagatctacctgtagacctgtcagttacatgaacctataaaattccttctagcctaggccaattttgattatatccctcattcctgaaactaaaatctcttgactctacagcatagaaagaaatctttcatcaaggaggttacaagagagtcttggaaacaagacacaaaaaatggttttgacatcagacaccccaactttaccacttactacttcctaagtatacaatgtcaagaattctctttactcctataaacctgtatttcctcatttccaaaatgcagagaataattccttacccattctaaaatattatcttgagaatcaaaaaaactaagttggttcaaatacaaaagaaaaataaaatgtatgattattatacacacaaaataatttgtatatgaaaaggagatattaagtgatgacggtgagagagaatcaagaggcattataaggatcaatgcagaactccagtgcttatataaggatcaatgaacaataattgtaactagaggtatttcttgagtatattcttgtgttaggcattgtgtcaggtattttacctacattatatcatttaacattctaaatatcactaaagtaactttttaaacccatttttgattaggcttagagaacataaaatactttttaagttaaagtactaactggcagaggccaaataaagacctaaatctggaccactgaaactagtgcacacttctaagttagatggaaggcatgaagcaaacactttggaaattaaaattcagttataaaaaccatcacaacacaattaatttagcaactacattcctttatacataattgtgccgagtgcatctaactcattaagatgtagaatgtttatgctgtcatataatattatcacatggtaataaatgaagttgcactatatctctaaacatctggatttcagagccaattttacacatttaattcagctatttggtgtcttaaacacatagcaaaaatacacaaggaaaaaatgattgtacatctggcatcaagatggctccaagaattggactgccaatgaggaagtcaggtttttctagcctatatcctctggaggataaatacccaaaatagtactgtttccaaagtaaccaaaatcaagaaaggagactccacaaaggaaacaagaatgaaaaagacaggcctagcccttttcaaaagctgagccttccctcccaggatccaaggtacttagggtttctcatacctgacaacctataaacgagaaagagtatcacttgtttgtccttccatttctcattttccagctttggtgcttatcaggttctccagaggtagcaaatttgtaagacatttcatctatttagattttcatttattcatccatcctttcagttactcagtgatgacttctatctgctgagccctgcactaatgatccaaaattcccaatcttcctgcctaggagagatagggagaggtagggaatatggcttctccattttctccttttcctttagtaaccaacctctactggaattaatcctttgagttcagctgggccttgagatccaacatgatttgttttaaaaatcaaggcaactattaatgtaaaaacaaaacaatacaagtattaggagaaaacatgagagaatttctgtacaactagatgtggggaaagcctttctaactataactcaaatccaaatgcaaaaaaaaaaagaaaaaaaaaagattgagaatttcaattacctgaaattttttaaaatttgcatagcaaaaaataccataagcaaaaataaaaaattaagtgcatgataggagaaaatatttataaaatatatcacagattaagctccaatcaccctaatatatattttaaaattcttggccaggcgcagtggctcacgcctgtacttcctagcactttgggaggctgaggtgggtggatcacaaggtcaggagttcaagaccagcctggccaagatggtgaaaccccatctctactaaaaatacaaaaatcagccaggcacggtggcaggcgcctgtaatcccagctactcaggaggctgaggcagagaattgcttgaacccgggaggcggaggttgcagtgagctgagatcacaccactgcactccagcctgagcaacagaacgagacttggtctaaaaaaaaaaaaaaaaaaattcttaaaacccatttttagaataagaaaaatagaaaaacaagtagttcacagatgatataggaattgcccttaaacatatgaaaatatgcttaattttacttataataagagaaaagcaaattaaaactacactaagaattataaccatattactctaacataagaggttatcaataggagaacctgggtgtggtgtacacaggaaccctttactatcttcacagcttttctgcaaaccgaaaactcttcttaacaaaaaagttgatccaaaaaaagtacattgagatactatttcttgcctatgagattgtcaaaagttgaaaaacttgacaatatactctattagcaaacagagtgtagagcaacagttcctctcaggcattgctagttagagtgcaaaagggtataacctgtgtaaagggaaatttggcattagttaacaaactatgtgtctatttccttttctatctttctacatacctatctatatatttacttaccagcaatgtcagttacagcattcaccctgaacatacaccttcaactgtatgaaaaaacgtggacataaaattattcactgtagtgttatttccagtaaaaaatactggaaagaatctaaatgccatccatagatacaatcaatagtagtcctttgtgtgaacaaccaatatacacatagaactactattcaactgtaataaggaatgaggaggatctttataaaattatatgaaataattgccaggataaaaaagcaaggtgaaagagtatacatagcatgctaacttctgtataaaaaggaagcgtatgtatatttgcttctttttataatgaagacatgaaggataaaccagaaactaatgaaaatattttcaaagagcgtgagtaaaaatggagctggaagggtagggatggagtgggactttcttgaacaatttttttttctagttttgacttgaaccaggtaagttttgacttgaaccaggtaagttttgacttgaaccatgtaaagttttacatattcgaaataaaaaatttaaaaaggatttataaagcaaaacctaaacttgcatacaggcaggacataaatggatctaatgatatatcacatcaacgtaaataatcacagaggaaaaaaataaattcaaataatttctgaagacagtattctgaatgtatatccttagtggaatattaggaaaaaaagaagtccaaataaatcttgaactttacttaatagattgattgtcaggaggggtattgatatagtaattctgaaactattttccgtgtactataggatagagcaaatgaatcgatacattaggatctcactgtggaataaaggagatacaaatatgaaatgagggaaagtgcggaagaatcctgtgatgttgaatttgaatggttgagttgtacatggtaacatacatgcatctacctatctgtctacttatctacctatctaatctatctaatctacctatcgcctagcggcaatggcaccccagtagcaatgaacccacctagcggccaaaactttctttctaaattccattctccagtaaagggagacagggcttgactgattcttgattggggtagggaaaatgtaaggtaaggttgatacatctttttttactccaggacatactcaaagactgatggagatatgtcaaaacgacataggaactagcatcaggggatcccactggctaaatgacagacaatttgagcctcacaaaagaataaggagctaagtatagttatatcattttgtggaacttcattgagctgtgtgcttataatttgtgtatttttttgtaggtatgctgtatttcaatatgaaatgtagtgtctttttttaagaaagctgtgatacaagcagcaaataagacatataatttactttagcagaaaggaagaccgtgctctatgaataaattgttctgattacactgatggtcatccatcctactatggaaacagaggtggagacctcttttggtaagaaacaacgtcagcccagaaatgtataataatacaaagagaaaaacatcattaggcacaaatcatcgatggacaatagaacccatgagtgaaaggttcttgggacacaaaatagttacccagtctcaaagtatcaccccacagatactaatttcaaggcaaaacaaaacacaaaacaaaaaaaaaccttaaaaatggagtgacctgaagaatatccaagatgaaacagcatcaccaaaactggcacaaacaaattatatgactctgctgtgatccactgtgaagcaggcaacattacctagatagtactttggcctacaatgaggaacaattggacagatccacattgtgtggtattccacaatcactgggtcggaatcttcaaaaatacagactcatgaaagagaaataaaaggcaggagaatattctagattaagagggtccaaagagacaaaataactaagtgaaatgtgtaatccttgattgtattctaaaaagaaaatggaaataaggaaaaagagacattacaaggtatgagggacattaatggaaacatttgaatatattagattacatatcaatgttaaatttcatgtggagagtgataacagtattatgattacatattcatcttaggaggtataaggtgaaatgtcagggggtaatatgatatctatgactgaaatgcaaatgattttttaaagtataataaatgagagaaaaaaagccaatgaacaattacaacaaaatgttaataactggatcctcaagggggaagagtaattgggatagactgtacaaaaattaatcaaagataactagcatattttgaatgctcactgttgtcaggccctatttagagaggtttgcaatactaactcatttaatccttgcaataactctatgtgattgataccacatatatccattttacagacaaaatggaaacctatagaagtaaaataacttgcccaggctagtaagtggagtagctggaatttgaagttaataaatttagagtcaaagtttattatcatatccacaatactactctgcccttcaaataaataagtctgtttagaggagcaaacacattaatcacaccaatcttatgattacatgcaactgatatctcctgtgtgcctaatgcagaattctggagggttcaattggttccaattagttctttttcctgtaccagaaaagaagatcagcaataactggaattctggggtggcatggagtgggggtgttaaattttacaaacacagcatccaaaaatagtatgttcagtcatgagtattatctttaaaatagagaatataaagaaagtctgaagatcaacatttaaatcaaagaaaaaagaacaaaagtacaggtgctttgaggtttagactatgctgaaaatgccattatagagcagtccatttcctcagtaggtagccccaaaagacccctgacacagtagaaattatatcattatacaattaatcagttttctttcacaatggcacaatggggtgccctctttaactcaacagagtaaccagctcaccaacagtatctagaaaagaggaaagtcacagaatggaaaaatagacacaaaaagctatggagaagagagactgaaacagacaaaggcggttgtactataaaagaaagcgagaaatggaaagggaaatgtcagcaatctaaggttaaaagagaaaagatcaggatataaaaagatgtagaagtctcttatgaaaaaaaaaaaaaaaaagggaggggaccagtgaagagatagaaatcatgaccagagtcgaagcttgaaaacgcagggcaacacacaaagagaagctgtaatagcagagccattcactcaatcattcatttcactcattcatttaatgcctaacatatgaagggtactttgtggagctttgagagacacaaaaatgactaagacaggacccctgccctcaaagagcccagctgttccaaatattctcattttggtatgctccaatttttaatgtaattttaattattgttgtcacaccttagctaatattttcatactcaacatgtacttccagaaattgcagcaactataccatctataaaagagggtaatcttggcagggagcggcggctcacacctgtaatcccagcactttgggaggctgagatgggtggatcacgaggtcaggagatcgagaccatcctgcccaacatggtgaaactccgtctctactaaaaatgcaaaaattagccaggcatggtggtgtgcacctgtattcccagttactcaggaggctgaggcaggagaatcgcttgaacccggaaggtggaggttgcagtgagccgagatcatgccactgcactccagtctgggcagcagagcgagactctgtctcgaaaaaaaaaaaaaaaaatgagggtaatcttaaatggatggcagctgccatacagaatgagttcattcgttgtggaacggaaacatgtttacatttctgatatgctgatagtatataatgcagtattgtgatgtggttctctgtatatatagatgctgtctatactttttttggatacagcacactccacatcattctattttatttttatcatcccattccagagaggaggcaaaggacaaggaagtctaaaggatgtggaaagacaaataaggaagttaaaaaacaggttttcattttctttacaatttcccagagggcttctatgacaaaaagctgtactgaacaacggaatgcgtatttgtcatagagtagctgagagtgaattctaggtaaacatacaagggagaggctcctagacagataccattgcctagtacctttcatttaaaagatacctagtgatatatgacttgggaaaaccagaaattgacctcccagcctgcctcagtatatggtctttgctcttaccaaggttggcttgctccctgaaaagacctgaaaattcaagtttgaaaaggtgtttcatatacctaatttagaacacacccctcctagatctataagagtaggtgagaagcatagaaatgaacacctattattttgaatgctcatcttctgattcctttaatgcactgtcccgccctttaccctctccccaaatctttgtggttcttttgggatttcaattgaggtgccccatctctccgccagagataggaatgtgactcaatctaaccaatcaaaatcttctgggggaagtgtatgaatctgcagttagagagaaggctttccgagatcttgggcacttaaattcacataagtctgaagctgcttagagatatttcttcccccaccacaaagactgtgactgaagaaaagatgaagaccacatggagaagaggaggactgtgaggggggtgagagcagaggcgaatttatcctgaagctactacatcttaagcttacaggtctttctctctttttttttttttttttcccagacggagtctcgctttgtcgcctaggctggagtgcagtggcgcaatcttggctcactgcaagctccgcctcccaggttcatgccattcttctgcctcagcctcccgagtagctgggactacaggcgcccaccaccacgcccggctaattttttgtattttttagcagagacggggtttcaccgtgttagccaggatggactccatctcctgacctcatgatccgccggccttggcctcccaaagtgctgggattacaggcatgagccaccatgcccggcccaggtctttctctagcgatgtgttcatatggtcatttataatcttcttatagagaaggctctccaaactgtatgagctttgggccacaaaatcctagattcacccctgggagagacagttgtgaagatacaataaggcacacatagccacccataacagaagccagtgtcaccccactggacctgcaattatgtgagccaatattcaccctttctttttatcttgggataatccaaatttggttttacccacttacaaagggaagaaaccggagattttaaagatagaaataaagtcatggctcgtaacttgctggcaggaaaaaatgagaaccaatgctgtttttgactttcagagtatctatcataagctatcattttgtttttgtccgcatttcagtatgtggtttaaaaggaagttccaacatcatatttgtaactagttataaggaaccggcagggaacagcctccagacatttttcaaatatatttttcctttaactggctataaaggacaataaggattaagttggcaccacaaaaagtcgcatttaatgatacccttttgtgtgttacccatttaccaaacatggatttttatttctgcattctatagaatacttattcgccactgagagttccatttaaattctttgcatgcacacacacacacacacacacacacacccttccaccaccactaccaccaccatcattttcatcatcatgtgatttcagaagagcagtcatgtctacagtaaaggtatttgagagctaaacaaagcctcctggctagagatcctggtatcttcctttaaacccagatcattcatggtatgggttccctgcagagcactggttgtggccccaccaagcactgccatttccagcactgtcagtttctttaaccttcaagagaacacagaagagtcattcaaagccagcaagtgaagagatgtcctggcagtctaatttcaaacaggcctcataccagagtcttttttatggtttttaaaagaagtattttatgctgctctgatgaaaacctctaacagtagtagcttctgtctgacaaataccatagagaatgaaacaataagtctgaagcaaagggagggggtaaaattatttttgtttcaatagccaacacacaatgaaaacaagaaactatagaggtttaaagaataaccgatatttattctggtaaagacttttctcatatcagcactttaccactgtaagatgctgacaataattatgtgaatgttgctataaaaaaattaaatctcccatctcatgggtttaaaggtgtttccgcctctgccttacacacacacacacatacacacacacacacacacgtacacacacatatttcaggtacctctgtcaggatctcccaactcaattatactgcatggaggaaaaatatgtatactactactactagaataagaataaactagtaaacaaacaaatagaatacaatgtaagctgcagtacatgtaatctgaaggcctgaagctcatgtgtgctaggtttttgattgagcagtggtgggggtaaacgtggcacagcagttatcagcctggactgtggaatccgatcataccgggaaatgaatcctggcttactcattgagtaacctggtaactgaacctccctgaggcccaggttattcatcaacaaactgatgacagttatcccatggggttattatagggattaagtgagaaaatgttatataaaggtgaggagtggcagaatatgccaccccaaaatatgccactttggcatgaggattattttgagctgaaggcagttgagaagaagcagatatgagagaagctctctgtcttccccctatttgccacaaaacaggatatagatttataaaggtgccctccccacctatcaggaaagaaaaagttaatcatcagagataactctagatattcactagccagaagagacaccagaggaatctatgtaacaagctttactaactagcccttccattagttcccccatatatttaccttctcacaatttgcagaaactcaaagtcctttcctttgtcttaccatttctctaaaaatttattgctcttttttaaaaagctatataaggtcacattttaatcacccctttgagtcactcatcactgggtacttccatgtgtatgtgcaagtacatgttaataaacttctgttttttcttatgttaatctgtcatttttcactctactttagagggccacagctggagaacctaggagggtagagggaaatagatttagtacaaagagcttagtgcagagcctgtttcacaatgaagcactctgtaggtgaaagcattgccatgattaatgattgccacaaagcatccatgttggttaaacagacaccatgcctaagggcatataatgactctgaggaaagctagacttgaagaaaacacgacttgcccagccaagtaccttggtcaaaacacatatttgtttgactctatagtgttgagacttgagtatctaatatacagatgaatgagccagtacagaatttgaaatttcaacaaaaaggcaagtataatctgcctgataataataagcaacttgtaaatctttgaatggatgggcttgcctgttttcacccatgctactcaaactgtgaaccacagaacagaacatcagtttcacctggggacttcatagaaatgctgagtcttaggtctcaccctagaccttctgtattccagaattataataagatctccagatgatttgtaggcatattaaagtctgaaaagcactgctgtggaccacaaaatttaatgtactgcttatcccactttgggtgtgtttctgtgatctttacaacttaataaaccacccccaaaagttagtgactttaaacaacaatttatttgtcctgcttcttcaatattggcagggctcagtgagacggctcatctctgctccatatggtgttgactggggtagttcaacacagactgcaagatgcaagctggcttcccttcattcacatgcccttggctgacctggctgggacagttgggggctggctgggcctctctccatgtctttgttgttcttcaggacctctttccaaatggagtggtctctctcctgcagcatgatcagacttctttaagtgatggcaccaggctccaagacagtgaagtcagccatcttaaagtctaaatctggaactggcactgtgcatttctgccattttctgttgatcgaattgagtcaaaaggcaaacaaatgtcaaggggagaaaaaagactttatttcttgacgggagaagaggtctgcacagacagtgtggaaggatttgttagcaacagtttttgcagacaagctaccacagagtatctgttacttttcactttcttcatctctctgttctcctgattggtcaaacagccacttcatttcaattacacaactatatgcgaggtcccattgggagcataaggaattttaagacatgatatctcccatcaaggagcttgttataatacaattggtaaaataaggaatacatatcttgaaattttaataacaataaaatactgtaataataaaatatttaagtagcagtgccagataataacagaaatgatgtcctaaggccatgaaccatttatttaattaatcgtgcacacaataaccatcctgagtgttcagaagagagaatggaaggggaggagaatggccatggaaggacggttgtgcagtgagtaagacttgcataggaaaatgagtaaggttttcaaaaaaaaaaaaggtccaatgaaatacacacaaaggatacaacagaatcaaggagccaagggaatggggtcatagggacacaaggccatgaatgagtatctgcatgttcttcaatgatgattatcaattcaatgttcctgaaagaatttcctgcctcataacgtccacctttacttctccctttagatatgttcataagctatttgtggaatccccaccagcaatataaccttgtattaataatgaagggtttttatgaaccttataaattttattataccttgtagagagggtgggggaacaaacaaacagaaatgtaggcattgccaaatggcaacttgtaaacttcactattcattgtgtaggaactaacacttttggtattgttaagtagccttgtaaatttcactctcccttagaaaataaaaatggaatgaaaggtgctgcttagaagaaacgtataaatttcaatctccactgcaggaaaataagctctgattacactacatagttcatacacctcaatgttccgaacacttgtttttttacagattcatgtataatgacttggttttccaacaacagagagtgaaatttacaagttgttatttaacttttttaggagtgtatttttcttccatgtcttttttttcttctttgcccctactcacaccagaaacctaatatgagcaatgggatttctgaatagtaccatacattaattccttcaataacaatgattaaaacattttaaacattgttctcagggcctcctgataccacatataaaagtggggaatgacacagcttttggccacacagttcaaaaaattgctctttaccttgttggggaagaagagggcttattaaaagtttataataagcagtattactagtatttaacttctatttgttgttgaaaagaactgagcctataatttcagaggcttccgagcattttcataaatatacccattagatattcaatagccagtggatttgaatgattttgccatttattcgaacagatagctgtcctggacaggaaggatagaagcattggaagaaagtgttagaactacatttccataaagtcatgacaagaaataaagaaagaaggggagtcaccacctcaatactagaagtgtcagcacaatgatatcctcataaaaggtgttctaaaagaaacttttaggtgttctaaaataaagttataaatgccataccaagaaatactgtcaaaacaaaagtcaagtacaatacagcccagaaagaaccaaatacatctttacatcagggagtaaaaatatacatagatataatatccacaattgtcttaatttatagcttttaaatagataatatacatacaaagtgaaaaattgaaaccacaccaaagtacgttgaaaaatgtcttcccactcatgctgttaatgatctctgtaccctcttcaacatatgcatatgtgaacatatacacacattttaaatttccatgactacaaataatggcatattctaacccatttttcacttaaaaatgtcatagagatggttctgtatagacccatttttgtgatggtctaattttattacaaagattataaagtatagatattccataatttatttacagattctcctattgcttggacacttaagctgtttttaatcatttgttgttaaatgcaatgccatggcgaatatttttgtacatagaattttgtgcacctgcatgactatagttctaaaataaattactagaaatggaactgctaggtcaaaaggtatatatgcattctattttgatagttagagccaaatagctttccaaagacaatataacaattcatgcttctattcatgataccaatacatcttgcattgaaggaattccaaaacaaccaaaagttcatcatttttctgccaactgatcctttctctcttaaaaagagtcggggtaaaaatcacccatttttgcttataaccataggcagttataatcattattgcccaagattcaaggccatttcattacccactgcatcaccatcctcactgtggtataattctaactggtcagagagacctttaatttgcagaccttctcagaagacagattatctgcattctgcagacatctgcagaaagccatccacaagtgcatatttcatggctgaatatttttacataacatcagctggaacccatcgttccagcattctcgccaagtgtcacaacctgctctattatatcaataagcagtttcaattagtcattttcttcccatggtgacgacagctataatagcatgcagtagtctgatgaagtttgtaatataaagtggagatgggagtattaaaaggaagagaatacagaattagaatcgcataaaaaaatccatctcccaaatagtcatttggggaaatgacaacatttttgaaacagtgttcaagaatgaatacaaaaatgcaattacttttgaaaagtcagataaataaatttgccatgggaacacattcttgccccagatagaaccctagtttttactggctaattagtcattaagcaccatctcaaaaacaactgtatatgaaagaatattgggtaaatagaaataaaacttaaggcttaacagaattgtaaaatgaaaataaatgccaacagagaatactactttgaaagcattggatagtagtaaataaattagaaggaatgacacagttgctctgccctcaaaatttatccctaatctgttactacttcctactttgtgtgctaagattaccaggctccaaaccatgcttgccttccctggcacacagccagagccttctgactggccacctgcctctcttcttgtccccttcagcctcttctttacacagcagctgaaatgattttctaaaaaatataaatcagatcgcatcatttccttcttttcagccctctactggttttgctcataattaaaatctaaaatctttgccatggctggcaaggccacatatggaatccatctaccacttctttctcctccctacactggcctctatcaagcacattcccaactcagaccctcaggtcttgctgcttccagctaaaaggttagacccccaaatattcagatgtttttcctccttcactttattcaggtatgtcctcaaatgtcacctcatcacaaaggattatttgaccaccctatctaaaaaataacccaaaactctttatcaaatgcatgcagatttactttccttatatcatttaactccactcgacattatatgatgtagttagatgtatatctgttcattctgtatatcccctactagaatgtaacttcaatgaagatgagaagaagcaaagataaaaaagtgcatcccaaccagacagaaaaacatactatgactgtgaactacacccattgatatggtttggttgtgtgcccacctaaatctcatcttgaattgtaactcttataattcccacatgtcaaaggcagggctaggtggagataattgaatcatgggggcacttccacccatactgttctcgtggtagtaattaagtttcacaatatttgatggttttataaatgggagttcccctgcgcaagctctcttgcctgcagccatgtaaggcatgcctttctcctcctttgccttgcaccatgattgtgaggcttccccagccaggtgaaactgtgagtccattaaacctctttttctttataaattagccagtctttactagcagtgtgagaactgactaatacacccatagttgagaaaacagcatctacctgactttggttaaattcattcaactcagcaaacatttactaaactcttattagataagaaattccagaaacataggtcccagtgtctatctgttatatagtttagagacaaaaacttgcatataatttgggaggcaagacatgaaatataaactactgaaatgacaactaaaaagagttaatgatcaaaagccaacatgagtagggcaggcaataagtgtcagagagttctgaggaggagagatttgtgtaggctgagagggtgaaggaatggttcaaaaagaaggctggagaagatctgggaaaggaaaccaggaggaagaaggcatttggggtgagagcacagcaggggcagacacatagattataccagtgttccccaaacatcaaagcatggaaccttggtgttacatggtccactgacaggacaaaccaaagaataataaagttatatctctttccatttgattttaatctttctaatacatgcaatgaaaaagtattaattcagcattaattgttaaacaccttagtaacacttgccaatctgaatggcattattttactttttattttttgtacttctctttaaacttttactccctatttatgataagggcttttatttatggaataacatataattttattcatatgtaaacttctatgggtaaaaaaaagggagttgctttaatggcagtcaatcatggactaaatatctgggtcactacctacccagacacaaagcagagtcaacctttaaagtaagcaaagggggctcagtggaaaagagaagaaagttaagctcttgtcaagatgatgcagggggcctcatgtcaggctaaggattctggaaaatattctgtaggactgtggtttcccaatttgcaacaaggtcaaattccttgaaaacacacgcgttatatttgagtgtggcatgcttcttattttcaagacagcaagaaatatggcaatcttcaattccattataccatttcattatacaaacttaaacacaaagtggaaagaagtaaatacaactttatactatatgtgaattacaaaagcacaatcacaaccacagtttttttttttttttaaagctgtctatatctattatgatatgggcaagaaacagatgactcacaaaatactcaaatagggtaatctgcagaaatgcttagaaagtgtattcatggtgtggagaaaccaaggattaatgcaatacccagggacaaggcgggagcctacttatagagttcacagagaactgcccaagcaaagagcaaagcagagagtgggtaggaaaggataaattgaagataaccaatatacaaacaaggctattttcacatatttcaaatacttaccaggtcttcgaatactttacctgtctaatcacgagctgtatattttttatagggaataagagtgcataggccaggcgcagtggctcatgcttgtaatcccagcactttgggaggccgagataggtagatcacaaggtcaggagatcgagaccatcctggccaacatggtgaaaccccatctctactaaaaatacaaaacttagctaggtgtggtggcatgtgcctgtagtcccagctactcaggaggctgagggaggagagtcgcttgaaccagggagacagaggttgcagtgagccgagattgcaccactgcactccagcctgggcgacagagcgagactccgtctcaaaaaaaaaaaaaaagagtgcatatagcatggacttaaacctcagcttgccattcacttctatgtgagtttcttaagctcaatgaatttaattttttcaataaaatgggagataataacagtatccactataaggctggtgtgagaagcaaatgaataaatgtatgtaaagcacttagcacagcatttgcctataataaatatgcatgctttgggaaaatgggggagggtcatgtgagctgccaaaatagtgaagagaaatttatgagagaaaagcttaagattgcagaaattatcaatttaaattgcattagcttagtatttcatatgagttgtccaaaacatcccatattattcaactattccatttcattgataaaatacttcaaaggcatacaaagaaggaaaatagtctagatcggtagaggcaggtggggttatagtggtggtgatcagtggtagtggcagggaatagacagtaaaggcctccttcagaaggtaatatttaaaataagaccaactgaaacataaaaggagttaactaagtgaggtgaaaagtgccccaagcagaggaaacccaacatgccaaggacctggggaagaggaaacctcctggattcaacatattccacgatcaacatgtggaagagtaaacaaggcgtggggagaactgcagctggagcggtagaaccttttcagtcatgtttaaagaatttaaattacatttatcccaagggtaatgagaagcctttgaaagactttcaagcaggaaaaaggcatgatcccatgatcggattatcatcattagaaaaccactactaaagagaacagggaggcattagagagttttgagttaaggactgaacaagaaaaataatgtttcaaatttcatttttattattttattgtttacaaaaattgtaaactgccgcagacgatttctctgagggctaactgtataagtataggttcatttggtaactcactcattccgtaagatatttattaagcacctaatgcatacaccggaactgtgcatagataggggacggaggagaaaactcacaaataagcagtctaaaaagtgctaagacttgaaaggcaaacgacacttctgagtggtgggtaaaattccaaaggtggaccaggcagtgtctttgctaaaacatttttcggtatggctgaaccataaaatgcatgggccgtattgaaccactcctttcacaagaatttactgagcactgactatatgctggtattgtatagctttggtgacatggtggtgtatgagaaatcacttaaaatataatagcaataacttttttattgtaaataaggctgggttgattatcaagagtgcatgagaaagaaaaacagagaagtgaagaacagtgccttcacttaaggagggttcgaatggcaataaaatacttttaattaaaacttctctgctgagaatagacagcctttgaaagcttgtgtaaacataaatgaactacatgtaaatatattcatgatattatagctttttaaataacattataacttttaaaatgtcaaatcctttgaatatgaaatgccatcccctctccccaaaaacatgaccaccatgaattatccagttgatcttaaatcaaaagccacttacttaaaagtgaaatgttcattccttacacttactagaaaaactgcttcaaatatgatcagaccttccctttgtcttcagagaattccgctgctgaaacagacccaacaagccagccaaggtccatctggggcagcttagggaaggggcaagacatgttccctgcccaacactatcttttccaacttagcccctgatcatgccaagacatcacagtgtaataatagtaatttaataatgtagtcggccaggctctgcccacagtagaaagcatgagaaaataaatgaggcttgaaagctaaacagagagaaacttctccaggcactgcctgcagcagggagatacctggtaatgaaatacccactgatctccattcattacacaggaggcaaaccttaaaagagagtctagaaaggtggatctctcaaaatagaaataaataaataagctcacctgccatggtggggtctctgaaaatgacttggaaggactgcctatagaatttttgtggggatgcagcaaagttttgtcagatgtcaagggaggtaattattcccgacttgcttgggcacatttgctggataaattggcctctttaccttcatctccccatgcgggcaccagataaagaaaccgtgtttaaactctacagtgttctctctggcttttaccatgaaaaagaaataaaaatgcatcctgggtgcttggcaaatcagcccagtgtcagatggggacccattatctttgaccttcacatttgtgccccttgggactcacagaaaatcctcaaaaactcttttgggtaaagatatatgatgtctaggaggtacccaccttcaggagaaagaaattgcctttgcaatataaaagttgcaaaagttgaagttagtgatttctttattttttatttccatttttgtctatctgctcaaatttttaaaatttacctacaaatgctggaagccttgtttactcaaccatgttatcaacatgttaagctatcagccatttctctcccttccctgctttcctctccaatcaccaagacaacactaacatttctccatcttaccttctttaaagaaaaattcttacagttaactgtctgccatctactaccacttccagaaccagtaatgaaatgtcagaggaggaacagttaattaaaattgtggaatcctactttgcatcctctcacagtcaatacatgtacaattagagatgcctttcagcatgtggtataactagtataagttaaactttgaataacacttgatcattaaaaataaaaaatcattaatgttaagcaaatacgcagtaaacatcttgcttcattggccataaaactcctttagctcagctcaactagtgtggtagatttaatattgggattcacttagatggtgctttttagtaagaaaccaaggaacatgtctacaatctgcaagtggtttatgggaataaaaactgtgcctaattatcccacatgggtttacctaagttgtcatttttttacaaaatttctcaagtttctccacaaacgtttagggaagaaatgacatagaatggtggttaagggttcagactctggagtcaaatgttgtgtgtgtttcatccctgcctctgctacttgctaaacatgacactgccataaccatttttcttcatttctcagagcctccatttccctgtaggtaatatgaagaaaacactattcattcacagggctactgtgaggatgaaatgagataatgtacacaaagcattttaaatagtgaccagaaccttgtaaagattaagtaaatgcaagctggtcctcctaattgataccttattcattcaataattatacttcctaaaagagtctggtaattatgtatttaaaacatattcacgaggtggagccaagatggccgaataggaacagctccagtctacagctcccagagtaagcaatgcagaagacgggtgatttctgcatttccaactgaggtaccaggttcatctcactgaggagtgtcggacagtgggtgcaggatagtgggtgcagcacactgagcatgagccaaagcagggcaaggcatcatctcacccgagaagcacaaggggtcagagaattccctttcctagtcaaagaaaggggtgacagacggcacctggaaaatcgggtcactcccaccctaatactgtgcttttccaatggtcttagcaaacggcacatcaggagattatatcctgcacctggctaggagggtcctacgcccatggagcctccctcattgctaggaaagcagcctgagatcaaagtgtaaggcggcagcgaggcttggggaggggcccctgccattgccgaggcttgagtaggtaaacaaagcggcctggaagctcgaactcggtggagcccaccacagctcaaggaggcctgcctgcctctgtagactccacctctgggggcagggcatagacaaacaaaaggcagcaaaaacctctgcagacttaaatgtccctgtctgacagctttgaagagagtagtgattctcccagcatgcagcttgagatctaagaacggacaaaatgcctcctcaagtgggtccctgacccccgagtagcctaactggcaggcaccccccagtaggggcagactgacacctcacacggccgggtactcttctgagacaaaacttccagaggaacaatcagtcaggaacatttgctgttcaccaatatccgctgttctgcagcctctgctggtgaaacacaggcaaacagggtctagagtgggcctgcagcaaactctaacagacctgcagctgagagtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagcgcctctcctcctcgaaaggaacgcagctcctcacaagcaacggaacaaagctggacggagaatgactttgacgagttgagagaagaaggcttcagacgatcaaactactccgacctaaaggaggaagtttgaacccatggcaaagaagtaaaaaaccttgaaaaaaaaattagacgaatggctaactagaataaccaatgcagagaagtccttaaaggacctgatggagctgaaaaccacggcaccagaactacgtgacgaatacacaagtctcagtagccgattcgatcaactggaagaaagggtatcagtgatggaagatcaaatgaatgaaatgaagcaagaagggaagtttagagaaaaaagaataaaaagaaatgaacaaagcctacaagaaatatgggactatgtgaaaagaccaaatctacatctgactgatgtacctgaaagtgacagggagaatggaaccaacttgcaaaacactctgcaagatattatccaggagaacttccccaatctagcaaggacggccaacattcaaattcaggaaatacagagaacaccacaaagatactcctcgagaagagcaactccaagacacataattgtcagattcaacaaagttgaaatgaaggaaaaaatgttaatggcagccagagagaaaggtcgggttacccacaaagggaagcccattcagactaacagcagatctctcagcagaaaccctagaagccagaagagagtggaggccaatattcaacattcttaaagaaaagaattttcaacccagaatttcatatctagccaaactaagcttcataagtgaaggagaaataaaatacttaacagacaagcaaatgctgagagattttgtcaccaccaggcctgccttacaagagctcctgaaggaagcactaaacatggaaaggaacaactggtaccagccactgcagaaatataccaaattgtaaagcccatcgaggctaggaagaaactgcatcaactaatgagcaaaataaccagctaacatcataatgacaggatcaaattcacacataacaatattaaccttaaatgtaaatgggctaaatgctccagttaaaagacacagactggcaaattggataaagagtcaagacccatcagtgtgctgtattcagacccatctcacatgcagagacacacataggctcaaaataaatggatggaagaagatctaccaagcaaatggaaaacaaaaaaagcaggggttgcaatcctagtctctgataaacagactttaaaccaacaaagatcaaaagagacaaagaaggccattacataatggtaaagggatcaattcaacaagaaaagctaactaccctaaatatatatgcacccaatacaggagcacccagattcataaagcaagtccttagagacctacaaagagacttagactcccacacaataataatgggagactttaacaatccactgtcaacattagacagatcaacgagacagaaagttaacaaggatatccaggaattgaactcagctctgcaccaagtggacctaacagacatctacagaactctccaccccaaatcaacagaatatacattcttttcagcaccacaccacacctattccaaaattgactacatagttggaagtaaagcactcctcagcaaatgtaaaataacagaaattataacaaactatctctcagatcacagtgcaatcaaactagaactcaggattaagaaactcactcgaaaccacacaactacatggaaactgaacaacctgctcctgaatgactactgggtacgtcgcgaaatgaagacagaaataaagacgttctttgaaaccaatgagaacaaagacacaacataccagaatctgtgggacacattcaaagcagtgtgtagagggaaatttatagcactaaatgcccacaagagaaatcaggaaagatctaaaattgacactctaacatcacaattaaaagaactagagaagcaagagcaaacattcaaaagctagcagaaggcaagcaataactaacatcagagcagaactgaaggagatagagacacaaaaaacccttcaaaaaatcaatgaatccaggagctggttttttgaaaagatcaacaaaattgatagactgctagcaagactaataaagaagaagagagagaagaatcaaatagacgcaataaaaaatgataaaggggatatcaccactgatcccacagaaatacaaactaccatcacagaatactaaaaacacctctatgcaaataaactacaaaatctagctccctctccctctccctttcatctccgtctcccgctttccacggtgcccccctccctcgtctccgtctcccactttccacggtctccctctgttgccgaggctggactgtactgccacgatctcggctcactgcaacctccctgcctgattctcctgcctcagcctgccgagtgcctgggattgcaggcgtgcgctgctaagcctgactggtttttgtattttttggtggagacggggtttcgccgtgttggccgggctggtctccagctcctgacctccagtgatctgcccgcctcggcctcccgaggtgccgggattgcagacagagtctcgctcactcagtgctcaatgttgcccaggctggagtgcagtggcgtgaacctccacctcccagccgcctgccttggcctcccaaagtgctgagattgcagcctctgccccgccgccaccctgtctaggaagtgaggagcatctctgcccagccgccaatcatctgggatgtgaggagcccctctgcctggccacccagtctgggaagtgaggagcacctcttcctggccttcaccccgtgtaggaagtgaggagcgtctctgcctggccgcccatcatctgggatgtggggagcgcctctgcccggccgccccgtctgggatgtgaggagcgcctctgcccggccgccctgtctgggaggtgaggagtgtctctgcctggccgccaccccgtctgggaggtggggagcacccccgcccggcagccgccccgtctgtgaggtgggcgtgcccccacccggcagccgccccgcctgggaggtgaggagcccctctgcccggccgccaatccatctgggaggtgtacccaccagctcattgagaacaggccatgacgatgatggcggttttgctgaatagaaaagggggaaatgtggggaaaagaaagagagatcagattgttactgtgtctgtgtagaaagaagtagacataggagactccatttcgttttgtactaagaaaaattcttctgccttgggatgctgttaatctataacattactcccaacccagtgctctctgaaacatgtgctgtgtcaactcagggttaaatggattaagggaagtgcaagatgtgctttattaaacagatgcttgaaggcagtatgctcgttaagagtcatcaccactccctaatctcaagtacccagggacacaaacactgcagaaggccacagggtcctctgcctaggaaaaccagagacctttgttcacatgtttatctgctgaccttctctccactattgtcctatgaccctgcgaaatccccctctctgagaaacacccaagaatgatcaacaaatactaaaaaaattaaaaaaaaaaaaaagaaaagttcaaataaagtgtatgaaagaactttaaaaaaaaaaaagaaaaaaaaagtgcgaaaattagccaggcatggtggagtatgccttggggtcccagctactcaggaggctgaggctagaagatcacttgagcctgggaggcagaggctgcagcaagccatgattgtgctactgcactccagcctaggtgacagatggagactctgtctctaaataaataaataaataaataaataaatcctatttttaaatgctaaaaaaaaaaaagaaaatctagaagaaatggataaattcctcgacacatacaccctcccaagactaaaccaggaagaagttgaatctctgaatagaccaataacaggctctgaaattgaggcaacaattaatagcttaccaaccaaaaaaatccaggaccagatggattcacagccgaattctaccagaagtgcaaggaggagctggtaccattccttctgaaactattccaatcaatagaaaaagagggaatcctccctaactcattttatgaggccagcatcatcctgataccaaagcctggcagagacacaacaaaaaaagacaattttagaccaatatccctgatgaacatcgatgcagaaatcctcaataaaatactggcaaaccgaatccagcagcacatcaaaaagcttatccaccatgatcaagttggcttcattcctgggatgcaaggctggttcaacatacgcaaatcaataaacgtaatccaacatataaacagaaccaacgacaaaaccacatgattatctcaatagatgcagaaaagacctttgacaaaattcaacccttcatgctaaaaactctcaataaatgaggtattgatgggacatatctcaaaataataagagctatctatgacaaacccacagccaatatcatactgaatgggcaaaaactggaagcactccctttgaaaactggcacaagacagggatgccctctctcaccactcctattcaacatagtgttggaagttatggccagggcaattaggcaggagaaggaagtaaagggcattcaattaggaaaagaggaaatccaattgtccctgttcgcagatgacatgattgtgtatctagaaaaccccatcatctcagcccaaaatctccttaagctgataggcaacttcagcaaagtctcaggatacaaaatcaatgtgcaaaaatcacaagcattcttatataccaataaaagacaaacagagcgccaaatcatgagtgaactcccattcacaattgcttcaaagagaataaaatacctaggaatccaacttacaagggatgtgaaggacctcttcaaggagaactacaaaccactacttaatgaaataaaagacgatacaaacaaatggaagaacattccatgctcatgggtaggaagaatcaatattgtgaaaatggccatactgcccaaggcaatttatagattcaacgccatccccatcaagctaccaatgacttccttcacagaattggaaaaaactaccttaaagttcacatggaaccaaaaaagagcctgcattgccaagtcaatcctaagccaaaagaacaaagctggaggcatcatgctacctgacttcaaactatactacacaaggctacagtaatcaaaacagcatggtactggtaccaaaacagagatattgaccaatggaacagaacagagccctcagaaataatgccgcatatctacaactatctgatctttgacaaacctgagaaaaacaagcagtggggaaaggattccctatttaataaatggtgctggggaaacctggctagccatatgtagaaagctgaaactggatcccttccttataccttatacaaaaattaattcaagatggattaaagacttaaatgttagacctaaaaccataaaaaccctagaagaaaacctaggcaataccatttaggacataggcatgggcaaggacttcatgtctaaaacaccaaaagcaatggtaacaaaagacaaaattgacaaatgggatctaattaaaataaagagcttttgcacagcaaaagaaactaccatcagagtgaacaggcaacctacagaatgggagaaaatttttgcaatctactcatctgacaaaggactaatatccagaatctacaaagaatcaaacagatttacaagaaaaaacaaacaaccccatcaaaaagtgggtgaaggatatgaacagacacttctcaaaggaagacatttatgaagccaaaagacacatgaaaaaatgctgatcatcactggccatcagagacatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactgggtatatacccaaagattatgaatcatgctgctataaagacacatgcacacgtgtgtttattgcggcactatttacaatagcaaagacttggaaccgacccaaatgtccaacaatgatagactggattaagaaaatgtggcacatatacaccatggaatactatgcagccataaaaattgatgagttcatgtcctttgtagggacatggatgaagctggaaaccatcattctcagcaaactatcgcaaggagaaaaaaccaaacactgcatgttgtcactcatagctgggaattgaacaatgagaacacatggacacaggaaggggaacatcaaacaccggggcctgttgtggggtggggggagtggggagggatagcgttaggagatatacctaatgctaaatgatgagttaatgggtgcagcacaccaacatggcacatgtatacatatgtaacaaacctgcacgttgtgcacatgtaccctaaaacttacagtataatttaaaaaaataataaaaataaaacatattcacatatttacgtattcatgtatttaaaatatattcatttattttacactatgtgcaactcatttttctacttaagaattagagagatgacatttcggaggcccctaattccaaatgctgccgcctgtttttagtacagatctgtgttaagcaaaggaaaatgaagcggtcaaatcgcctcagaagcttccggcttccacccctgtttgtaaacgaaactccatattagtcaaactacactccccagggagcacctgtaaaagtccctgatttacagaagtatttactttagggtatggagtttgttttttcaggtttatctctgggagagcttggtgaagctgacagtccagcaattttattaaactgttcaatttcagcattttttaaagagcatatataaagaacaccggcagtagctatttaaatttcccagtggatgctagaaataataaaaggacacttaaatgaccatttttgagcagagccaacagcatgtgtcctaattatccaactatgtgaaaaattctgtggatttttaccagagcacaagggtgtgatatgcacaattcagaacactaacggctacctcactagggtgtagagaacttttcaagtctaaatataaggtcccagtctgccagggtaagtttttctgctactttccctcttgatgaacttgttagacatgataaatggacaacatggtaagaagttgatatggtccactgataagcctctgatgaagaacaagtaaataaaaaaccattgtgctaagtgctctccttcatttattctcacgatcacattctgaggtaggtattactatgcacattttacaggtcaggaaagcaaagctcacacaggataagtgccttatcctacagtttaagtatccaagctggtgttctgattttcctccactcacctcttcctatctcttctccacccacctcttcctatctcttctccacccttctctgccctgctggtggtctcttccttactgatctctacagactcatctcccgtgccctttggtttctatagggctaagacaatggcaggcagcattaagggatcagagaattggaggaaagagtctgggggtatctattccccatttcctctctcctcccctcacactgcacaactgagacttttgacaagtgcccacatttttctagctttgactataatttctgtcagtggccctttttccctaattcctagctagggctctcattggattcttgtaattctgttctctgtctttgctccttcagactttccatagttgcttcaccatcttttttggttcccttaaatctacccacacctctgtcaatcttctgttcattaaactctcttccaacctctcagttttggtgtcatccactttctgctggagaaaggagggtagcccctagcagttggtacctcctcctctctagcttccctttcatctacccacaaccaaccactcacccttcccttgtagccagtcacaccacaagcaagtctgtgactcagcaaactggctcccagaaacaaaccctaggagcataattgaagatgaacccaaagatacagttataagtatgctcgtggagaatttgtaattttttaaaaaatggtagttatctaagaggacttgattaatcaatgaagggacattcataaaatgaaaaattataaatgattaaaaataataccataacttatatttcatgacatgaacatattctcaatatattaacttcaaaagggaagatacaaagttgtgtgtagaataactcagtttttctttgtaaaaattttgtatacatggggagaaaatggtccaaaagagaccatccaatagaaatacagtacaaggcacataagtaattttagtgtcagtagttacgttttaaaaagttaaaagaaaccagtgaaattcatttagtgatatattttagtccaacatatgcaaaataatatttaatcatgtaagcaacagaaattaataatgtgatatattgaattcttcttttgcatatgaagtcttagaactccggtgtgtagttgacactcagagcacatgtcaactcagtcttgctacattttaaaagctcaagagccacatgaggatagtgactaccagattggacagctcaggtaagcctcaaaagcgggtgtgtagagtaggaagttgaatgttcttcactttcttattatttttctccttttttaccattaccatttactactgatgcatgtcacctctgcaattagaaaaacaaattatttttaaacactaagagcaaggcttttttcttctgtctctggaacactttttggctcatgtcctttgcaattcacagactacacacttactagtatagaaaggtgccctcctttcttcccctccctttacattttctttggatagctacctatcttcagccctcaggcataagagtaagaatcaaatgttgattttcttcagagtggctgctgagccagctcccactctccagtggtgtgacccggaatctatcaggcctcacaccactgttttagcagctctgaatggcttgtggaagggcatggaatggggccagaaactgcttaatttgaggttaattaaatagtgatgacaagccttaatctccaacttgtcatcagattgtaaacactgattgcagctgcagcaatctgcaataaacctattgagaggaatcttgaccagaatgaaataagtacgttggttacccagatgaggctgggagaggtgagatcagagaaatctaggcttttgcagtaccaggagaaatggagacctgaaaagagggaaattcatgggcgaatgtgtcaattctgattcctgtacagccctatcaaaaaaaagaaaaaaagaaaagaaaaaataactggatcccatgcacctggaaattggaaagaacaagggcagaaatataaaaccactaaactaaggacctggaaaaagctgaaatagctttacatctattagccattgatgaggtttccatgaaaaaatatgtctgagccactgcatgccctgaggccgctggacagatggttataccaccagagtgagctacagcagtggctttctagagtgcaggcaaggatgacagttacagtgtgttaggtctctactgtgtctcaagcacatcacatgtaacgtatatgataattctcaaaagtactttatgaggtagctattattttctccattttaaagaggagaatgctaaatctcaaaggagtatcctaccttgcttaagtacatgtaacaaatgggttgaacccagactgtctaatgccctaatgcaaattctaaatcacaagaatctctgcctccagctttgaggcaatgttgaagtgggaaaggggaaagaatagtcaagttcctgaagaagatgggaaaaaatgagtcaaaaatctccaaagaatagggaagcacaaagggctgaggtaacaaatgccagatgagtaaacatgttcataacactgcaccccggaaagtgcccctcctggctccattttcatggagaatgctttctcattcttcaagatccagcacaaggccaattttcacctcttctgtgaagccttccccaaacctcctagtgagagaggcactttaaaaaaatatgtgagatgcattgagagacagatggacaccataaaagctgaactcaatattacatgtgaagaaaatttacaaaaaaatcttaatctgagtgtcagaaaaattggagtagtgaaagaaccattacagttattgtcaaatagttaattaactattatgtaggtttaaatccatgtattcttccttaaaaccttttggaacaagataaatcattctcatccattcatttattcattccctagcactgtgataacactagagaaataacaatgaccaaaaacagacacaattccactctcgaggtacacatgtttaaaagggaaaacagagtaatgatacaaaaatcacacaaataaatggacaattatgacatgtgttccaaataagaggtaaatgagatgttattattttatccaggatacaggactggaatcattaaagagaatacacagggaaataagctgcagttcattatttggaaaaagtttcaaacaatccacacagaaatggccccacacatgagcctgctctcttctgggcattggatgtgtcccggctgaggcagggaagacaagggtgcatccgtcgataacttctcaagtctcttctgactctaagaaactgtgaccctatcattccaaacaaaatattttctcagataagaattagaattggctaggttgaatttccaggagacttaggaaatatgtacagagaataatcacttcctaaatagagaggggagtcaagcaaaactgagtcttctaaactgctcggtagcattctccttctcttcgcacatggacacacttctgctttatgcactgccctgacagcttcctgaggacagaggctgatggtcttgctcatcactgaatcatcaatgcgtggcacatattaaatatttgttaagtgagtaaatgaatatggtactaaaatgtgcatactgacagaaacttttttctgttgtggcccttgtaggtgaacttccttgaataattaatgaacatgaaagtcagtcaatcactcacctcctgattaatagtcagggtcccttgtccaaacagccacttagtccattaaaaattaataattttctacagaataaatatatgctgtacatggtacatcaagggttccacttttaatacgcaattaagtaatgcagaaagactaggaatctattaactaagaaagagctccatgaacttgccctccaagtcatcattcatttactatccatttctcttccaattttaaaaaattatttagccagaaaaaaagtagttctgaaaacagagtaaataacaacatgttgtcatattttggctaacatttgcaggccgacacaatgtgtgtttgttaaagatttgagatatgctattccttctgtgaaatgacgaatacattagggcagatcaatacaaaactgaagctctatatgtaaaatgttaagggtctattcattgaaaaattatgagccatgttatagaacttaggtcagagttaaattattgatctacattcatttttcccctttccatgtgactatcttttgattttttataacatacattattgcctatgtagaaaatgaatcctcttcttctagagctagtgtgtctggtgactgacaattttctaaaattaactgttgtgttggtagcatttagatttgtaaattgaactccccttgcataaacatttaaacattgaaaataaaatctgtaaactttggtagcatgaactcaaagggaaaagaggataattttcattttttaatacaaagaaagcaaagaaaaaaaggaaaggttatttttcttaacatcattctactactttatggttcttgatacatttcattgatgaggccaaattgtattcagttgactttttacaaatgactaaactgtattgctaagcaaagggatgtaatcaacactttgtgagctgaagtctcaattttcagacctaaagcttactcaagatgtataacctcaaattctgtaagcaggttagatgtcttgaaatacaaagactctcatcccctatcagcccccaaagtgacaaaggaatgtgtcttcaatgaagattttctctcatctgctgaaaagggaaaatgtgcaaatatttcaaagaaatgtagattccacagacccacattaattcatgaaaaaggaagctaatgtaagagttcttagtaggaatgatctttgatttggggctgtatttggtcagtaacttttgcctactaggagaatattttctctttaacgaagtagtatcagacacagagggctcttcattttctctaatggagatacaatcatttagattcgtgctccaaatgaggcagaaattacccctaatgtgtagtttgaacatttgtatcaaaatacagtgaaatgctgtttcagagtctgatgagaaaaatatgtgagctcacagaatgtctgcctctctcaggtgcagaagtggtctactgctttttttttcttttttcttttcttttcttttttttttttttgagatggagtctcactctgtcacccaggctggagtgcaatggtgaggtctccgctcactgcaacctccacctcctaggttcaagcaattctcctgcctcagcctcctgagtagctgggattacaggtgcacgccatcatgcccagctaatttttgtatttttagtagagatggggtttcaccacattgttcaggctggtcttcaactcctgaccttgtgatccgcctgccttagcctcccaaagtgctgggattacaggggtgagccaccacgcccggccctctgctacttttcttcacattgtcactgcaggaatcacctggctctagggggatatcccacagtctcacataaataccaatccctgtcgctggaacaagggggtcccagcctcacagaaggcctgagggactctgtttctctacaggtcagctccaaagcagagggccctttgcaccataaatcaatgtcatccacagaaaactccaggagaaagttaaataccagcagcaaacaatgtctcttgtgtagcagtctctcaccactgtttctgctaggtgacaaaagcagtgagaaaagcagaggaagcaagggctgaagacagaaaagtcaaagaattgcagaacttgagagttggaaaggggcagagtccaaataggaaaagacttaagcttcctactgtgttgtgctatgtagaatgctgtatgaggaagggcagcaggctttctccccagaagcccagctgaaagtcatccacactttacatggtcccctataccaggcttcagcccccttggccttggttttctcaacacacagtatggaatccatttctcatgagatggacttcattaaacacactcatgagaccaacatataaaaccagaatgtcaaagtagtagtctacgatttgcagtatagctgttgcacagatgtcagaaagaccaatacattcattcccttcctgtaaatgtcttccctgcaaaaccaaatcctaatcaggcagcaatctgacatgtaaggaatctgaacaagaggagttcatctgatgaactgaatgttaaacagcgtcaggggagatggagtcaccaatgggaaagaatacccaatgtcccttggctgcagctctctacatccattgccgtaacagaaatggccttgccaatagaaaaacaattctccaagtttctcacaggaggtcccgtcccctccaaagagagctacatgtgtattctttgtgtatttttatcattgagaaacataatttgaatgggaaagcctttctttcgttctaaaaaccctgcatcatttttctcattgcaggttaaaatatgttcattgtaaataatgaacatacggaaaagggtaaaagttattctatttcttccgcccagaaaactataggtggataatctttcagtctgtttctatgtatacatcttaggttgtccatataaaattatcattttgcagataaaaagcagtcaattaggtgcaattctacatggtccaatctcatatacatacgcacattacattaaagtcaaatgacaccttaacttctactttgttgcttttctttgaattaactagggctcatatacagttttccatgttactcggtaataccataattgattctcttgcacgcacttgtttaccaaaacttctcattatttccttagggaatattcacagacatagaagtgcttggttaaaggatttgcacacacacccattcatgcatatactgtctaaggttgctctcatcattaacagcagagttgagtagttgtgaccatactaccaaaaaacctgcaatatttaccctttagtcctttacagaaaaaggttgccaaccctgacctagaatccataattaactagatacagaatccagacatccattcaacaataggacacagacttcctatttttaaaaaattcaccgtgactacaagcagatctgcatttaaaatattttattcccattagtatttttaattggtccaaatgctctatgtgatataacttcactatcattagaatagtattaaagaatactattagaaaaatgtagctccattatttttactacagaaattattataaccgaagacataaatgcgaaccaaataaaacaaaataagttgtaaaaattcctttcttcaacaattgcataataatctataatacacatagatatacatgttcttaaatatttcatgtaaaaattggttactatttaataattaattttagaaacattaaaagaaatttaacttctgggtctttgatttgaaacagctaagaattttagactggtttccatttttaatcatgatcaagactcagaaacgtagctaagaaaaatcatattgtactttttattgaaaaggaatcacacagaccatgtctgaattattataaaggcttcattaattagattttaatctacatgactataccatatgctaaaaaaccatccaaacaaactctatgaaacggttttactgctattacttaaagagccatttaaaagaatttctacgggataaagactgggtgatttatcatagttttatgctcctttaatctgctccatcttcccattgtaaaataaatattggttttaaaataaatggttctgcccaggttttgatgagaaaaattgccctgtaaatcacaagctcacgtgtgccaaactctaagtccaatgttaactagcctattctgaagaaaaataagtcaattttatagaacaaaatctaaagaagacaattacttaagtgtattttcaaagctgcaatgtaattaatctgagatatgagcttctgtaccccaagttttttaattctcaaaataagaactagtggatatcaaactggtcctccaactggattttttaaaaatgggttctgtactatagtttttattatattctttccgaatccaatatacaagttatgtaactgaaaataaatacaatgagggttatatgataatgtctgagggttatatgatgacatctttatcaatcacttttttcatacacagagagccaaatcaatttaatagtcaggttcttagaatatttcatagtgttctgaaaaattgaccttacagtatacatattttcctataataagcatagtggttaaaatgctctggaagttatgaatggtttaaagcagtgcttcacaaactatttaggatgtaaaactagttgactatatttttcactccaatatgttgtgggttggtgatacttttataaaatacaataaaaattgcacttggatttagtggtagtgtcaaactgctatgacagtctctaaaccagcactgtccaacagaaatatcataggagccacatgtctgattttaagctttctagtagccacattaaaaatgtaaaaagaaacagttgaaattaattttaataatattttatgtagtccaatagatccacaaccttatttcaatatgtaatcagtatacaaatataatggagatatttaactttttaaaaaaattaagtcatcaaaatccagcatgtatattccacttacagcatgtccccattcagactggccacatttcaagtactcaacagtcacatgtagctagtggctgttgtgtgggaaagtgccattttaaaccattactcccaaactctgcacctccctcttcatgaactggtccacatacaacactttgagtagtactgtctaaactactgctcccttaaaaatggcaccttcatttctcttctataattttctactctgtgttttaaattgagggctccattccagataagtccaacacttaaagaaattaacaaactcatgattgcagctaactttatacatcctttcaggaaaggaatttgcatttataagggatggatacggaggtcccctctgctctcccttctctagaagcaatcactattctgaatgatattggtttctttctttcctatccatgtttttatactttttctactgactatgttcttaggatttaaataaagcaaagagaaaatttgtttgcacattgctgagatatatgaatttaatgcgtttagctcatacaaatcctgaccatattccatggcaaccactgaaaccgaatcacacacctttctacgtttgcaccctctgatcccctattcgtccttcataccacactgctttgatatatcattttctttctgctctgtatttagactctgttccaccttctagcctggataatttctacccattgagatcaaagcttaaatatcacttcttcaagtaacctttgttgatctgccctttgccctggtaaaattaggttccctgtcaaacactctcacttttcctatactgcacttaccaaaattgtaaatagtttctgttgttgttgttgtttttgagatggagtcttgcactgtcgcccagggtggtacaatggcacaattggctcgctgcaacctccacctcctggattcaggcaattctcctgcctcagcctcccgagtagctggattataggtgcccacagccatgcctggctaatttttgtattttttagtagagacaaggtttcaccatgttggccaggctgaagtagttattttttttactgatttgtttaatgtctctctcattcataaaaatatgttagcaccagcataattaaaagtatacagtaggtatccacaaatattaattgagtgaatgaatgaattttcattctcagaagccagacttaacctggtcattatgtttctcaatctctagtcatgacactagcttacaatgtgtatatcatggatatatatacatagggtatccctgttaattagaaggtatattttcaagagtatggccataaagaagttattcatggtatattcttttgaccttctattttcaattgtctctatatttagctcccatttttcatttctaatactgtttgtatttctctctctctctctctctttgttcttctctctttgtagttgatcaagtttgacaagtgagaatgtgctgttttagtctttaaaataatcattttttgctcggttgatcttctctactgtttctttgtattctatttcatttttggtaatatttttgtattattccttccctctactgtatttgggtttactctgctattttatttatacctttttaattgaatccttaattccctaacaatgtctccttccgtttctaacgtatacatttatgagtctataaatttccctctatatacctctttgtgtcccacaagacttaaagtatgtactaatttctatcatcatttttctttgactcacaaattattgacaggtacagttttgagtttccaaatgtataaagttttgaaaagtatcagtttctaatctcctgcttttttcctctgaaataaagaattagtaaatataatttttattcatcagcattaagactttctatgtgtgtatattatctgttagtggagtttgaagttctatatatgtctatttgtccaagctaaccggttatgtggtttaaatattctttatcttttctaagcttcttagcttgtttgatttatcagtgtctgagagaaaaatggttaaaactctcagattatgattatatgggttttcaatacttcttggtgactgtgtcaatttttactttctatatttttaaaaggatgctactaggtaatgtaggctcaggattaactcttcctggtgaattgttcttttatcattaaataataactctttatctgtaataatatttttgcttttaaagtatattttgtccgatattaatagtgtcaccagctttcatttgaatgatatttatatgatgtattatgtcaatttcatctattttctcttaatcttcccatgctattatccttaattgggttgttccttgtaaacagttaaagagagtatagctgttctctctatccaacttaagaatctttgcctgcagacagataggtttaatcatttgtatattggctttgattactgattatttggcctcatttcaactaattaatctacagcttcctaaaagtcagtaattatggcctctcactgaaccaagtactgcataccatagcaagcattgctgtatctatcttacactcataatttagctgttctcaataaataatttagacacattggcaaataatattctcttaaagcttcaagctcataagtacttatatatataacacagaaaatccccaactaagatggctaatccactactactcttatttctttacctataacatgaaaataagtgaatccacttgtcatctacctccaatgttgctgtactttcctcttcaacctcctcatttttaaaaatttctatcgggaacagctctcattctgtctcttctacctttcttcttccctatcccagtctctcacctgttaccttgacaattgaattagtatcttttctctccctgccttcatcctaccacctaacaatccaatgtttcctccagttaaatgagggtcgcatagtataagttaagaaatttgaactttaccctacagctcagtgtttctcaaactgaacccaaaggcacagtatcatagctccaaacattctatgagaatatgctttaggtttttatggttttattccaattaatgtcctgaagaatctaaatgacaacctgataattgagctatgctttccaaaagcagtgcctgagtttgtcttttttttttcctccatcaactctgttctgttctcagtatcactggaaccaaacaatcactttaaatgacagcttttaactttcagtgtgtcagtgagcacatctggctgctaggttggcatgtcctaatgctaaaattgtcccatgtctgctattgtgctcttcttgaagataatttgcaatggaaagatagtgtcatggaataagactttaatttattaagttatttaattaatggagactttgatatgacatcataaaaactcatagtgtggcagagtaatggtctattttaattgttatgggctaatgagaaaagaacaaaggcagaattaacatgtaaatgatgcgtttatatcaaatgaaagccaaatgatattatgggacagtgcaaaaggaagtttcccaatttttcaaatagagaaaagtggtgagaaaattgagtcatcatgtggctctgagtagtagaggcatgccaaattaagagtctttgccatagtagtcagcacactttattgatgaaacattaatttatcaaatatatgttaaatacttcatcaataaacagtgagtgttaaacactgttctaggcactaaggatacagaagtcataagatagtcaactctccagtgtcacggaagttatattctgacaataaaaagatgaacatgaatttataatacaacatcagggagtcgtaagtcttgtgaaggaaaacgaagcagggcaaagagatggaggatgatgagggaggaggaaagctacagtaggcaagatgatcaagggaggattctctgagaagatgacatttgagcagacacctaagtgcaacaggaggcaaaggcatacaaatatctcggggagaagatttccaaacaaaagcaagagcaaatacaaagatgttgagaagaacagcaagaaaaccaatgtcaacagactgcagggagaaaggagagtggtatgagactaggtaaaaagaagagggctgaatcttgaagagccttgaggtcatagcaaaaagcctgaatttaattctaaggatgatggggagttactacaggttttttgttttgctttgatagagtctcgctctgtcacccacactggagtgcagtggtacaatcttggctcactgcaacctctgcctcctgggttcgagtgattctccagcctcagccacctgagtagctgggattacaggcatccatcaccatgccccgcttattttttgtatatttagtagaggcagggttttgccatgttggccaagctggtctcaaactcctgacatcaagtgatccacccgcctcagcctccctattacagggtttatacagttcatgcagaataccagaaagggagatggggactgtggggatggatacaggtaggcttgtagatttgctagagaaaataaggtagtttcttctgattgtttctctttctccagtgaaataagaagtgagacaatcaactgattgagagagctggggatggccattggagagttgaggtacaggtgaagatataaaatagttttctcagaaagtagaagtattaggtaaacaatgcaggatcaccgtgtagaacagaggatccactgcagtcagcatagttgtgtgtcctccatccatccacactcaggcccaaagtaggtggaaagctgaatgagggtcatagttttgccagataagaatgacagagaaagatgagcaaaggagttcagtgtgcatgtaaagaagagaagaaccatagcatctgagctgagcaaggaggaaagtgaggatacaggaggatgacggattgtacataaatcctgtaagtcaacagattggaggccccacaggatcaaagaactgttggagtagagatgctaatgtcacctgaggcagcagccctgaaaagataggaagtggtggtcagagagtgggatgctgtgaaacatactttgaaggttagcatggcatttcataacaagggcactattggcatttggggaaaacaattcttcatcgtgcataacagtctcatgtactgaatgacatttagcatccttaacttctgccctctaaataccagtagcactccttacatttgcaattactccctaggagagtggtacttcctagattgtgaaccattggcctggggtatgactatgaggtagggagagatatttgcaagtgagaaactcagggacctgatagaccaggtatgagtattctctgtggatgtttttactgagaatgatgagtataaagacagggcgctggggggaacgtcttcaataaatacagaggagtaggctgtagaagagttttatggcatgtgctttaaaagcctctgcggaggaagagaaaaggaactgtctagaagtgacaatgaacaataccagaagacaccaactccactgtcagacactgagaaaaaaacagacacccctggagagggtgatggggaagcctccttaagagtttgccaagagtatcaagcagctatccaaaagaactttctgtgatgatggcaatgttgatatctacgccatcctataagatagacaataggcacatgtacttcttagcccttgaaacgaggccagtgtgtctgaggatgtgaattttttactttgatttgaacgaatttaaatgtaaacagtcagatgtggctactggctaacaaattggatggggcagaacagtaaaaggtgaaggaagcattcagaagacaaaattcttcttaatctctgagtcttgaggaaaagggcaagggcaggtatgagtctagggaagtttgtacatttgtagcaggaagaggtgaggagcatctaatagcacaatagcatcagcatttccaataagcaggattccaaaaattcattttaatttatttcagcctcctctcagactaaattctataccatattgttgtggaagacccttaaaaaaaaccctcaaatatttaaaatatcaccatcatgtaagaattatttcttctcctaagaagcatctggtattaatagactatgactatcgcgtgttttctaagatctaagtgtcccttccctccaaagactggctatctatatctaacaaaggaaaatgtaacatttgaaaattccctgttaaaagattttgttgtcatttggaaatcatatttcttgctgtttgcatttctattaaaaatataaagaaatttgttctttggtatcccaaatgaagtaaaagtattctaattggttgcattcacaagtctacaatttgcggcttaacaaaattatttttgaaaaggtcataacctgtacccacatgcccacccaaccacacacacagacatccagaatggtcttgtgatcatgtcttcagaagtttggctgcaaagttacaagcaacaactgtccatctgcacccaccaacctagtgaacaatgccagtctgggacccaaggactatttactcaacagaagaattccaacttcaggcaggggataggcgaagtccagataacatctagatatttcttgacattgcatttgattggaaataaaggaaaagtaaagcatttctggttagtttctgtttcttagtgtctctagttcccattttatttcaatcaaaatatcaaaatactctttagcccatagaggggacagagttcctagtttaataaaccctaaaatatataattaagataaagcctctgtagggttactcagcacaacactataattgctcagattccctagtggattctccagtcaatttctctgcatccttgaggcaaaatcttttccttaattgtcctcacttagaccaggtgctaggtgtccttcctagcctgcaggtcttacaggcccattcatccctaagggggtcttatatattaaccttgcttctgaactctaagcactggcaagtcaggcagaaggcccaaaggacctaacagcccataggtaactacaatgttggtaaggtggattctgccagatgccagccttggatccattttgggtccctacagatttatgcttctactataatgaatttcataatttctagtatgtgacccagggttgaactaagaagttattcttgctttcccctttagttttccctaatgggactttgatcaacatgaaaactaaaaatatcctggtgctagaccattaacactagttaactattccagactgtggccactgtcaaagacagccatcttgtaattgaattccactggggacaagaagactcaaaacagagtaggtgaatggattgcttaaagtccatctcagctactaaggagaatgaagagcagcagaaactgaattattaattcccaactctattcacaagccccctctggtggaggaagtattagtaatgaaacagctataacaataaccaaaatttttttaaaagagaaaaggcaatccacaacaaaacaatcagcccctgcagaaatgagagtcaagtgtagtgattagcaaatatgagctgcaacctgaaaaccacttacagatgaagcagtatgatgaatgatttaccaaaaggtcaacaccgctcttttgtcttcatcacccatcagttttccatcgccctcaatttgtctggcacataacagaaagcagggcataaaatattccccataaaaattaaccttactttgcaacattaaaaaaaaaaacttatagttgtatatagttgaagcgtaggggccagcttctcaattagtactcctagcatacagtagaaaaagcgttgacacttaaagccctattacaagaggtaatgttcttagcaagttccggaactctctgccctattcttgccttgctgacccactattctcaagcgaaggaaggggtcagtaatccccctaccaaataccacaccaatggtggcaggaggggagcatgtgacagcatttccccttttactctcctggaggccaaacttctttgcaatctctgcttttagctagcgtggatgccagcctttcaaccttgctatgcctgcaatactttctgacagatgagctatgagatgtaccaccttcccactcccatttgacaacctttgtacaaaaagaaacacaacgccaagggaaagtatatttttaggcatgagggattctgaaaatgaacatatctgcaaacttctagatccccttaaccagacctgaaaaagacattaatctattttaactaaactgattaaattgatttaatcagaaagcgggtcacttccctcctccctatcctgtcgctgaatttactaattgtttctccggctttgcccaatcaataagatattttgcatcttgcagatataatgtaagttatcagttattaaaaattcctcttcccggtctctggttaaagtgggtacctaaatatctgcttatttatttacgtcgttgttatttgcagatttcttttttaaaaaaagcagaattaaaatgaaagaaaaggtcaaaagagtttggaaaaaaagctatctacagggatgttcatcactgcatcatttataatagtaaaacttggaaatcttaaatttccaagcaaaagaagactgttcaaattaattatggtatagccataaagtggaatacagtcatgcatcacataatgaagttttgatcaatgacagaccacatatatgatatcgatcccataagattataatggagctaaaaaattcctactgcttagtgacgttgtagttgtcataaagtcattgtgcatgcattaccttttctatgtttagatatgcaactacttacctttgtgttacagttgcctatagtattcagtaaagtgatgctcacaagagtatgaaattgtctaatgacacagttttcattaagtgaggcatgactacactatgcagacattgaaaattaagtggtggaatatttaataacaaaaaaagatttgtggtactattaaggggggaaacacattgcaaaacagtagatactgtaatatcatatttattgagagctgttatctttgtataccattggtttgacaaacattcattggtcagccatcttccattcataacctcttctctccagcattccttgcacttgggaattgttctataaaataaaatattaaagaagaaggctgctaggtagggcttttttttctttttttttttttgagacggagtcttgctttgtcacccaggctggagtggagatggagtctgactctgtcgcccaggctggactgcagtggcacgatcttggctcattgcaacctccgcctcctgggttcaagtgattctcctgcctcagtctcccaagtagctgggattacaggcacgcaccaccacacctggctaatttttttttttttatttttagtacagatggggtttcaccatgttggccaggctggtctcgaactcctgacctcaagtgatccacccgcctcggccttccaaagtgctgagattacaggcgtgagccaccatgcccggcctaggtagggcttttcttcttgtctgattaaaaggagcggatttatctaacaggtctctttttgtatttatcctttatctttccaatctaaacataacgtctggaggaacagcagcttcattgtgaccatgaagacaaaaaaataacacgctaagaacagtagaagagaaatgccaaaacatcagctctagattatcctctaaagacttggagaaagtcactattggttggattttctttattttgcagctgaacacattcctgatacacaggagattctgtttttgttttttgcttatctgtggcttttatattttctaccatagtatgtactgttttatcataagaaaaaaatactggatacaagaaaaagggtcttttgtattcttcaagagaaatctagaggctgtgagttggagtctcaaatcatccaaggaacaaaagcacaggcaaagaagacatgccaataataaaattcttagagctgcttaacattattaatattttcattcccttcaacagaaactgtttacagctattagtattactgtttttcgagtcatggaacacttaagatctactatggtgtcaggtgctacttaaggcaccaagtatccaaacaataaggcagcccatgaccaaaaggaaccgtaacaagcaaacgaagaggaaaaacctagcagggtaaaacacactgcctaacattgctcagctggttaatggtgaagccaggactggaatgcaggtctcttgacacctaacgaccttcatcaccctatcatatgcttaacccacttaccatttagaagaaagaagtgcagcttgctaccagcacaacgctctcggagcaaacgggaaatgggttaagcattaatatctggctaaaagatgtaagaaaaactctggtgagagtatttaaggagaatgatctagatgggggtcaaaaaacatcagagacagaccttgttcttcattaactagtatttatagttatagcaggattgttttccctaaataaagggaaaggtctctttgagtggggcagaaaggattccactttttggctgggtgcagtggctgatgcctggagtcccagcactttgggaggccaaggcgagtggatcacctgaggtcaggagttcaagaccagcctggttaacatggtgaaaccccatctctactaaaaatacaaaaattagctgggcatggtggcgggcacctgtaatcccagctactcgggaggctgaggcaggagaattgcttaaacctgggaggcagaggttggtgagctgagatcatgccattgcactccagcctgggagacaagagcaaaactccgtcctccccaccccccccccaaaaaaaaaaaagagattccactttttatctatctataccacaccgaatcagtcgatcaatccactgaccacagattgtaatctcggccaaccactatagtggggaaagaaaacatagcagtgcaatcagctgttggataccacaggcaacttgacaagtcagtgacaacttggcctatttattcatcttttaaccgtttgttctggtgtctgtgtagtcacaatcaaagaatagtccctaggaatccatggagtttcattgaaatggagttagggctttggatcatatgcagaatctcagtactattccaggagaagggcagccacattgcctctgaatggccaaaacatagggtagtgaagagtgggagaatatgccagcccgaaatatgccactttagcctaaggattatgtggagctaaaggcacattaaaatacaaaacaaaacccagcaggtgcaagaagtgttctctaaccctcccctttttcttcctgaaaacatgaaacaaaacccccatatagaagacgtccagctataccagaaggaaagtctcattcttatcatcaaggatgggaaaatgagactaggaaaagtctgtacaaacagatcttgttaaaataattcttatcttcctttagcctttccacacagttgagttacttttccacaactgcctctctttgttcaacctaatataaaaccatctaggttttgccacttctttgagtcttcatttccttatgaggtatctcatgtcacataaaacttatattaaataaatgtgtgtgcttttctcccattaatctatcttatattcatttaagtcttaggcccagctgaaaagaaaaccctaaaagagtgtacaattttgcctcctctacagtatccatcttgaaagctgaaagttcactctcaatatgccttaagaataagaacaagtgggggcatgttttttagccatagttattcgtaacccaaacaaacaagtaaaggataatataagtgccaaaaatataaatgttgtctggattcacacatatcttatttgagtgactgtcattttatactgtcgtaatctgtttgcatgtctgtctttccactaaactatatgctccctaaacgcaaggacgatttcctttcatctttgctaagaatgtccaagccttcctccttccaaggctcgaactggattccaactataaaagtctataaaatatgacagctatttggaccgaaatccttcattccaaactatcctacttaaaaaaaaaagtcaactttttaacatttccaaaatatcctgaagggagggaaaaatcacacattaaattctgtcaagtaacatttacctcctcaagccctgactaatcggaaatgactggacttggcagctccttttatcacgtggtctatcagctaaatttagctcctgttgtgccaattgaaaaatgccaacatcccttcccatctcatacaacatcccaacccgccaatgactctagggtctctctggcaatctggtgtgaccactcctcatcagatcaaaatataaattacaaaccaaacttaaagtgtccaagtagccccatccagaagagcaatgatgaagttagaagagacgaagacgagaagggtgccagattcattactattgattccctgctggtctttcaatgtcacggaaagatgtccattatagttctatgaagagcatttggctcagtttaaactcttttgttttcagttcctttaaaaacaaaaatcaaccacgaaggataaacaactagaaattaatggagcccaaagggtttctgcagaatgagaagccttcatcactgcaccctaattatgtaaatctgctcctgcagagtccagtacatttatttattaagtctcaccactgccatcctggtaacccagagaagaagccaatctataatgactcaagccacatttcaaaatagactccaaaggacacatgatgtcatttgctaaaatgactcaatccagatggaaagcattctgacctatacataattgattgacctttgctatgctttccccagttatttatatactatcatatgcatgaatgtatatcagtggtatttacacttggcagctacttttaagaacacattattcaattgggatttgaagctttttacgaccatttcctgaccaaacattcataaatgacgaacaaggaaagatgttatcttaaaaataatgtttaataggctctggagagtttagagaagctttgctactctagttattttaaattacaggggacaagatctatgtacataaagctgagttcaaaccctgaaactgaggataccaaaggacattttatttactttccagtttggagctcaataatgatagtaaaatatgctgtacagaaggcatggaatgttttagatacatgtgagaagagcatcaactgtggtgaaggtagttagagacaataacaaattatcagaatctaaccatggatttcattttccaaaagaggttagctgcaaattggataatacccagataatcaagatagtttcaagatgatcatagaaggggaggcagatagattagggaaggcaaatatgaagcaagcatgtctttactcccattaggaatacccaaggcagacatccataactgattactgaattcttaaccacagagccctcacttggctcaaaatacttttccaatagtactccaggcaaacaccatcaaccaaacagacttgtcctaataacataaacagagaaagttgtatcttatttactgatcaaattaattctatttattgttaccatatactccaagattcaatctaaaactaaacaggtttttaaattcaaaatttaaagtcacatctctgaatcctaagaaaacgttaagtcaaatctagtagttttccatacttcatggtaggctagaatgacccttaatgtaaatgaaaagcaagcaggaaagctaaacaggagaagatgaaaatgcttatatgttcacataggaatattatatagcagtgaaaaggaaggaactacggccacatgcaaccacaggaataaatcttagaaacagaaatccaagtggaaatagcacatggagaagactacatacagcagtgctttccaagtagtgtgcctcagtaagtgggttacaagtgttcccaatccccttagttctggggtgaatagtacctggagtagccaaagtcttgtgtcaagccagagcatttatatcaggaggttctagaatattttcaagttctatgtatgccatgatggaagaagttaggaagcactgacatacaataattctttccagagattaaaccattataaaaccattttataatacttaaaaactaaaatgtatctgcttaggcatatatatacatatatatatatatatatatatatatatatatatatacacacacacacatatatacatgtgacaaatttatttcaaaatgataaaagaaaagcaaggaaaacatgaatggatacttcatccagtacatccattcattcagtataatggttactgttggaaacaataggcaggagatgagttaggtacaaaaacacttcagtagatggtaatgttacagttcttaaggtagatggtggttcatgggtgtttagtttattatactccaagcatattattttataaatacaacatgttatatactacttttctcaaaacatcaaggttaagaaggaaggaaactttttagctgattctgagtcaatttttcacagttgaatctcaatatggcaattcaagaatagatacaactacttttggaagactgaaactcagaggtcaagattttgtcctcatgcaactagaatagtccaaaggtttctaacagtcaactcatgtaccctatttaatgattacaagattttgttctaatccaaatagagtattaatgaaaaattgttgtaaacctaaagttacatttccctactgaaacaaaaacatcacaaaacccatatgtaagcctcttagttaagatccatttagttataaaaaacaaaacccaacctgaagtgttcaagtaaaaggattctggatgaggaattagaggtatcctacagcacataggatagcaagtacagccaggccttatgaagaaccagagccagggtgtaggcagcctttcagatccgaggttgaaacattctctctctcttgggctgcaggttcttgtgtctctacttctttctggaacctttactttattgtccctacctttagctgtgctttttctgctttggcatcgacatgaccaaatatttgtatctcttgtgatttaagtttaaaccaagtagtgccctgaagacaatttcaaaatgcccagaggggaaaaagaatctaattaacccaaccaaggtcaaaatctgtctacaccgggtttaatcagacacagctgtacataaggagttaccaattccaacaactacaggggccaggcaggtaattaaaagtatgatgctgaccaggtgtaaaaccagaagctggaagaaaagggtcttacaacaaagagaactcatgctgcctctccactttggatatgtaataatagaaatccagattttcattgaaatttcttgatttttaaaatacatctgtatacgttaggccacaggcttctactgtcagcgtcctacaaaaaatgaattgtgaatatttcagtttcggggggtcacactgggcaaacctgacttagataccagccctttgggtagaagagcaggtctcacagaagggctcatggtcaggcagtactgcaacaaagcctggattatgcactactttacacaccctccccatgaaatacacacatcagctaaacttctaaaaatatcttgttcaaaatcagatactaagccgggcagagataatcatcatgtagctttgtatgggttcatagtaaaaagcattaaaaaacaaagaaatcacacaaaagcaaactagagccagaaaaacacagcaccatcttcttcttttctttctttcttttttttttttttttttttttgagacagaatctcactttgttgctcaggctggagtgcagtggcgcgatctcagctcactgcaacctccgcctcccgggttcaagcgattctcctgcctcagcctcctgagtagctgggattacaggcacgtgccaccacacctggctaatttattgtagttttagtagagatggggtttcaccgtgttagccacgatggtcttgatctcctgaccttgtgatccacccgccttggcctcccaaagtgctgggattacaggcgtgagccatggcgccgggcccatcttcttttctgtccacagccaaaacatcctgccacaaaaggaccatttgttacaaaacaactgcatattcttttttcagttaactgaaggtaacacaggccctcctgtgtcaatttcttcaccatacaaaactgggagacacagaagtcatagcttaagtaagtgtcacttcctctcggaagcccagcctgagtccctgatcttgtataaggcaaatgtccctttacaaagcacctgtttcccttgctgtggtgcctaaccacagcacaactgatattgtatatgcacaactgtctatttatctcttccacataggtgagcttctggaaagcacagatactgtctaatcctccttctctgttcttaacacctgtttgttaaataaatacattctgtagtcagacatgtcaaaaattttattttttaatttttagcagctaattttaaaaatgctgaatttagactagattcctccttattcttttgtacgcacttaaaaattttcaacaaaacacttaaaatcttttactcagaaaagaactacacatatcactctgaattactacagactcaatatcacattgttgtggggctttcaagaatctgtgcttatatttaagctaaaaatccttcacagcacctcctgtcagtttgtagatacgcatagattttctcaatatacctgtattgatatagatataaatatacctggtatagaataaggcacggtaaaattctctacctagacataaaacccatatatttaaacttatgagaaatctggagaagtacagtatatacatgtccagcaagacttatgttccattttaaagaaatgagccttggcaaatttccctagcactgagaactgtttagcaagaattaatttttaaatgaaataagctaaaaataaaatagatgtagtattatttatacttaagtcttgttctttagcaattattaaaggttacactggtatgttttatcattggtaactggactcaagtttgaccaaatgtttctctttacccatgaaaaatagttgcaatgttccaattttgactgccattccaggtctttggtggcccttcatcaagtgcaatttggtagcctaaatgatatgggagggacagagcataatttcatggcagtaagtatagctgagacagaaaggttaaacaaggtccatgtctttggacacttgaccctaagttatgacagattaactttaaaagacaatgttttatcttgaacagaggggagttttgtcttctccttccagctaggtggaagtatttggcaaatgtcttctttggaaagaattatttagcaatggaattataatcggaattatttagcaatggaattataatcaatgtagtaaggacagaaaaagcaaactaaggacaaaggaataaatgaagaaatgacagccacacttgccaaggtgaattccattcagggaatttgccaaatgaaaaggatattaacattaacttaagcaggtttccttacttcaggaattgtctgtctttaatattcataatggtcctcatgaattttccaaaggatagagtatgcagcatttatgattatttaaaggctttataaatgtaactgctcttgggcatagtggtgctatcaggcagacctaggttgaaattctggctctgtcagcggctgtgatttcatgtgctaatttcttaactcttatgagcctcaattaccttgtctgaaaaatcagccctttcatttatatttcaacagaacttctgcccttgatgtccctttgaagttatttcccataattagtcacagatcatagcatcatcagctgcaatcatcttatctccattctattaacaaatttacatacattcttttgtatgttcaacaaacagcatatgccaagctgagctggcaactggacaaaaacatattatatgtggtttctgaacacccagagctcactatcttgttggggagaaaggcagtgaggaaatagtaatgcagagcagtgacaggtgcccataaggggttcgcctagtttggagaggagaaaacatttgagttgaaatctgaagagagaaaatgaagccactggagatgaagaaaacaaacttccatggggctgagggaacaagaatgtgcaaatgctctgtgggaggcagaaagaaagagattttgaggaggaaaaagggcagtgtagtttgcgtgcaaaaaccaggtgagcaagatgggagaatcaggagaggctttttctttttttttttttttttaatgtcaacactgtttggtgtttatttggtgagcctgagggcaattttcattctcatttctttttcttattgattatttccaaccctttcaacagtgaacatgcgttgcttttgcaattacaacaacaacaagaatccctatagacaaagcaaaaaatatatactttgtaatgtttttaaaaaacaaagattaaactacactaaaatataaggtgattatctctgaatgataagttttggggcagttttttttttaccctcatcactgctttccgaattccaaaggtaaaaagatactacttgaataagaagaaaaataaagagagttgtgtttcaagctttccctcttcccttcttcccaccctatctaacacttggaatatcccatgagggtctccaacgtcagcaggaactaagagccaagagtcgactgagagatgactttctttctctttcttttttgttgtgtggtgaagaaagaaatcataatctgacgtctaaagagcacttcactgttgctcttggttggactctaaatcacattgggaaaattaaaactacaatgagaaacatcttacaccagtcatgatgactattattttttcaattttatttttattacactttaagttctagggtacatgtgcacaacgtgcaggtttgttacatatgtatacatgtgccatgttagtgtgctgcacccattaactcatcatttacattaggtatatttcctaatgctatccgtccctcctccccccaccccacaacaggccccggtgtgtggccccggtgtgtgatgttctccatcctgtgtctatgtgttctcattgttcaattcccacctatgagtgagaacatgcagtgtttggttttctgtccttgcaatagtttgctcagaatggtttccagcttcatccatgtccctacaaaggacatgaactcatccatttttatggctgcatagtattccatgttgtatatgtgccacattttcttaatccagtctatcattgttggacatttgggttggttccaagtctttgctattgtaaatagtgccacaataaacacacgtgtgcatgtgtctttatagcagcatgatttataatccttttggtaaacacccagtaatgggatggctgggtcaaaaggtatttctagttctagatccttgaagaatcgccacactgtcttccacaatggttgaactagtttacagtcccaccaacagtgtaaaagttttcctattactccacatcctctccagcacctgttgtttcctgattttttaatgattgccattctaaatggtgtgagatggtatctcattgtggttttgatttgcatttctctgacggccagtgatgatgagcatgttttcctgtgtctattggctccataaatgtcttcttttgagaagtgtctgttcatatccttcgttcactttttgatggggttgtttgtttttttcttgtaaatttaagttctttgtagattctggatattagccctttgtcagatgcgtacattgtaaaaactttatcccattctgtaggttgcctgttcactctgatggtagtttcttttgctgtgcagaaactctttagtttaattagatcccatttgtcaattttggcttttgttgccattgcttttggtgttttagtcataaagcccttacccatgcctatatcctgaatggtattgcctaggttttcttctagggttttatggttttaggtctaacatttaagtctttaatccaccttgaattaatttttgtatagcgtgtaaggaagggatccagtttcagctttctacatatggctagccagttttcccagcaccacttattaaataggaaatcctttccccatttcttgtgtttgtcaggtttgtcaaagatcagattgttgtcgatgtgtggtattatttctgagggctctgttctgttccattggcctatctctctgtttttgtaccagtaccatgctgttttggttactgtagccttgtagtatagtttgaagtcaagtagcgtgatgcctctagctttgttcttttggcttaggattgacttggcaatgtgggctcttttttgcttccatgtgaactttaaggtagttttttccaattctgtgaaggaagtcattggtagcttgatggggatggcgttgaatctataaattgccttgggcagtatggccattttcacgatattgattcttcctacccatgagcgtggaatgttcttccatttgtttgtatcctcttttatttcattgagcagtggtttgtagttctccttgaagaggtccttcccatctcttgtaaattggattcctaggtattttattctctttgaagcaattgtgaatgggagttcactcatgatttggctctctgtttgtctgttattggtgtataagaatgcttgtgattttttgcacactgattttgtatcctgagactttgctgaagttgcttatcagcttaaggagattttgggctgagatgatggggatttctaaatgtacagtcatgtcatctgcaaacagggacaatttgacttcctcttttcctaattcaatacactttatttctttctcttgcctgattgccctggccagaatttccaacactatgttgaataggagtggtgaaagagggcatctctgtcttgtgccagttttcaaagtgaatgcttccagttttgccaattcagtatgatattggctgtgggtttgtcatagatagcttgcattattttcagacacgtcccatcactacctagtttattgggagtttttagcatgaagcattgttgaattttgtcaaaggccttttctgcatctactgagataatcatgtggtttttgtctttggttctgtttatatgatggattatgtttattgatttgcgtatgtgaaccagccttgcatcccagggatgaagccaacttgatcgtggtggataagctttttgatgtcctgctggatttgttttgccagtattttattgaggatttttgcatcgatgttcatcagggatattggtctaaaattctcttatttggttgtctcactgccaggctttgatatcaggacaatgctggccgcataaaatgagttagggaggatttcctctttttctcttgattggaatggtttcagaaggaatggtacccgctcctctttgtacctccggtagaattcggctgtgaatccatctggtcctggactttttttggttgctaggctattaattattgcctcaatttcagagcctgttattggtctattaagggattcaacttcgtcctggtttagtcttgggagagtgtatgtgtccgggaatttatccatttcttctagattttctagtttatttgcatagaggtgtttatagtattctctggtggtagtttatatttctgtgggatcagtggtgatatcccctttatcattttttattgcatctatttgattcttctctcttttcttctttattagtcttgctagtggtctatcaattttgttgatcttttcaaaaaaccagctcctggattcactgattttttgaagggttttttgtgtctctatctccttcagttctgctctgatcttagttacttcttgccttctgctagcctttgaatgtgtttgctcttgcttgtctagttcttttaattgtgatgttagggtgtcaattttagatctttcctgctttctcctgtgggcatttagtgctataaatttccctctacacactgctttaaatatgtcccagagattctggtatgttgtgtctttgttcttattggtttcaaagaacatctttttttctgccttcatttggttatgtgcccagtagtcattcaggagcaggttgttcagtttccatgcatttgagcggtttttgaatgagtttcttaatcctcagttcttgtttgattgcactgtggtctgagagacagtttattataatttctattcttttacatttgcaaaggagtgctttacttccgactatgtggtcagttttggaataagtgcgatgtggtgctgagaagaatgtatcttctgttgatttggggtggagagttctgtagatgtctattaggtccacctgctgcagagctgagttcaattcctggatatcattgttaactttctgtctcattgatctgtctaatgttgccagtggagtgttaaagtctcccattattatcgtgtgggagtctaagtctctttgtaggtctctaagggcttgctttatgaatctgggtgctcctgtattgggtgcatatatatttaggatagttagctcttcttgttgaattgatccctttaccattatgtaatggccttctttgtctcttttcatctttgttggtttaaagtctgttttgttagagactaggattgcaacccctgcttgtttttttttttccatttgcttggtagatcttcctccatccctttagtttgagcctatgtgtgtctctgcaggtgagatgggtctcctgaatacagcacactgatgggtcttgactctttatccaatttgccagtctgtgtcttttaattggagcatttagtccatttacatttaaggttaatattattatgtgtgaatttgatcctgtcattttgatgttagctggttatttcgcccattagttggtgcagtttcttcctagcatcaatggtgtttacaatttggcatgtttttgcagtggctgttactggttgttcctttccatgtttaatgcttccttcaggagctcttgtaaggcaggcctggtggtgacaaagtctctcagcatttgcttgtctgtaaaggattttatttctccttcacttctgaagcttagtttggctggatatgaaattctgggttgaaaattcttgtctttaagaatgttgaattggcccccattctcttctggcttgtagagtttctgccaagagatctgttgttagtctgatgggcttccctttgtgggtaacctgacctttctctctggctgctcttaacattttttccttcatttcaactttggtgaatctgacaattatgtgtcttggagttgctcttcttgaggagtatctttgtggttgtctctgtatttcctgaatttgaatgttggcctgccttgctaggtttgggaagttctcctggataatatcctgcagagtgttttccaacttggttccattctcctcatcactttcaggtacaccaagcagacgtagatttggtcttttcacatagtcccatatttcctggaggctttgttcatttctttttactcttttttctctaaacgtctcttccggcttcatttcattcatttgttcttcaatcactgatattctttcttccacttgatcgaattggctactgaagcttgtgcatgcatcacgtagttctcatgccatggttttcagctccatcaggtcatttaagttcttctctacactgattattctagttagcgattcgtctaatcttttttcaaggtttttagcttctttgcgatgggttcgaacatcctcctttagcttggagaagtttgttattctgatcttctgaagccttcttcactcaacttgtcaaagtcattctccatccagctttgttcccttgctggcgaggagctaggttcctttgtaggagaagaggcactctgatttttagaattttcagcttttctgctctggtttctccccatctttgtggttttatctatctttggtctttgatgatggtgacgtacacatggggttttggtgtggatgtcctttctgtttgttagttttccttctaacagtcaggaccctgagctgcaggtctgttggagtttgctggaggtccactccagaccctgtttgcctgtgtatcaccagcggaggctgcagaacagcaaatattgcagaatggcaaatgttgctgcctgatccttcctctgaaagctttgtctcagaggggtacctggctgtgtgaggtgtcagtcggcccctactgggaggtatctcccagttaggctacttgggtctcagggacccacttgaggaggcattctgtccgttctcagatctcaaactccgtgctgggagaaccactactctcttcaaagctgtcagatagggacgtttaagtctgcagaagtttctgctgcctttttttcagctatgccctgaccctagaggtggagtctacagaggcaggcaggcctccttgagctgcggtgggctccacccatttcgagcttctaggccgctttgtttacccactcaagcctcagcaattgcggacacccctcccccagcctcactgccaccttgtggttcgaactcagactgctgtgctagcagagagtgaagccccgtgggcatggaaccctccgagccaggcaccagatattatctcctggtgtgccctttgctaagacagttggaaaagcacagtattagtgtgggagtgtcccgattttccaggtaccgtctctcacggcttctcttgactaggaaagggaattccccaaccccttgcacttcccaggtgaggcgatgtcccgccctgctttggctcatgctccgtgggctgcacccactgtccgacaagccccagtgagatgaaccgggtacctcaattggaaatgcagaaatcacccatcttctgcactcctcacgctgggagctgtagaatggcgctgttcctattcagccatcttggaacctcctcccatgatgactataagggaggcttttaaatggtggaaatgaatggtttccaccaggacagtggcaagattcaattatcattttaaaaatctctgtcaagctacagtgtggaaaatggattggaaggagacaataatggctgcaagggtatcaattaagaggctattgtagcaaggatgataatttaaactgcaattggaacagaagatatggtaaaatgtgacaaatctgagagatatttaggttggtaattaattgggtaagagaactgtggtacattttacacataaagtcctaaggtgcagtatttgatttggtctataaattgtactccaaatcagctgatgcttttatagttagagagaattatctcagtagacgtaatacttctctttcaaaaactgtcatggttcttaatcatattccacaatggtcagtatggggatgtttatgcctcatggaatagagaaatcaaaaatttaaatctatatttgatgttaaatataaatagtatcttcttataaaaatacattaccattactcttagcttgatatattgtaaattgctttattcacctcctcagccatttttcatcagcagtagtatatgtgctccctgttcctggcagtgattcactggatgagaacataaatgtatttgtgggaatatgtatgaacgttgctctgggaacaaaagaaacagttctgttataccacattggtggtaatcattctttcccaaaatcattgcttgatcccttaaacaaacaaaacaatgtgaaataacaagcattgcaaatacctaagactttggtgtattgactgcctatctgtcaaatttgacaggaaggattaaccatggtttcaatatttacacttggattttgaaagactagataccaagttgatgactctttgaaaataatatagaaaagtatatataaatacataggtaaaaaggatgggacaaaagtgtcaatggttactgctgaaatatggttttggagtgcaagtataggggatttctgctattcattttatgcttatgcaatgtttaagttttaggagcaggtatcagtttctaagaaaaatcgaaaaaagagcagatatgaaaaacaagatcaataaaatagtttcactgtttaataatgccaggttagtgagaggcaacattcatcatggaaactaaatgcattacactagactttcactatttataattatttttctaggaccatgatcagactggcccacggtatataatctacaaattgactactgatattgtaagagggctcagccatattcaaataccatctattaaaaaaattaaatatgctaattcgccactacaatttaaaattcaactgtaggtaaataaaagtaaattgtgccaatatgcatgtggaattacttgcttctgatcaactaaaaaaaaattagtaagaaatctggtgaacatcgtattggtaaacaaaaacaatttttaaaggaaagtggcaagatccatgtccagtctgatccaaggtgttgccagaatggcagcccgagttgagagcagaaatgtgtttctcctcacacctttccaacttttaggctgtggtcacttcaaactaagaagcaaatcacatcttagcccatgtagtaatgaggttatccacactagaatgcataaacgtcaccttgtggcttgttaaaaacacagattcttgcccatcacaagattatattaaactgactagggtctctaatataatgatgaataaaaatggaaataataaacacatttatgatctcaacaagaaaattgttaatatttcaaattaagtatgaagtctgctgtaggactttttttttttttttcgagatggagtctcactctgtcactcaggctggagtgcagtggcatgatcttggctcactgcaagctcctggggttcaaacaattctcctgcttcagcctcccgtgtagctgggactacaggcacctgccaccacacccagctagtttttgtatttttattagagacaggatttcaccatagtggccaggctggtctcgaactcctgacctcatgatccacccgccttggcctcccaaagtgctgggaatacaggccgccctgcccggcccctgctgtagttttttaaaataaatatttatctgattaaggaagctcagctctattcccattttgctgagattttaccatgaatgaatgtgtttgtcaattttttccccttatctattgagatgatgatatggtttctcagttttactctattaatatggtaagttgcattgactgattttcaaataatcagcttgtattcctggaacaaacccaacttgataatgatatattattctttttatatatcactggatttgatttaccaatgttttggctaggatttttttttcatttatcttcatgaaaaaaattgaactgtggatttattttcatttaatacccctcatctttggggtcaaggttatgctggtctaatgatgtgagtttacatataactgatattgcttcttccttaaatgtttggaagaatttgctggtaaatttaaatgggctcttttttgtgggaagatttctaattatgaagctaatttctgtaatagatataggataattcagattccctaaaaatatatcaaatttagttgtatttttaaggaatttaaccatttcatttaaatgttcaaatttactggcataaaatcttactaatatcttttttagtgcttttttatttctgattattatttcaataatttctgctcttatctttattttcttctactttctttgcatttattctgtttcttttttagattcttgatactgattactagattactaattttcaggctttcttcttttctaagaatttaaggctataaatttccatataaaaactgctttagctgcaacatcaaagcttgatatgttatatcttcattatcagaaatatttttaatttttgttgtgattactttctttgaaacatagggaagaaaatattacctaatttccaaatattggaattctatcattatcattttattactgatttccaccttaatactactgtgaacagaagataaactctatggtttaaagcctttgacatttgttcagaagtgcttatgtctaggtatatattatatttactaaatctttaaaaatgtatatgcttatttggttgttgcagtgttctatacataagattaagtttgttacaagtggtgtttgaatcttctatatgtttactgacttttttgtttgttttgttttcagacagggtctccctctattgcccaggctggagtgcagtggcatgatcacagctcactgcaacctctgcctcccaggctcaagtgatcctcccacctcagccttctgaattttttggttttgtagagatggggtttcgccatgttttccaggctggtcttaaactcctacactgaagcgatctgcctgcctcggcctcccaaagtgttgggattacaggtgtgagctaccaggcccagccgtttactgacattttgtcttcatattctattaactacctgaagaggtatggtaaaatcccaactaaggctgaagatttgtatatttctctttttcagtgctgttatttgctttcaaatattttgagaccatgctatatgtacctatacatatagctatgtctgcttcttttggaatactgtgtgtttgcacaatgtttctctttttacaactttgaatctttatatggatttatatttagactgtacctcacatagttagcttatagttgtcttgttttaataatccagtctaataatctgtttttaaatagaagtatttagtgttttgtattaatataattaaggttatatttatattcttatcactatcttaatatattctttatttgtctcacagttttctgttcctaaattctctttttgtcttcaattaatcaaatatattttatattatccattttccccctctatcagcttggtaactgtacattctttaagtggttaccctggaaatgaaaatatgatttcttgacttattagaatctaccataattgatacttttatcctgtctggataaggatttcacattattttaacttcatttaatccactctcattctacctgttattgtttgttgcctttattttaattccacaaatattttatttttcaagctttttattatggataattcccaacatatacaaaaatagacttaataatctaatgaaacgttcatatttatcatcctgctttagcaatcattagctcatgaccaatcttgttccatctctatccccatccattttctctccaaatatattattttaaaacaaattccaaacatcatattacatttcttatgactatttctgtatgtatatccaaaagatgagtatgctttttataatatataactatgatgtcattatcacacatacgaaaaaataatgataatgggccaggcgcagtggcttacacctgtaatcccagcactttgggaggtcaaggcaggtggatcacttgaggtcaggagttcaagaccagtctgtccaacatggtaaaaccctatctctactaaaaaagtacaaaagttagccgagcatggtggtgtgtgcctgtagtcccagctactcaggagtctgaggcaggagaatcacttgaacccgggaggtttcagtgagcagcctgggtgacaagagtgagactctgtctcaataaataaataatgcataataccatcaaatactctggaaatactcaaatttccaaatgtctcaaatgtgataaccatttttataggtattttgaaatcaagagccaaataaattctgcatactgtgattggtttatttgtcctttaagcttaatttaacctattgattctccctcaatctttttttttttgcccccttgctatctatgcattggagaaaggggcttgttggaactgaagttttccacgctctgatgttttttcccccatgggtattgtattaaataaaatgcttcctagctgtaatttctgtttgtttgcagttagatctagaggcatgcagattcaagttcatttgttttgtttttggtaagattacctcatggctagtggtttatgttcttttctcttttcccataaatattcagggcctggatccgttaattcattaaaataaaaaaataagaatattacacttttaaaacatttattagcaggaatcctattatcaagagaaaattcccccatctatgtttacttagtcatacaagagatgtggaacaaatgcttgattttttacatttgtataccatttttcaaaacaacaaattggttcactaacatctttccatggtaaccaatcggttataattattcttaatgttatgaactcatggatataaaatatttgatgaatttgcatctgctgcagttactgtcaatgagtgcttaaattgttctatctttagttataggacttacactccactaaacattactttgattgttttaaacaatccatattcatagacacttacttatatatttatactttttggtgttcttcatgccctccttcatttacatgatttcaactgggactatttcctctgactgaggagctccttttaatagttttgatatagatatgctgataattaattatcttagttttaattttctaaaaatgtcctttttgaaggatgtgttcggtaggtataaaattctgaattggcaattactttcttttggcactttaaccatggcatcccattgttttcttggttccattgttttggtttaaaaattagctttatgtctcattggtgtgcctttgaaaatatatcttttttcctttggatgcttttaagatgcatttatttgtcttcaatttttaagcagttttactacaatatgcctccatattttatttggctttttttttttcttacacagtttcttgaatccatggcttgatgttattcattaattttggaaaattctttactgctattcttcaaataatacttatgccccatcttccctgaaatctcctcttgggcctccaattgcctgacacagacctttacactaaccaatatgtctcttataaaattttctttatttttgcattctcttttccactctgctttaatctggatattttcccttgatctattttccagatcatgaatcctctcttctgttgtgtcaactctattattaaacctatctacttagttttaaattacacttactgtaattttaactttcatgttgtacatttgattcctttcataggatctagatctctggtgaaattctctgtctcttcttgaacatattaatctcttatctgaaacagattatagctatagatcttatagctccaatttctcagtcacttttggatctgttacttttggttggttttctgtcttgattattggccatttgttcttgtttcctggcatgcctactactttctagtgaatgacagatacactttttatggaaattgtacaagttttgaatgatgttatctttctccaaagatgatttgattttcttctggcaggcagatagagtacaggaaaatcatcttaatccagttgaggctggtatatttccagtttgctcttaccctaggttgtagttcttcaggggcctcaaggaccttgagtatttccatggtcctacttctttgaaagccctgaactctgtgagacactgagactgctacaatatctgctttgccatttactcctgtatcagatattttcagctttatattttgttgtctctccctgggagtgtacaaaaaggcctcaagggaaaattccatgcagtatgttgaacttacatctctgtggctcctttcctctgggatcttgtttcctccagtcctttgttggtagccctgaactccactggtcaggaaagaatttaagctatttccactttagaaactaaaatcttaagttacgctccttgttgatgtattcatgcttttattttccctgatttttaatattttaaaagctggtcacattctcatcattttggtatgatcacaaagaaacatgtagtaatggaaaacaaagaagtattgaccttcactaggcaatcaaccctcagataatgtcaggaaatctgaagctttctcaagtaggagtatggaagagtggagaagggagatgtgttatttatcacagacaatactcagcacaattttattgctccttggggaatccaaagcttttaaagatgatattattatttggaaggcctccagagagcactaagtattaaaaatagcacctgcattctgctaagtcaaatcacctgtttattatccagggtgatgaaaatcatttaataaaatattacagacgcttgttcaaaatcatgcacacaattcataggctcagagacattaatgtctatgcctggctcactacatatttgttaaattgataactcaggtggacattagttaatattaccactttttaaaaattaatgatatcaagttatttgaaatagccagtagaaaacctctgcagtaacatttcccatttttcctcatacaaaatttacataaaacctttgctttgtaatagccactatcttttttctttagagaaccttctcctcctcctgcctttagaatataaatataagaatgtgactcaggtctggtcagtccctgttcatcccattggccagagttattggttcagaaatgagcatgtgatctacattattccattgagactcagtacttggattttatgaacactactggaaagagaattgctgctggttggtaaagggatagaatgaaagattcaatgtggttatcaccacgtaatgaagacctgcctaagactgaagccaaaactacttaaaacttctcagttacatgaatcaataaatgccctttgttgcctaagccagtttattaggactgggtttcagacctggaaccaagagttcttactaatatagctataccaaaaaagtgtgtagcagcaaccaagtctgtcaacaagagtgattaaccctcaggtttaagaacaaaactgaaaagacgcagtagcattaggaacatgtttttgtggtgataagatttattccagtccactgataatgttttactttcccacctacatttacaggatgcccaagacatgaggcctgaaatttatcaataatatcaaataacatagccccattcttgaagttccaaagttagagtattattggcatttttcacctattcctcacagagcttagttatttggggatgaagtaagttacagaagtttccaaaaaagaaggaaatctctatgtgtttcatgtttttaaaattctgtcttcggctttggcttaagttatggttactgatggtagctgtaagtaatattcccaggagaaaggctgcaaataaaatgagaattcctcagcatctttattgtccttcaagtggacacgaattcaagcaggtgcacatactgaggatcatacatttctactcatggcatttaattaggaggaaagtaaaatgtgcagggccagaactttaaatattagtttaataacctttatgcacctaatttctgaatgattttcttactctctggagaggcatctaatgtcagacagtggcattaaggtgaaattaaggtgagtcatggtaactgaaaagccatgaggcaggcacatgtcagaattattaattttaaaggatatatgaaatattttctcctctgaaaatatgcccagttaatgtatgctgaacttgaagtatggctttatttccctcattcacaactaatcactgtctccaggaggaacagactaaagagagaaagattacaaaagaagtatagccatttcaaaatccccaaacaaatgagaaatcaaaagaacaatgacaagcttgttggttatgtagagtaaaatttttagtgtgccaatcatggctgataccatgttttgaccatgtcaaaattcatcaaggcaggagttttcaaaccttttttgaatatgacccacagtgaaaagtatttctatatctatctgtaatatgactgtgtatgcatatacatttacaaaactcttaccaaattaaatgaactctcatattttctattctatataatttcactaaaagcaatccctaaattgtctcacaactcaccagtagcttacaagttgatataaaacatataatttgacatatattccacatcttaggctaagagaattacacatattcaaatcattaccaatgccaatttcagattaagactgttctgaaatgaaatcaaatcaactctttctacacagtggaaattcttagaccgtttattaacttcactaaatattttcataaagcatttgaagcaagatgctttcttcaggataacacctccaaacatactttgtatctttcgtttttctttttcttttttttttttttttttttttttttttgagacggagtttcactctgttgcccaagctggagtgcagtggtgggatcttggctcactgcaacctctacctcctgggttcaagtgattcttttgcctcagcctcccaagtagctggaattacaggcacatgctatcatgcctggctaatttttgtatttttagtagagacagggttttaccacgttggccaggctaatcttgcactcctgacctcaggtgatctgcccacctcggcctcccaaagtgctcagattccaggcgtgagccaccacacccggcctcagaacatactttgaaacaacccaatgcaagctcaccacctcaaatccagatccaaagacgacactatctttaaaacaaacaaacgaaaaaccatgtctctataaaaaggaatgaaacataatgtcacagggtgatattctaatgagacaaagaggtagtcccattatctgttttgttttacctggtggtatcaactgttgtttcatcactgtttctgtgaagaacatgttttcttaatgaacccttgagaaggacagtgatttgatgaatgaaagatgtgacacatgaaacaaaatattcctcattccacacctgtgtatataatatcatttggctctccaaattatcttaaagtttgaatctcatttcttccttcctcaatattttcttttaccatggaggcagggacagcaaagaaatgtttcctctccagatccactattaactgaaaattccagtgctctgaatacttgtttttttttttttatttttaaaaagggacctgaatttctattaaaggatttcctttattaactcctgctgaagaatttacatattggcaggttggaaagtaagccctgtaggaaagaaatcggacttgtttttcatcatcaacatgacggtctgatgatgggtgtatgagtttcctgttgacacccatgtcacatttactgaattactgttgagaccacagggtagacccagcttatacaattcttttgtcttctttctgcttcacagatcattcataatcacacacggggtaaaaaatgagggagcgaaaattgtgtaagctaattttcactgttgctggaagcggaagcaaatagttctcagagctgagagtgaacctgggtggtgaagagcagtcagcattaccggtggcaagttcagcattctgaccaaaatgagccactctgaaccctggtgttcagtcaatggcggtttcctcaaatttgtccttaaaagttgaaatgtatcatacttctgctcagccacccttaagaaacttgagtgtatgagtgtgtgtgaaatacaaataaaacctacacagctattgtctggattgaacaaacaagcaaatgtgctcagttttccaaacaattgcagatgctgtaataattcagaaaagtgtgtgctgagcagtgggggatgctggcatgctctgttagaatcattgtggctgggtgcggtggttcacgcctgtaatcccagcactttgggaggctgagatgggcaaatcacctgaggtcgggagttcgagaccaggctgaccaacatagagaaaccccatctctactaaaaatacaaaattagccaggtgtggtggcgcatgcctgtaatcccagctactcaggaggctggggcaggagaatcacttgaacccaggaggtagaggttgcagtgagccgagatctcgccattgcactccagcctggacaacgagagcgaaactccatctcaaaaacaaaaacaaaaagacagagtcattgctaaccatgttgcttagcacaattttggaaggaggcatgatgctggcacagaaaacccttgtcagaaattcctattccttaattttatgctctttctttcattcttttctcacttcattgtcatacaggcaagtgaaaaagagtggaaagagaagaggcggtgtcaaaggaaaagagaaaaaatacacctgactcctgttgtttatgattgtcttgtcagttaacacctgggcaatcatcaaccatgtactttccttgagccaggtccttaaagaacccaagatgaaggaagtagacagaagcagctttggggtggttagggtagtgcttctagaactttaacgtggctacagatttcttgggagtcttgttaaaatgtggattctgattctagagtggggcctcaaattctgcttcagttggtgatcttgttaaaatgccgtttccgattatggggtggagcctcagattctgcacttctactcttagggaaacccaagcctcagggttagtctttgagcctggggcagtggcctatcctgggcctttttctttacaggtatttcacttgactacttctccttttttcaggggcctgcagtaaagagaaataaagcatgacatagtctgaaaagcactggttctagaatcaaacaaacttgggttggaattccaactctgcaactgatttgcaatctgtgtggtcacaggtgagttttttgaatccctcttaaattcattttctccatctataaactgggtatgccattttttaactctcagggcagctacaaggaacaaatgagatcatgtgcatcatcaggtaggttcacattcattatgaaatgaatgactaaagagcctaaagcacaaccgttctatctacaggtaataaaaaggaaggtagggtgcaacaatgtttaaatacatctttatttttcttaataccatgactttggctcttccttagatctacagctatgggttgtgtagagttgtaaccacattaagccaagcatgtcttcccatttcgaatacttttctgactccagaaattcattctctgatcatgctttcagtaatgacaaaatccagaacagattgggtttttgaaaatatttcttgctatatcaaatgaggaaaatttgaaaatatttcttgctgtatcaaatgatgaaaatacatctgatgatttacttgccctcaattaattcagttcttaggcttgctcttctggacttctctggctcctgtttccaacaacagatttcccttcttctcaagctcccctcttcccagtctctctcctccaatctgaaattgggctccctttgctcccatagtaaataaggcaaaagtgtcccttcattcccatgtgatccagctggggaatctcagtttctctaaaggaatcaagaagatacttcagagttaaccagaggaattaaagaaaaaacagttaatgccagccttctccaaccttcccacatcagcagactgaacaaagcgctcaaaactcagggtttaataaagagggaaaaaggaggaggagctactttattgggtgtagtagagacaaagagggaaatagaagaaaattgtgaagtagtgacattagctgccatgtcctacctcctctggcagttctccagggcagacagggctggcagcggatgggtgttataactcctatggatcatgcctgacccttctgggcccgtcatgacttctgtttagatgacactaaagggtctcagggcagcatcagagcaggaaggatgtgccaaccacagaagtgccaactcatgacaagaatcattgctcattcagggattgctgcccctgccatcaccccctctgtcccaggatctgcattccgctgttctctctcctgcaagctgtgacagcagaagaggggcctccttcccattagctcatttccatctcggacttagtcaaaggaataaattattgtcagctcatctgtcttattagattgagccacatgatattgccatgttgttgctccaatactggcaatttcatgtgattcaacctcatctgctgtttagagaaaggaagtttcactgctatgaaaaactaaaccatttctgtggctgagctatgctgaccagaacagagttatctcaaattcatctactcaaaagctgcatattttaaactgaaatgcactgagcgtcttccttatccctactttccacatttctaagacaagataaattcagcaacattctttagaaaacattccatctccaacagcaactatcagtcaaacaacagggaatcattgtgcatttactctgtataaagcataagaaggataaaaaaaataaacacaacatcttttctgtccctaaggagtaactgacgtagctgaagaaagaagaggggaaaaacaccacaaaaaatgtaaagaatgaagcaacaatataaggaatgtcacaagacagaccatgatcatttgctaaatgagtggaatggaaaataagtacagtgagttgagaggcaggagcaatcacctagaatctgatgtgagccactttctatctaatttagctcatcaatcacctcaccctcccacctacttactgtgggaagttatcacagaaaatgaaaatctcctctctgcctactcataactcccagatgtcggttccagaaatgtatgcccagcaggtctcagaccactcccactcatttattgggtccatctcaggaaaagatgggggaatggggacatttacactggatgcttttctttctctaggtgaagtcagcatgacacaggaaaatgggagaaatctaaatgtgtgtgcctcaatataaactgtagccacctggtagcctagcacttttcctgacttcatgactccttttaattctgaatttcaacctttctgagcagttgccaatagtaaaaaaaatgacataaatttaagcatactacaaatacctgtttagatacaaatgaggtcacattaacacctcacagcccccctattttagcaattccctgcgtgctctcactcacacaatctcccatggtaccctgctcttcctctctgctgagggcctccctcttgaggacaatgcctagccatggaccctgtctctagtgtcctcctggagaagggtgtttcctttcccagggggtcatagccaagggctctgcaaggcagcagcagccctggctgccccagtacttctggcatgaaagccatgctgggatgttccatgcagaaatgcagataatacccttctgcccaacactgtcaccctctactgcctgggttgaataaaagtgaaagtttgctaaggtcccaaggcaacatctctgaccaggccttttctccttctcccctttcttccttccttttttttttttttttcttttttttttttgacagagtctcactctgtcacccaggctggagtgcagtagcgtgatcttagctcactgcaatctccacctcccaggttcaagcaattctcctgcctcagcctcccgagtagctgggactacaggtgcacgccaccactaccagctaatttttttaaaatatattttcgtagagatggggtttcactgtgttgcccaggctggtctcgaactcctgagctcaggcaatccacccgcctcggcctcccaaagtgctaggattacaggcgtaagccacggtgcccagccacttctttccttttttgagacagggtcttgctctgttgccagtactggagtacagtgatatgatcatagcacactgtagcttcaaactcctgggctctggtgagcctcccttctcagtctcctgagtagctgggactacaggtgtacaccaccatgtctggctattttttttttaagagatggggtcttgccatgttacccaggctggtctcaaactcctggactcaagtgattctcccaccttggcctcccaaaatgctgggatgaaagccattgtgctcagccctcaccctccacttctaatccataagaaagacgtgtcaattttacctacaaaacatccctcgagtcctccccttcactccatctcggcagataccctgttggttgcttattaattaccatcacctcttacctgggcctctaccacagcctcctaatgtcctgcttccactcttgcccttccagttcattctgcacaaagcagcaagagggatcttgtaaaaagactaaatggatcatgtcttcctagacttaaaacccttcagtgctttccctgctacactcagaataaagtcaaagcccttggccctggcctacggggccttccaggacttggccccagccttgctctacaggagactgtccagtgaaggttataaactcaaagtccactgcttcccatgagaagcctgggtcagaattctgggtcttctgtttaccatgtgaactgtggagctttgggccagcttcttagcttccctgcacttcagttcctacacatggaaagttacatatctcactggattattagaaataaagtgagatacaacgtatacagtgctaggaatattgccagtcaatagtaaatgcttcataaatataatcagcctggtctgctttcatttcttcgaacacatcttttccacttcagggccttccatttgttgtcctttctgctcagaatgctctccctcctccccgtttgtacagaaaggccttccctgactaacagatctcaatggggactctccctgtctcactctgttattctctgttgcaactcttcatttccttcgtatcacttgtatcctgtgataaactgccattattttctttctttggctattcactgcttattgtctttcccttccatgagactttaatctttataagtattaccattgaattccagtactagaacatcattttgactcagggatccttcaagagcttccatcactatttaaatttttacagtgaggaagtggatgaatcttactaatctctcatctcatggtctatttccatttggcttttacttaaagggtcctctttctgtggaggtcagaccaactctctggggcagggttggacaaaaaacaccatgattgactcagtctccccaactcccctgaaagtacatataagcttcttttcaaggactccttgccttcttggacagatatttaactaagtaacctctgatggctccttttatctcaatccgatttaccttctctcttgtgtgtgtgtgtgtgtgtgtgtgtgtgtaatgcacacacttactaagatgttggcttagcccagagtcctcagaaagcacagcctgaggcaaaatcttacataatcctaatttattggaatgtgccatccagggaaggaagagggagagaagaaggaaatgaggaagggacggagaacaagcagatagatacaagggtatatttctgagctggctgccactgttactcagcacaactgatgtcagatctccaggacccatcttctgaggcaggctgtgtgaatgacagctcctttggacaataagtcagggtaagaaggagatgaattccaggttgcacatacgtgggagctgagccatctagtgcatcacaggcctcagtggcaacatgggagccctgggggagatgacaggctgacttgagagaatgggagcagtcactgtaacagcctttggcccttggcagcaacaatgtcagcagcattagtgacctggctctgtaaccatgagagcagcacaaaccaggcaagcatacagatctggaggatggcctaaactaagtctcgtactgatgggtaggaaggtgatgactgtccaaatgtagtgtttgaggatggcaagcatgggacatataggctcaccactcctgaagcttgcactcatggcagacatctttgtactttgtactttgtctggctgagcccaagtacagcctcaaaacacttcttcatacagagctgtaatcagccactacatcacaacagtaatgcaaatgatgacagcataagataaaaaaaattgtaattcacacctgaaatgataaagacaaaaacagtataaagctaatgaaaatgatgaatttcagaaagtgaaaaatccaccaaagggaagcccttccagagcatcttccatctaacccagctccatagcccagaaatcagcgtctgtggatcttcttgatattgcaggaaaagagaatgccattcaaatgacagcttttccagaactggaattctatgtacaacctagcatcacagctctcatcattctgtatttgatgacagttttgtgggtttcatatcccaaaatgatacctgcctaattcacagagcaaagtttatttcatttaaagcagttctgatcaggggaaaatgtttcattgtggtgttataaggaattgatctgctaatgttcttcttaagctttgacattaattacagagaagatgcatcatcatttctactgacccttcattccacccccacctaccaatacacccacccaaatgttcagagctttgtatatgtgtcttaataatctgtcatccaatacttggcaagtgaaatgtgctatcatatggtaccaagaatgttcgcagctctggctaaaacttcactggatctgatatttaagccttagtggtgatctaacataggcagagaactgtgctaagaactgatagatgcagaagtgaataaaacactgcccctttcccttagagtagtaagttccaaactaaaggatagaacccaatagtgggtcttgacatcaacttaggaaattgtaacgagaaattttaaaagctacaatagaattgaatatagtagaacatatctcaaataataataaagggtatagtttcatgaaggggtgtgtgtgtgtgtgtgtgtgtgtgtgtgtgcatatacatgtatttctttctgtaggtgatctaacagtttgaaagcctaagttttccaaaggtgaaaaccatcattcaaacacataatgataaaaatttacgtatagagaatccctggagtcatgcagaatcaacattcagtatgcatacaggatggcagagattagtactaagggggcctgatattcaggcaatggtgagaatctagagtttgccttctaaagcccacattcctcatattactctctgctcagaaaccactgtatgtgcccccatcactacagaacgtaatccaagctcatgagtatggcattgaaggacctccaagcttatttcccactactcttcacctcctcccacaccttcttgatgccatactgttgctataatcatttttgccattttgaatgtgttctgtgtttgaatacgttctgtgtttttttacttctggacccttgcacaaactcttccttcatgctggaatgtctttccttccctatctgaccactaaagtaatatacttacagtggtcagcctttgttttgtctctccagcaagctatccgatcctccttctggtaataatattttctttcctttgagaaactccctgaaatttcatgggttctgtggtcaatcataatgccccactgcctatggccacaggagaagctctgtgacaaacatacagtgattggttgaaaaaaacaagcatgtgacctatggcagaacattatactctatctcatgtacagacgggtacaattccttctctgaattctaacagcagccctcaaaatacagtgagcataataattacctggaagacttgctaaaccacagattggttccacccccagagtttctgattggataaatgtaaattatggcctgagattttgcatttcaaataaattcccaggtgcgttagcttcctcctgttgctgtaacaaattaccacaaacttagtggcttaaaacaacataaatttatcttcttacagttctggtggtcagaagcccaaaacaggtcaaggtgttgacagggctgttccttctggaggctccagggtagaatccatttttttggttctctcagcttctagaggttgcctgcattccttggctcatggcccttctcttgcatcactccaacctcttactgctgtcctcagaactcctactactaacgcttacctcctgtctcccccttataacgacccttgtggttatattaggcctactgagataatgtagaataatctctcattctcaacccccttaacttgatcatatctgtgaagtcccttttgccataagaggtaacttaggcctgagtcctttcacctgaggattaggatgtggacaactttgaggggtcattattcagtctaccacaccaagtgatgctgatcctgatagtccagggtccacactttgaaaaccaatgaattactatcactatcaaagccagcctagtattttattctttagtctgtctgcctcccactagattaagaggttgcagaggctggaatagatcttggcctttttaaaaattgctttaattctatgtacattctcctttctgaatactggtaaatacatctttcagttaaactggaggaataggtaaacagtctgaaatgctgatagaaaagaaaactgtgaagataaaaccccaaagtggagaggtattggttaataggattatctggattccttactgccaacagtaaatctttctacctaattatgctcccaaatttcaaatttctctattgctgacaactatcgccattttgatgccccccagttatttctcatttttctcaaaccaaatttgtgtagctggccagcctatcctgagttctacctcatgggctctggatgtcagagatagcttcaccacacactcaagaactcaagccagaaatttcaccagcatcataggaatagccgctgacagttattcccccactgatatgtgcttggcaacgttctgagttctctgtgggcacttactcattaattcttaccattcttgtcttgtccatttaaaaaatatctcccatagtgctttacatgtagcatacatacactttataagtctacattgcttggttcattcagtagaccataagctccttgagggaagggatgggtcttattcatcatcttgttgccaggatgaaactatgtcacttgtacctcatattacatttgcagtaaaatgttagagagatgagaccatatgtgagcagttggaattaagtcagtcaagttgaagtggggtctaacatcaaattgccttgaaaagcaggcagaacttaaaacatgatataataggcatctcagagctagtgcaaaatcctaagcaagagcataaagctaatgttgggagcaggccccccaaaatctggccataaactggccccaaaactggccataaacaaaatctctgcagcactgtaacatgttcataatggccctaacacccaagctggaaggttgtgggtttagggaatgagggcaaggaacacctggcctgcccagggtggaaaatcacttaaaggcattcttaagccatgaacaatagcatgagcaatctgtgccttaaggacatactcctgctgcagttaactagcccaacctattcctttaattcggcccataagagatacttttagttaatttagtatctatagaaacaatgctaatgactggtttgctgttaataaatatgtggataaatctctgtttggggctctcagctctgaaggctgtgagacccctgatttcccacttcacacctctatatttctgtgtgtgtgtctttaattcctctagcactgctgggttagggtctccctgaccaagctggtcttggcaagctaaaatcattttatagagccaaatcagtaagtccccagtttagcttagaaacaatcagacaaggaccaaaggctttctaggaggtatgattctttgaagagacaagggagattgaaattgagtccataaaattctcttccatcttcctgattctaggtgttgaggtatctgtcctttgttcttggtgatttactatatctgattgcaacttagaattcaaacattaggctctgccttcttttccatccggattctaaaatcaatatctttactatgacgcttattcccaggattaatttatgaaattgtatgatgtgctttgaagactgaaggcttcttagagagagagggaatgtcaccttgtactatcaaaccagtatattaaacagttactgctttaaaaatcagatgtttgttggttgagatgctattaaatcttaacctacaaaaccagcacatgatcatttcaatggtacaaaggcaaactaaatatagcagatgacaattgctacaacataagagaaaaaatgtaatgtaatattttaaccatttagttatatgccacatgaaaataaattcttataaagaataagttttagcacttgccccatttgtgtgatagggtacctaccatgtgccaagggctgtgcaatactgtgatgaacaaaagaatccctacgtgatggagccatcaatctagtggacaggatggatatttaataattatgaataattactacataatcacaggacagaataaaatgaaggatttccaagagcaatgtgaacatagaaccaaatatggagcatatctgaggaaacaagaggctgtccagaggagaccatattccagctgagattttaagggcaaatgagagctgacgagcagcacagaaggggaaagaatcttccagcatttgatcggcatgatacataaaaggagagtagcagggcatgggctgggaacctggaggcctgttcaagactgttcagccttgacaaggtaaagggcaagaggtgatatatttgtttgagctgaatctctcagcattttgcatctcaagtctcctagttttaaacaactttctagagaggaggctgctctttatagaactgagtatatggaagacagccttgagaaccttaaattcaatgcactgtgtagaatataaccatgattctaaacgatacttgttaaaaggcttttttttttttttcaaatggccatggctttgttaaaaaaaaaaaaaaaaaaaaaaaaaaaaacaagataatttggtaactgagtagagacaggacaggtttttctactgaagtctttggtttatggatacacctatagtgttggaaggaagcatttgtattttaaggtatctttcctaggtttgttgctaagttcatggacagcatacccccatgaagatgacaacacagttcttctaagacattatttatttatgtatttattttttaggcagagtcttgctgaagtgccataggagtgatcacggttcactgcagcctcagcctccttggatcaagtgattctcctgtcgcagcctctcaagtatctgagaccacaggtgtgtaccaccacacttggctaaattttttttcttttttttttggagagacaggggtcttgctttgttgctcagtctggtcctgaactcctggcctcaagtgatcctcccacctcagcctctgaaagtcttttaagatatcatattacggaaactttaattaagctcttgctacatataagacactttgcttaggattcaatgtatatctttcatttaaccttcacaacaactctaggaggtaggcacaattattattctgcttatcaacgttgtcaactgaagttagaaaggttagtaaatctttgaagttcacacagcaagtcagcagtgaggctgttaatccctccccactgttaaccaggaaaactctacttctgttaaattctgatcattttttgctaaaggggttagcagtgcttttgactcttttatgtttccctttgatttaccatctaatggttattgctacagtgtttaataagcaatgcattatccctgggcagtggaagtaatatcattactcagagacggtaaacagaagtttgcatctgtgcactgcctggaggtggaagcatcaataaaagcctgaggtggaaggaagagatgaatgtgcaggcttgaatcagaggcaagggacgcaatttgatgtggggtaataagaaattctgcctaggctagcaaagaaacacaatcctttaccactcctagcctcaactgcactgttagatttctcctaacactgcttttctttgctccacagggtacaacagtcccagccccgcccatcacacccacaacccttatgtacgcccaagggtgcctggcatgcaagattctaagagcaatgggttgcaagtccctttgacaaagtttgcctggggaccaggaaatttaagtctacatccgaggaccaaagatatttaaattaaaaacttcctaccaaatccaacagcagctaagagagtggcgaatgcgatattacagaaattggtctgcagcctccaaatgccaaagtggcagcttgttatttatgataagataaggagcagctcgttactaaagatatccatgtcaaccccacgcattgagcagaacaaaggatcgttaatgattcctgggcttgtcatgttagaatggggtggcgatgataaaagagcatctatatatgctttccttgtgacatttcttatttttaaactccaatataaaaatatgtgttaattgttatgatttgtgtcacatgctatgctccagggctggacaggaaacagtgtccccattctagtatttttataataagcaataaacaaacaataaacaatgacaacaagaagagaaccactttccaggatcatatgattagttctgacatttgggaaattgcttcattgccagaagtcaattcccgcgattgcgagcatcttccacacataaaattaataatgtgcccagctcccctcctgccttcattttattatatgaaatttggacctcccacagcatgtaaagtcacatttttaaaataaaactttcttcctttataaaatatataaggaaatgtcttatagagttacacagacctttgaaaacatacatttttccattcctttgtttattcaggcaatacccgtttgagtacctactaagcgccaggtacttttctagagtgaatatgacaatgagggaaaacagacaattattaatattccaaatgaacaaaataagtttggtagtagtaagtgttgggaaaaaaataaagtaagtcaacgtgatagagagacaggtccttcctaatggggacgggggtggaggggcggtcagagagggactctctaggaaggtgacatttaagcaacaagttgaattacaagaaggaatcagccataaaaagatctggagaggagcattcctggcagaaggaatggcaaatgcaaaggcccagtgccggggacaagccgggcttgttcaagaacagatgaagttcaatgacccgagggcattgaggagggcccagtggatgcgggatgaggtcagggagtgggggcaggagcagatcaggtggggccttgcaggcctaatgaagacttagtattttatattaatgacaaggacagccaccgaaggttcaaatctcggaaatgatagattctatttgatattttaaaaattacagctgtctgggcgtcatgggggaagaaaatggacaaaattgtgttccactcaaagatagcatttcccttacagatcccaaggccctgtctttgtcagtacgggtagtgattaagaacatagtgctagtcagaaaacctaggtttgaatccttgctctgccatcaatatgccatgtgatcttagggactccatcaaacttactaaagtcttcacgtgaaaactataataataactcttcccagagtcttggtgaaaattaaatgagatataacacataatacagagtagtgttagtgcctagtacttgatacatataataatagctgttgttgttattattattattattattaaaattaggaagaagaaagagaagcataaggtaaagcactcagcaactactctgatcattcaggtgagaatacagacttatgggagacaggatggaggtttccatcagcatagagcatctctgtgctccaggcccttggacaaatgtcacctctttaatgtcctgaagacattaggtagaatctagaccaaaacagaattctggaaaaactggaaataattcagatgctcaccaacaggaacatgaatcttgatatcatggatgcaactcacaaatatgttgattgaggaaagctagacaggagagactacatgctgtgtaattccatttagatgaagttcaagaacaggtgaaactaactgctgttggtagatatcaaagcagtggtaacattataagggaccgtatttggaaaacatttggaaagagcacaagggagcctgccagggtgctgaaaagtgctctataacttgatctagatggcagttacatgatggatatacatatgtaaaaatatcatcaaaccatatacttaaattagcatactttataaacttttactgatgtatgtgttataccttaatttaaaaaaatatgtatttcaggggatcagaaagtcagctacataaataaacaaatggtgactgctctcttcaggaaaacgatgacctcaggactacttaggagccagttaatttccaaagctacttcccgtttctaagttaaacagctctgcacataatgtcagccacagcaatggcaaagaaccgcagggcaggtgatgaaaaagctcggcttagcagcaggacaatggggaagtgtgttaaactgggaccatgaccaacttcccaaaaccctctctggtgattgccagtgcctgcttaatgccttacctttcaattgtgctgaatttgtctgcattaaatgaaagttcgagggggcaggatcacttcttttttgttttagaaatatagctcaagtacctgtgtgctctataaagaataaaaataataacaggaggccgtggaacaactgaagtatggaacatgtatttagaaagtactttctggcatttcaataaaggaaattcagagggcttccagcataagaacaggatccgaatggattcattttcctgatagagtgacccaacccacaatgcaaagtcattaagtcccatcgcgtggcattaaaaaatgcttttaagctaagatcagccgaaaatgtgcccagggcagatttttatggccatatcatcacaacctgaaattcaaattggtgaactagctagaaatacatgctcactagaatggttcagagtttttctgcatctatctcagtgaaaaatgttagcaaaggaaaccttattttcctggaaaaacactatcaaataataaaacaattcaggaccagttttcacaaagtaataacaggccatacataattgattgcctttagtcttcgtctctgggtattacaaatcacagttactagcgcatcgaacaagctttcattccggattcagactgtccgtcttggcactgcctgaaacggcttgagcacctttattgcacactttactgcattgttcttcagttgcttcttcagtgaagttctgctatacccaacaatgttataccctccttctttctgtgtgtttactgactgtccctgatggtaggcaaaaagtaacttctagaagggaactgatttagacttatgatctcacctcaggcttgcaaggcaatacacaccacccagggagataaaacatattcctatgaaatcatatcctaactctctccattaaaactctagaactgcactaaaagcaggaaagatatactaaaattataccaattctttggcttaccaaacatcaggcagctgcatccataaaaaaaaggaataaataattcattccaaaactcttttttgcacatctcaaggctcataacattggtttgtaggaggaggtctgaacgagggcctagaaattctgagttatgccttggctataacaggaacctgatccctctatcttactctccctttgtatgtacggctaatgatatacacctgggctgccagtgacagtagccatgagccacgtgcctattgagcacctgaaatgtgagtagtctgaaatgagatgtgctgtgagtataaaatacacacaggatttcagagatttactaccaaaagaagaatataaaatatgattctttaataatgttcaaatattaattacatgctgtacatgccgaaatgataatattttaaagatattgggttaaataaaatatactatttaaatttatgttacttcttccattgaacttttttaatgtggttattaaacatttttttaagttatgtatgtggctcacatgtatttcatttggatgacaatgatctagatattctgaattgctatgaaagctaagattctctccttgtggaaatgggtaattacaagcctaacagttacgcatgtcttaaaggatggagaacgtgggggaagaggaagcaatcaagtcaccaagtgtattacatatttagttatacttcaattttcctaagcacattacaaaaagaatggaaagaaggaagaaaaacatgcacagtccttcaccctcctgagacagaaatgagactgaaaatggactttgaaatcaaaccatttcagattagaattctgcctctaacctcagtttctccatttgtaaaatggaagataagcatactcaccttttagagaattaaataagatcatgccgatcaagtacttaaagcaacattgggcacggttgggaataaagatcttggcaccggagatgttgaacctggagcggaagggacattgagaccaaaatgtccattgggcaatgggaatctgagcctggagaccaataaaaagatggatagatgcaagtgtcctagcaagcaagccgcacaggtgagaaaacactaaaaccaggaagggagctggtgtcacataagcagctcacacttcatggaaacatcacagctgcagctgagctccagccagtcgttcccatgaaggaataataatggtacagtgttgccaggttttccaattttctaagagaatctagaaatccagctttttaaatgtttagaaattttaaaaaatttagtttaatttaaaaagcactcattattccagagagaacccacgggaaaatagtttaataccagccaggcgcggtggctcacgcctgtaatcccagcactttgggaggccgaggcgggcggatcacgaggtcaggagatcgagaccatcctggctaacacggtgaaaccctgtctctactaagaaatagaaaaaattagccgggcgtggtggcaggcgcctgagtcccagctactcgggaggctgaggcatgagaatggcgtgaacccgggaggcggagcttgcagtgagccgagatcgtgccactgcactccagcctgggggacagagcgagactctgtctcaaaataataataataataataatagtttaataactctgctgctgcctcaaaggtcaacaaggtaacttgttagatttctaccatatgaaagttaacggggatctcagatgaaattcccacaagcccccaaacagttgagctgccaaagatgaagagggagatttacctcttcctcctcccagctcttcatgctgtaggaacacagttgctgcgactacaggtgtcccagcggtctttccctctccccagaccgtgacctggatgttatgcagaatgtttcaaagagagctgcaaaagcacaaggactttttacaggagacacgtgacataaaccaaggtgctactccggctattatccattgcccgctttaggtctctctggaatattgtctgtttccatttcaggcactctcagctactacccattttggttaataaattatcatattgtgtaaatgtatacaatctgtaagcctggaagaactgtctggaaaaaggatttttaaaatatcacactaaaaaaataaatactagtggcctctctgtatctattgtaaggagtaaaaggatttacacctgaaaaattaaaattacagtagctactctttcctcaagtggttcttagcaaatgcattttaaagaggatgactttccagtgaacactttaattttaatttaaccttcccagaaaatgaagtgctttgtgtagattcttttggttttatttaaggcataaaaattagttctgaactgtgataattgtgggcttaggaatgtaatcattccaagcaccacttctcacttgcttataagccctacaggtcttgagttgctgtttattgctaattcgaagttggcaagttatttaactgtgaagctgaacttgaagtcagagtgtgacgagatggtgggaggtagattgttttgttttgctttcaacaggttatccaaagcccggatgcaaaatgcggtgcaagacacggttctagatatgtgctcctctaactcttaatcttaattaaaatgggatgatgaaatgttctaaaggtggaataaaatattacattaatctataactctatcttgtcaaaccaaccacagataggatacaggttcctatcatccacccttatgattttgttcttaattgtggcattttgttgttgctgtgaggactcaacctaaatactattgcttctatttgattgtttaaaggaaaataatgtaacaagctttggtcatgaaaaatcgtaatgtccataatacagtagatgcagcatttctaaacattttagaattacgtgtttgaatccacgaccacatactcacatacatataatcaacattaaccaaagggtcatatggcgatttttttcctttataataaagagatcctctgaaacattttaagataaatgaattcctgcttaagtatgggtgcatttgaagtgagaatgctttgaataaagttatcattttcacacaccactatgcctgaaagttatgagcattcagacagaaatcattgaagaaaacttaataaaaatatgtttggcatatgccgtatttagtgtgatcaatagtgtttagtaattcaagaaatgaattaaaatttcaccctcattttgccactcctaaatttccatttgaaaaacaataagagaaattattaactccctgaatatttctaatgggcttctcagcattattgagtaaaactaactccacattgcaggcctgtgtgctgactcaggtttccaaggtttctctgggaactctttggtctgttgttgctgttctttattctttattgaaaggcatttcctagtgcatttcctaattttaggcacctggctagactttggggatgaaacaatacatgtggcagaatccctgcccttgggtgccttaccctctccttcatacagcatctaatggatccaaaaccagggagaaggtgcacctcacagccacaggctgcaacagagaaaggtaaagtgctggtactacctggtttgtgtttgtctgtctgtctctttcttttcttctttttagtaggtgtcaatattttacataaagatctaaatttctgacttctcttaaaaaaaaaatcagaagatcttagcatactggaccagaaagactacttggcaacatctggctgaagctgtggggtgggagtgttgaggggggtgtggatggtgcacttttcctagtcatctctggatcaaaactggctctagtttgccagtgttcccaccactccctatagttttatactcactcatatccattacctgctttgtcctcgtattacagtatttacattactgacctgcaagaagtaactagcagtcagaaagcctgatactagcccttggtctgctgcttattaaatatatgacctagcatgaattcgtgaattgcataatgccttggagcctcagttttctcttaaaaaagattaaagacaaaacaaaacaaaacacgccttctctggcactgcaattgcaaatctccaaaaagaaatctatggaggggtttccaaacctggaaagcattaggccaaggaataatattattgtaattttgttttcagaagaaatatctagaaaatcagaaataacagcctatatctgattatacctataaagatcacaaagcactctcaactgaattaaatctcatgtgacctctgagataaatatcactttagccattttgatgatgaagaaactcaggctgaaaaggaccaagggatttgccccaacaccaaatgctgacatttttaaaaagtcaactttcaagatagttcccataattttaacacctatgaagacactattaacaactgacatcacatgatgaaacaataaccagtaagatgagccatcactttccaaggatatactctggatagagagtagcagcttctttgagctttcgtttgtttgcttgttattcaagagcaacattttttaaagggtattacatgttgtaatataaaggaaatattttaagtaaatatttgtaataggtactcatttggacttctaataaactagtagggttaaagcttttgaggacgcactttctcattaaatgtttgtcaacattacattattttcttagagattgtcatcagcaagtaacttctatgagaaacaaatgtccttaattttattaaagtctacttttattaatcccctccctacccctaattgagctaatttgaaccatagtgccattcagaaagaaatatgagaattcatctggctcattgtcacatacattttttccacaaagaacctaatagagttaaaagcttgatttaaacatgaattaaaggtttatcatttacctttaggaacaaactctccataggaatagtaagctcttttaatgcatttacattttattaggcttacagacattcaatttattggtgtctttaggtacacatttactgcatacagtcaaatatataacaccttcatagtaactttttttaaaaagagaaggtagacttatttaagttttttcatggttcaccataattcaggtagcgaagtctaaatgaacaagcagagggcagatgagtgactttaagtgcacaggagatctccacatagtaatttagagacaccgtgggaaataaataaggagatacgtgaaagagtaaccagctcttggcaggacatgtatatgactgagtaacatgcaaactactgtttatacattgcaatcagctggcagccaagcaaaaagcttatagatgagtaaggacactgccacagccatgtttttgttctgaacctcctgattaaacaaataaactcagactagagagccacatggagaatacaatgctagggatacaatacaatagaatacaatacacttagcatgcagggtctaaatattaacagcaactgcagaagatatcactgcagatttgagtaaactttctgaaacaataatctacaaaaccagctgtgtttggtgatggctcttcataaaaacaaacagttgcaagaaatctaacaggattccaagctacagttcttagcttatagatttcaaacactggagagaaatgcataacatcccagctttttattctccaaagtgaagattttgaaagcaaataggattactatctagtatggtcatcataacattttttaaaaagacattattattctggaataggaagtatatgatctccttacaatgaacaattccatgtagaaaaagatagaatatctgcaaagcacttttgaggtaggttaaggtcctgggaaacagattcctcatgcatttagcttgaagaaaggtttaaaaggaattctttagggatcaacacctgcagaaggaaagggaaatagaggaggaagcaggtgagctgaaggagaagtcccaatggtagcttgtggggaataatgaagatggggtgccttagcgcattctggcagttgtaaaaaatatcataaacaacagaaatttatttatgatagttctggagactgggaagcccatcaaggtaccatcagatttgatgtctggtgagggcccacttctggttcacagatgatggcttctgtctgtcctcacacagtggagggactagcaagctccctggggcctcttttgtataggcactaatcccatccatgagggtggaaccatcacaacttaatcacctcccaaaggccccactttgagggttaggatttcaacatagaaatgttgggggtacacaaacattgagaccatagcatggaatgtcctgagtgagggtgagaagggaggggcctttttaccctccagtgatcagtcactggaagcaggccacctcatgaaggaggtatgcctttgggagagggttgtctatgggcagcaccacagcaagtagggtgataagcccttagctcctaaaggaggacctgagcagtgcattacagagtccatgcgacacttctgttccaggctagataaaatatttttaagctctggctgtaaggacagtcacctttaagcttttaatcttagacaaccatcataatacaagggctatttgagacacaatggtaagacattaaaaggtcaaagcatataatgctcttactgtccatcagataacatctccaggaaaatcagtcctgctgctctttgataccaaatggcttcttaggtatcagatctgctggcttgttctgaaaaaaggtagagtgaactcatttttctctactccttccctctaaataccctggaagttattcaacgggaagtgataaagaactctaaaacctggaaaaaaaaggagatagaaactgactaggggccttagcacttgagggacaacaacctggtgagttccgtggggtttcctttttatttccaatataccctatgccgggttccagagacggctgcaaccccaaaacagcaacagggagagcctgctccctctggtcaaatgaccagtaaagaagtccagtagagacctagtggggaagccccagccccagcccctactctaccactagggcagcgatgggcagtgaggccctaggccatcccaaccatatatctgacaaagaattactatctacagtatataaataattctcaaagctcaacagaaaaaaaaaacaataaacagttagaaaatgggcagaaaatatgaagagacagctcaccaaagagcatatacaggtagtaagcacacaaaaaaatattcgacatcattagccataagagaaatgcaatttaaaaccacaaaaatattgttacatatctatcagaatggctaaaataaaaaagcagtgataacatcaaatgctggtgaggatgcagagacactagatcactcagacattgctgatgggaatgtaaaatggtacagctattctagaaaatagttcagctgttcattttaaaacaaaaaataaatttgctatattacccagaagtggcactctcgggcacttgtcacagagaaacgaaaactcatattcacacagaaatttaaacatgaatgttcgtagcagctttatttgtaatacccaagaaatgaaaattatccaaatatccttcaatggataatggtcaaacaaactgtgatataacataacacggaatatttcttagcaatacaaaggaatgaactattgatacacacctggatgaatatcaaggaaattatgctaagtaaaaattaaagccaatctcaagaagatacatactatatgattactttaatatagcattcatgaaatatgataatcatagagatcaagaatagagtagtggtggctagttgttcagaatggggtagggaataggtgttgactctacaggggtagcatgagggagtctctgatgatgggacagtgaagtatcttgatagtggttgtggtttcatgaagctacacttatgataaaattgcgtagagctacacatgcacacatatacacacacaaatgagtacctgcataactggtcaatctaaataagctctatggatatgcattgtactaatgccaatttcttggtttttatattgtcctctagttaggcaagatattaacattggggaaaactggaaaaagggtacacaggccctccctctacatttctttgtttgtttctgtgtatctactgttatttcaaattttaaaatttactttaattgacaaataatacttgtatatatttagggggtgcaatgtgatgttttgatatatgcatacaatgtagaatgattaaatcaaggtaattaacatatctatcatctcataatttatttgtggtgagacatttgaaatttatactcagcaattttaaaatatgtgatacatttttatttactatagtcacaatgctgtgcaatagatctcaaaaacttattcctcctgactaactgcaaatttgtaccctggtttttgcttttatttttgagacaaggtcttgctctgtcacacaagctggagtgcagtggcccaagcacagtttactgcagcccaatctcctgggttcaagcagttctcccacctcagcctcccgagtagctgggactacacgcatgtgccaacatgccaggccagtcttttactttttgtagagacaggttctcactatgttgccctagctggtttcaaactcctgggctcaagtgatcctcccacctcggcctcccaaagtgctgtgagccacaggcatgagccacaggcattagccactgcacctggccactttataccctttgatcaacatctccccattccctctccctatcccccagcctctagtgaccaccattccactcactacttctatgacaaaaattaaagtttgtttcttttttttttaattaggcccgttgattgctcagggtaagaaatcgtaataaaattctaggtatttcttcctttgcaatgtgccagcatctgcatctatcactggaaagtggattgcaaacccatctcagatgcccacacctccattaacctctcctactcccggcccaatttcctgctccataccccttctgatagttgcttgcctggaatcccttcaatggcttagcaaactctatggcagttcctgggttgcacttcaacactttcttgaccctggcccacctctgttgtaatccctttctcaaggtctggtgcaattaagaatgctgctgaaagggtttttgttgtagttcgtgcctatcaaacacagactattctgattacttgtggcattttgcagtgatataaaattaaaactaaagcacaggagaagaatcttaggtttttatataaataatttattgtctataaattctcccaagaggaatctatgtcagtctacagaaagtgtctctccattgagacccataccatttgcctgtaaattcagcacactgatagccatttgcaatctgcaaaagaaaagccatctatctaaaggggcacgccacactgttattcctttgtaatattaagaaatttatcctaatttaaaagataactgaattcttattcttttacaaattagactttaaaacacagccactgaattgaccaagcactaccaagcttttatcctacttttatttaaatgtactgaaacattagtgatgaaagctttcatttaaagaattctgatgattctaatattcacttataatgtccatttagctaccacattgtgtttatgccccttaaaagctgaagctatgactgctctagtactgagttctccagtgcttatcattaattaaaaggtaaaacacgattaccagggtatctgcaatcaagctttcaatgtaagaaatatcaatatccagtacttgagaacattttggaaccaattttaataggtaaaaaagtccaaagagaagaaaaaatgttctttattatttcaaattaaaaccagatcagtatatcttactgaaaagttgcaattgcccatgccttccaggcatctgcctagtttttctcttatagcagatgctaaagaagagaaatctggcatgtccatttctgtaatatttacagatataacacatcagcaatacatcagtttggttttttatggaagctaacctcaagaagcaaaacatgctctgtgagtgtacttgtgtacttacttcagatcatccttatgcttgggggtgggcagacagattattaaataatgactgtactgagtgtctactaagcacagtggtgtacttgtgttgagggcaccgagacgaatagaagaatccctaccctaaaggagtgcaaaatctagtatcggagccacatgaatattgtgcaagtgaaagaaggtgagcacagattatgtccatggtgaaacaaaagttctgaatatctgttgagactgataaaaatagatcctgctaatgttaatggcaaaaatggcctgagtgtctttagctccccaatcaactctaccagtatccacccaagccaccccaaataaagtgtttgcccagtgtacatatgcagtttcaaaaaagttgcccggtttctcctcttctgtattggtaggaattgagcaggacacagatggcccactgaaattagaataatttgaggaaggtttaataaagggactatttataaaactttgggtagtatgtaggaaaaccataagggacattcaacactctggaactgttatcatcacacgacataaagggagaaggggaaggagcactgaccagaacttggaaagagaaagtctggtggagaggtcaacctcgagaagagctatctgctttgatagaggaacatagccagctcaaagggaccccacagggagtgatccaaggcaactaataccttgacctcactctccttccattttccagtctcctgcttgggtccccccattggccagaaggcaaaaaaacccactgatgaagcatacaggtcagcaggtggaaaaggatagcatccctgattcctggtattaagaaaatcaatcagccgccaaccgcagagaactgctgtgaaaattaaatgatgtaaagcacattatgcactcaaacatacctcaaacatagtaagtaaatgagaaatgtaagttgttaaatatataatatgggatatttttcattatacaattcaatatagcaattatctatgcctcccaccattttctccccacatgagaggtacagcagagagggagaagaaccaatgtttcctgggtggctagtatgattgcagcagagtgctaagcatttgctatatatcccatcttatttcattctccctagaaagaatgtgataggaattattaagctcttaggaaaggtgagtaaatgaagctcagatatgttgcctataattattgcttataattaggatctcagatctgtcaaattcctaagctaatgacttctccattattttatgtagatgggctacctgtccatattagataattttatttttatcacgttgaggggaattagagaaaaacttgctaaaagctaagcatctaacttagggcttgccacagaagagatagtcagtaactgctatatatgatgatgaggaggagcaggatgataatgattgtgatggtgatggtgatggtactggtgatggtgatggtgatggtgacaatgataattatggcagcggtgacaaatgatggtggtaatagtgatgataagaaccaccctactttaacctaggagcaaagaacttctgcaacagacacgaagaattccttaaataaggtttcagtatatagttgaagtagtggaactgataaatatttgttaatcctggtccctcaatccaagaagaagctttttcagagcaggctgtgtggtgcatggctgggccactatgaatttcggtttccctgtgtgtgaaacgcaataattatatatgtggtgcctagagctgatgtgaagaatgaaaggaatgcatttagaacacttggaacagcctggagcacagcgaacactaggtcaagatagccacttactgtcggggaggttagttccaacatggctgggctctcagcaagtcttcttttgaggaaaggacccagaagtggaaatggcccctctccttactagctgtgtcctcacccactccactcatctacacagtttagaatctgagggtgaaagaaggaagagcaggcaagggaaggcagcagtggaaaacagctcttgggtggtaagtagggagcaggaagagcagttaccaccatgcttaaaacaaggtttttaaaaaaaaaaaattgcctgaagtcacatttgaaaataaagagcttggtaaacatgctgatggcaaagagaacttgtaaaacagtttcacttgaaaaaggccaaggttaatggtataatttcaattttgaaccttcttttaatatggattagtgctctcaaatatgggatttgacattaagatgccaaaagaagactcagaaggtaacctcaagcagtattttttaaggaaatttcttccttttatcatttgaacgcagctgaacaaaaacgttattaaaaattattctgtcataaaaacagcaacatcaatgaccataacaaatgctaaaaagcaaaattatccatgaaattaaaaatatttcacgaatccaaggtgagaaatattttagggatgacacttggcacttgagatttatgtaatgagacattaccaacttttatgtataaaatttcctttctgaaaaaaaagtatgaaaaatcaaaagaaggcaccaaaaaagtcccccactgatttggaaaacatattcttttttttttttttttacaattaactgcatttggagaactgcatcacacttttaaataaaatatacataacacattttctctttatagaaaaacctttacaaacccttaagtttgctgaattactgctgaaaaagtatttttgaaataaaatatacagaatgaataaagcatctttactccattcttcggaaattatctagatacaaatatatacatggctaagttcaaaaacttacatagtagaaagtttaataatttgatctataatattaagctgttgatactttcgattggaaagaaggaggggaaatagtgaaagaaaaattaaccacagaatatattctttgcagtttgagatataaaatgttttatcatttacattaatgtgcataacattttaatattaattgttgcctctttcatcttgctgtcttattttttaaaagcttatcatagaaaagtctctatatgaaattgttcatccaaacagataaaaagttggaattataactgggccaatgaaatgttgttgttttgtattttattgctttgcttcttctttagtaatcatctttgcagtctgtctaaacaattctctgtgcactgacatttgcaataatgtgtttacatcacaaagttagaccctgtcattcgatggaacaagaggctgtattttgtagcccccagacactctgcataacttactccctctttggcctgagagtgtaatcgttttttcatctg

SEQ ID NO: 362 - DNA, 16479 bp, Homo sapiens
cacaaaatatgctcccaattattcacatcttctggactttatcacccagaattcttttccctctcccccttggctacccacttcttggcctagaccgacttctagaactagtgtctggtagccagtattctggggaagggagtcccttgggggtagtgtttgagctctgcacttcccagggggagaaggtcctgttcccctgcttcaggtcctgactttccccactccaaccccagcagccccatccggatgtttgcttccttccacccttctgccagcaccgcagggacctctggggacagtggacccccagacaggtgagattctgtcttctattaccagtgatgctcttcttcccctctatgtgctcaaggctcttagtctctaacactgtttctctgattcacatgtgctctccatttctgcccatttcttacaattgccttctctccctaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctgagtcattctgaaagatgtagagaatacagggactagaagcacttatattctcccaacaaatttgcatacatgacaaaaaacaggcaaaaggcagagagacccaaagacgggatttattgggggcccagtcatcacctggaagtcagaaggcgttgaagtatcgcggggatcttcatgatgagcaggaacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgtgtgaacccgaaactgccacttgctggctgaggagagccgctgcggcgttccactgtcacgtgagggggccggtcctcttcggcggcggcactcagtgagtgacgccaagtggccaatcacaggccagcctcgcaggccacgtgaggcgagagctggttccaggaaaggggggccagagaccccgcagagtcgatgcgtcaggctgtggagtggggaatcatccttaaaccccacaatgtgcctagtgacctcccctgcactgtttccgaggtcttaaggagtgggagggtctgagaaggacccttcaccccaaactcaggggttaagagagcgccccctgcccttttagttgggcagagatatgcctgggtttgggaatgaacaacggtgatctagaagcccgctgtccctgggtagcagggagtgattaggcaggcacgggcatggcaagacaatagctagctgaggaaagaagcattttaaaacagagcgagaccctgtggtagaggatggtgaaaatggggcctagccatcttaattgaaaacccaaagcttgagacagactactgaatcagagggaaggagaacgagggctgcaggatggggacagtggtgatggtccttctgtcccctcttccctgcctattccactccccaggattggtccacctctcagcctcgggtctcctttccctaacccatcccccaaggagccaggacctgccctacataacttccctggggcccaagcacatcctgtgacccaaaaatggagagaggggccaatgagaggcagagaggtgggaggaggtgcagagaaaaaagctcttgccactgcccccacccaatatttcccctcccttcaaggtctgaggtcattggtctggtggtggggatgcctcggagtttcccaggctgacgtcagggttatacctctcggaggttctagggcagggaagtggggaggggaggttccctgagatctctgtctttgagtttggagtttgtctctgagacagatttcggaggggtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgagaaatgcagaaaaaatgttactagggaagagatatcctgaaccattggatgcattgcttagtgtgtaccagaaggataattaacacatttgctcctggtttttctttactctggtggcaatctcggatgcctgtgttagagtgagagaagggctgggggaggaaagggggttgtcctgagacagagtggatgtggttgtacttttcacgtgaatgaaaggatgtttgtgcttctgagatatggggatacctttctgtggtcaggatcatggtgtactcaagcatgtatttcaggggttaaactggaattcccctgcatggggatatgtgtgtcttagggttataggtccatttctgtagtgtgctgtccacatgattgcccaagagacttgggccacaaagtccacaccagcagctctcatgtgggtcactgggttcaagtatgtactcccttgttgcagagctcacatatgtcaaagcatgtatcctgtggggtgtgtgggcctcagggtctcagaatgtggatccgtgctatgcccgtgctcacagttgtctgtatgtctcaaaagcacatagatccccagttatttttctgtattgtggttctcatatacacgtacctccatagctcagtatatgtttctgtactatacacctgttcctgagggagtgatagggttctcgtgtcatggggtccacatttttgtatgcaaacctcctaacacctgggttttacaggtaaagggaagctgaggactgattctagggcagtttgcaggcaatttgcaattctggaagcagacagtgaaaatataattgtggtcctcccttgttctgttctggaacctagagggttaacaggcagctcttccggtccacccccctccttccagcctgtagcttcttgttgccgtggagatggtggccccgccccgatgcagcacctgcccccccattggctgcagtggtgactgtggggctgaggggggagcccaggcctgggcagccattctggagctggagccggagcttggcatccccccacttacattctcttccagcccctcggcccctctaaattcccttgcagccgagcctcagcttcctttttcagcgcttgccatccctctaggctcttggcagactgagctgcatccgcattcacctcccctcctcctcctttccctatccttacttgggagtcccgagaacccccactgtccatccttcctgctccctgcccattcccctgcattctttgcttttcccctccccccaccaaccttctgagcccctgccactgcagtgcacgtggaaccggctccttctcccttccccccacctgccccttccttggattttctgtccccagcttctccccctgctactcttcacaggtctcttccaagacctccccctccagtccagggagggggtcatgggaggcagccctggccctccagacagacaggggttccaggaggtggggggcaggtggaagatgtgcccaccagggggaagaggaaagcctgcctatgggcaatgacctttaacccatctttccccccagctagccccttctggggtgggtgggcaccagggacctagcctccct

SEQ ID NO: 363 - DNA, 10901 bp, Homo sapiens
gtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgag

SEQ ID NO: 364 - DNA, 111053 bp, Homo sapiens
gtatagttctcaaccatgaaatctcctgggggtaatcttacctgtttaaaataaagggaaatgtaccctgtttctttcaccaaggcaccatgaataccaccttttcttttttttttttttttttttcctttcttttgtcttttttttttttaaatgcagggtcggccgggcgcgatggttcacgcctgtaatcccagcactttgggggtccgaggtgggcgtatcatggggtcaagagatcgagaccatcctggccaacatggtgaaaccccgtctctactaaaaatacaaaaaaattagctgggcgtggtggcaggcgcctgtagctccagctactcaggaggctgaggcaggagaaccgctcgaatccgggaggcggaggttgcagtaagccgagatcgcgtcattgcactccagcctgggcgacagagcgagattatctcaaaaaaaaaaaaaaaaaaaaaaaaaaaaaaggaaaaaaaaagggtcttgttctatcacccaggctggaatgcggtggtacggtcatagctcactgtaacctcaaattcctgggctcaagccatcctcccacctcaagtagctaggactacaggcgcacaccacctcacctggctaatttttttaaaaaaagttttttgtggaggctgggcgcggtggctcatgcctgtaatcccagaactttgggaggccgaggcgggcggatcacctgaggtcggaagtttgagaccagcctggccaacatggtgaaaccccgtctctactaaaaacacaaaaattatctgggcttggtggcacgcgcctgtagtcccagctactcgggaggctgaggcaggagaatcgcttgaacccgggaggcggaggtcgcagtgagctgagatcagccactgcactccagcctggcgacagagcaagactctgtctcaaaaaaaaaaaaaaaaaggttttttatagcgacagggtcttactgtgttgcccagatggatcttgagctccttgcctcaagcaatcttcccacctcagcgtctcaaagtgctgggattatgggcgtgaaccgccactcccagactactatcttattaaatatttctttttaacagttataaaaatgtttacgatcggccaggcacggtggctcacgcctgtaatcccagcactttgggaggccgaggcaggaggatcacgagggcaggaaatcgagaccaccctggctaacacggtgaaaccctgtctctactaaaaataccaaaaaaaaaaaaaaaaaaaaattagctgggcgtggtggtgggcgccttgtagacccagctactccggaggctgaggcaggagaatggcgtgaacccgggaggcggagcttgcagtgagccgagatcgcgccactgccctccagcctgggcgacagagcgagactccgtcttaaaaaaaaaaaaaaaagtgtacgatcacatgtttataagaacattctgttcttataataattgtaacagtaactcctccagaataatttttaacaactagagtcttacaatcacaagaaagatatttttcatctcaattaatatacatgtatatgcaggaagatgtaaaagattggtcaataaaggactttcaagtataaaagcataaagtttgtggggaagtggagtagtagtaggagctcaaggaaaaaagaggtgatgaaagaaaaaaggaatgattcccaactggtaagaactaatttatactttttttttttttttgagatggagtcttgctctgtcgcccaggctggagttcaatggcacaatctctgcttactgcaacctcccactcccgggtttaagcgattctcctgcctcaacctcctgagcagctgggattacaggcacacaacaccatgcccagctaattttttgtattttttgtattttttttttttagtggatatgggtttttggcatgttggccaggctggtctcaaactcctgacctcgtgatccacccaactcagcctcccaaagtgctgggattacaggcgtgaagcaccgtgcccggccatcactatgatatttcaattccactggacaataaatggtgatctaattgttttattttaaaatgtggggccaggcatggtgactcatgcctgtaatcctaccactttgggaggccgaggcgggcagatcacttgaggtcaggagttcgagaccagcctgaccaacatgaggaaacctcgtctctactagagatacaaaaaatagccaggcgtggtcgtgggcgcctgtaatcccagctatttgggagctgaggcaggggaatcccttgaatttgggaggcaaaagttgcagtgagccaagatcacgccactgcactccagcctgggcgatagagcaagactctgtctcaaaaaataaaaaaataggccgggcgtggtggctcaaacctgtaatcccagcactttgggaggccgaggcaggcagatcacctgaggtcaggagttcgagaccagcctgcccaacatgatgaaaccccgtctctactaaaattacaaaaaaattagctgggtgtagtggcgggcgcctgtagtcccagctatttgggaggctgaggcaggagaatcgcttgaacccgggaggcagaggttgccggaagccaagatcgcaccactacactccagcatgggcaacacagagagactgtgtctcaaaaaaataaataaataggccaggtgcagtggctcatgctgtaattccagcactttgggaggccgaggcaggcagatcacgaagtctaggagttcgagaccagcctggccaatatggtgacacccccgtctctactaaaaatacaaaaattagctgggcgtggtggctcgcgcctttagtcccagctacttgggaagctgaggcagaagaatcgcttgaacccaggaggcggagatttcagtgagccaagatggtgccactgcactccagcctgggtgacagagcaagactctgtctcaaaaaataaataaataaaataaaatgtggccagctgtggctcaccgcctataatcctagcactttgggaagttgaggtgggtggattgcttgatctcaggattacagaccagcctaggcaacatagtgagacctcatctcaataaatcaataaataggctgggcgcagtggctcatgcctgtaatcccagcactttgggaggctgaggtgggcggatcacttgaggtcaggagttccagaccagccttgccaacatgatgaaaccttgtctctactaaaaatacaaaaattagctgggcacggtggcacacacctgtagtcccagctatttgggggcctgaggcaggagaatcgctagaatctgggaagtggaggcaggctgcagtgagcagagatcactgccactgcactccagcctgggcaacaggagactctgtcacaaaaaaaaaaaaaaaaaaagagttcaagaccagcgtggccaacatggtgaaatccccatctctactaaaaatataaaaattaggggtgctggtgcacacctgtggtcccagctactcaggaggctgtggcaggagaattgcttgaaccccagaggcagaggttgcagtgagccgagattgcaccactgcactgcagcctgggcgacagagcaagactccatctcaaaaaaaaaataaaaattaaaaaataaataaaatgtgaatattttcaatatgccagaattacatccttgaaacaatttttatttatttatttttatttttatttatttatttatttatttttggaaggagtctcgctctgtcacccaggccggagtgcaatggtgcgatctcggctcactgcaactgcctcccgggttcaagcaattctcctgcctcagcctctgagtagctgaggcagagaatcaggtgcccaccaactttcccggctaatttttgtatttttagtagacatggggtttcaccatatttgccagactggtcttgaactcctgactttaggtgatccccctgccttggcctcccaaatttctgggattacaggcatgagccactgtgcccggccacaattttaatttatgatgaaaatttttagatacctacttaaagatatatgaaggagtatatacttcttcaaaattatttccctgagtataggtgcagaatttaagactgctgccctggccgggcgcagtggctcacacctgtaatcccagcgctttgggaggccaaggcaggcagatacctgaggtcggagttggagacctgcctgactaacatggagaaaccttgtctctactaaaaatacaaaattagcagggggcggtggcgcatgcctgtaatcccagctactcaggaggctgaggcaggagaatcccttgaaccctggaggcagaggttgcagtgagccaagattgtgccattgcactccagcctaggtaacaagagcaaaactccatctcaaaaaaaaaaaaaaaaaaaaaaagactgctgccctaagctatccaagcatctcctccatagcccccaacactcccatttccctcctgtctcccctctcacctccttggtggggaaagaagatgtttataggaaaggtggtcacaattccagctcctcctccttctgaggtgtccccaggagccagtcccctaactttgcccatagtagtaaccacagcagcttataagcagcctccagcatcagcagtgtcaggaagagggccaggaagataaagaaagccttgtccaaggcacgtcgcacgggacccctgggaggggagggaccctgggcaaatgccaggaacacatccgcctcgtccacatcaccttcctctgccatcctgactcacagtcagacagctggctggatcagggggctgggatgcaaggccttgctcagcactgccaggattaaggagcatggctgtggcaagtcctgcacctgccagtcctgaccttaattcccacacctaagagaaaagagaaaggaccctatgagccttcagatcaattatttaaacatccagtgtgatgtgaaaggtctggactaaatgatccatgaactctattcagctttttcatagtataattctgtgatttggaaactgaaggcccaacatgaaggcataagctagaactgcctgtcactctgggtctcaagtctcaaagactcaaggctcaaaatcttgggccccaactgatagagagtgaggaaatggacctaccatgcatctgtgagccatggtcagtcaaggatctaaagccccttctggctggatggtagggggtgagatggtctatcctaaccaaggcgggtaggaacaagcagaggggacttgagttctcacaggagtagttctccccactgggtctgcaggcagctaagtttgagatggtataacccagaacactctcttcctaacttttggtctctgcagtaccaagggaggattatcattgactgcatgagcccaaggggaggcttataaaaagacaaagaccgtgatggatcagcagggcaagggtatgtgattgggacttggctgttgggttggggttattttactttactttacttatttatttacagacggagtctcgctctgtctcccaggctggagtgcagtggcacgatttcggctcactgcaacctctgtctcctgggttcaagaaattctccttcctcaacctcccaagtagctgggactacaggcatgtgccaccatgtccggctaatttttttgtatttttagtagagacggggtttcaccatgttggtcaagctggtctggaactcctgacctcaaatgatccacccaccttggcctcccaaagtgctgagattacaggtgtgagccactgcacccagccagggtaattttaaagaagagtgaagttttgccatcgatggtccaggtctcagaggctaccagtggaggatgtggttgaggaggttgtaggagcaaggactgaagaccttttcttttctttcttttttttttttttttttgactgattgaagaccttttcttaggccaggcgtggtggctcacgcctgtaattccagcactttgggagcccgaggcggatggatcaattgaggtcaggagatcaagaccagcctggccaacatggtgaaacactgtttctacctaaaatacaaaaattatccgggagtggtggcgcatgcctgtaatcccagctactcgggaagctgatgcaggagaatctcttgaaactgggaggcggaggttgccatgagctaagatcatgccactgcaactgcactccaacctgggtgacagagtgagactccgtctcaaaaaaataaaaataaaaaaagaagatgttttattgaccctgttccccaggcattggcctgaaggttgggtaatgaaattgaagcccatctggaaacaagggattcgcccaagtgaggctgagggaggggagggggaacggtggaggaagcagtgtgtgtagtagtgaaccttatactgggaacctttggagcctcctacctaaactatttcattttcattttcacctcaataggaagatcttgttccttttttttttttttttaaccggatcttttttttttttgagatggagtctcgccctgtcccccgggctggggtgcaatggcacgatctcggctcactgcaacctccgcctcccgggttcaaaccattctcctgcctcagcctcccaagtcgctggaattacaggtacgtgccaccacgcctggctaattttttgtacctttagtagagacggggtttcacagtgtaggccaggctggtctcgaactcctgacctcgtgatccacccacctcagcctcccaaagtgctgggattacaggcataagccaccgcacccgggctacaggatcttgctctgtcacccaggctggagtgtagtggctcaaacgtggcccactgcagccttgatctccccagctcaagcaatcctcccatcttagcctcctgagtagttgggaccacaggtgtgtgtcaccacgcctggctcatttttgaattttgtagagacagggtctttctatgttacccaggctggtttttaactcctgagcttattaaacaatccttccacctcagcctcccatcattctggaattacaagcataagccaccatgcctaagaataccttctttacttgggaagtcaggtcaccccccaaaagagcagaaatgatgttataatgttgttttgagggctgggcgcggtggctcacgcctgtaatcccagcactttgggaggccgaggtgggcggatcacaaggtcaggagattgaggccatcctggcaaacacggtgaaaccccgtctctactaaaaatacaaaaaattaggccaggcgcggtggctcacgcctgtaatcccagcactttgggaggccgaggcggacagatcacgaggtcaggagatcgagaccatcctggctaacacggtgaaaccccgtctctactaaaaatacaaaaaattagccaggtgtgatggcgggtgcctgtagtcccagccacttgggaggctgaggcaggagaatcacttgaacccgggaggcagagtttgcagtgagccaagatcatgccactgcactccagattgggcgatacagtgagactccgtctcaaaaaaaaaaaaaaaatacaaaaaattagccggctgtggtggcgggagcctgtagtcctaactactcgggaggctgaggcaggagaatggcatgaaccccagaggcggagcttgcagtgagccgagattgctccactgcactccagcctgggcgacagagcgagactctgtctcaaaaaaaaaatgttgtttcaagtcatgccgcattgtcttttgctgcagctgcaaaggagtctcgaaaaagtgaaaaaaccctggactagaatttaaactgatcacttagttgtgtgaagctgtggacaagtcacatgacctttctttagtgttttgttttgtaataaaatcagaaaaagctcttgcctcccagaattattctgagagataaatgaaataaaggttttttgatgttgttggttttttgtaaattataaagcactatgtaaatgtaacatattaatctgataccctcacttacatcccaggcaagtgtgcaataaggccacacaaacacctttattgtctctttacatggtaggttcagcaccaacatcttgtgtaataaataaacctagcatcttgttggaatttttttaattttgaaataattttcagcttacagaaaaatttaagaacagttccaagaactttggcatgtacctctttcactcagattttccatttgtcaacacttggctgtatttgttccatctcgctctcaaccccagtataaccatgtgttacaggttgaattgtgtctcctaaaaattcatatgttgtgcagccataaaaatgaataagggctgggctgggcgcagtgtctcatgcctgtaatcccagcactttgggagaccgaggcgggcagatcacaagttcaagagatcgagaccatcctggttaacacactgaaagcccatctctactaaaaatacaaaaaactagccgggtgtggtggtgggcgcctgtagtcctagctactcaggaggctgaggcaggggaatggcttgaacccgggaggcggaggttgtggagagctgagatcgcaccactgcactccagtctggcaacagagtgagttgttgccaaaaaaaaaaagaaaaaagaacaagatcaggccaggcgcggtggcttatgcctgtaatcccagaactttgagaggccaaggtgggcagatcacaaggtcaggagtttgagactagcctggccaacatggcaaaaacccatatctactaaaaatacaaaaattagctgggcatggtggcaggcccctataattccagctagtgacatgggaggctgaggcaggagaatcacttgaacccagggggccgaggttgcagtaagctgtgatctcaccattgcactccagccccactgacagtacgagactcctctcaaaaaaaaaaaaaaaaaaaaaaaggtgaagaattcatttgttcgcatgttctcacttacaagtgatgatgagaatacacggacacacggtgggaaacaacacaactgggtcctgtctgggggagtgggggaaggaagggcaccaggaagaatagctaatggatgctgggcttaatacctgggtgatgggatgatctgtgcagcaaatcaccattgcacacgtttacctatgtaacaaacctacacatcgcacacatgtacccctgaacttaaaataaaagtcgaaggaaaaaaataaaatttatataatgaagtcctaactcccagttcctcagaatgtaaccttatttggaaataaggttgttgcatatgtaattggttcaatgaggtcatactggagttgagtgggcctctcaccccctttataagaaaggaagtttggacataggcttgcggatagagagaatgacatgtgaccatgaaggcagagatcaggttgatatgtcaaagattgccagcaggccaggcaccatggcttatgcctgtaatcccagcactttgggaggccaacacaggtggatcacctgaggtcaggagttcgagaccagcctggccaacatagtgaaatcccatctctactaaaaatacaaaaaattggccgagcacaatggctcacgcctgtaatcccagcactttgggaggctgaggcgggcagatcacgaggtcaggagttcaagaccagcctggtcaacatggtgaaaccctgcctctactaaaaatacaaaaattggcagggcatggtcatgggcacctgtaattccagctattctggaggcaggagaattgcttgaacctggaggcggaggttgcagtgagctgagatcgtgtcactgcactccagcctgggcgacagagcgagactctgtttcagaaaaaaaaaaaaaaaaaaatacaaaatgttagccgggcgtggtcgtgggtgcctgtaatcccagctactcaatcgggaggctgaggcaggaaaattgcttgaacctgggaggcagaggttgcactgagccgagatcttgccattgcactccagcctgggtgacagagcaagattccgtctcaaaacacacacacacacacacacacacacacaaaagactgccagcaaaccaccggaaactagtagaaaggcctggaacagattctcccttacacccctcagaaagaaccaaccctgcctacaccttgatctcagacttccagcctccagaactgtaaggcaatacatttctgctgtttaagtctcccagtttgtgatactttgttatggcagccctagcaaactaaaacaccattctaatcaggaaatcaatatcactcttcaattcatagatcccattcagatttcaccagctgtcccagtaatgaccgcctcttcttttttaaattatcttttttttttttttttttttggagacaggtctgtcacccaggctggagtgcagtggtgcgatctcggtgcactacaacctccaccttccgggttcaaacaattctcctgcctcagcctcccaagtagctgggactataggcacacgccgccacagccagctaattttttgtattttagcagagacggggtttcgccatgttgttcaggctggtcttgaactcctgagctcaggcaatccacccgcctaggcctcccaaagtgcaattatcttttcttttaacagctgtttttttctttttctttttttttttttttgagatgaggtctcactctgttgcccaggccaaagtgcagtggtgctatcaagagctcactgcagcctcaaactcctgggctcaagtgatcctcccacctgagccttccaaagtgctgggactacagatgcgtgccaccatacttggcctatctgtcctttctagtccaggatcacatactgcatttgactgtcacatatctatctgtagtctccttcaatctgggaagttctcagtctttccttgtctctcatgaatttgacagttttgaagaggtctttcatttctttcttttttttcttttcttttctttttttttttaaacaggttcttgctctgtcgcccaggctagagtgcagtagcaggatcatagctcactgcagcctcaaattcctcggctcaagcaatcctcccacctcagcattctgagtagctgcggctacaggtgtgtgccagcacatccggggaatttaaacattatttgtaggctgggcacagtggctcatgcctgtaatcccagcactttgggatgccgaggcaggcagatcacaaggtcaggagtttgagaccagcctggccagcgtggtgaaaccccatctctactaaaactccaaaaaattagccaggcatggtggcacatgcctgtaatcccagctagctacacaggaggctgaggcaggagaattgcgtgaaaccgggaggcagaggtcacagtgagccgagattgtgccaatatgctccaccctgggagtcagagcaaaactccatcacaagaaaaaaaaaaaaaaagacaggactttctacttgctagcctctctattgctggctttgatgatgtaagatgccatattggagaaacccacatggcaagaaactaggtgtggtctccaaacactaaccaacagggaactgagaccctcagtcaaaaaaccctttagaaactgaatcctgcaaacagctatgtgagtgagcttagaagcagaaccttccccagttaagctttatttttatttttatttttatttttattttttttgagacagagtcttgctccgtcacccaggctagagtgcaatgtgctatctcgcctcattgcaacctccacctcccaggttcaatcgattctcctgcctcagcctcccaagtagctgggattacaggtgcccgccacaacacccagctaatttctgtatttttagtagaaaccgggtttcaccaggtgggccaggctggtctggaactcctgacctcaggtgatgcacctgcctcagccttccaaagtgctgggattacatgcatgagccactgagcccggccctgagctttcagatgagatcacaggcaactcatagactgcagtcttatgagagcctccgaagcagaggatccagctaagctgttcccagatttctcccccacagaagccatcagataacagtgtgttgttttgagccaccgggttttggggtaatttgttacacagcaatagataactcatacactgtgctagaattgagcaccagatcttcagtaacagatacacccatatattccttccaaatttattcttttaacatttatgatatgtggggccttctgaaatgtggggctccaggcaggatctcctcttgcttggatataagagcagcactagaattagtctatcagtcttcacattttcttgcttgcatgctccttaaaaacattttggaaaattatgtgccattttgtatatatttttatttggcatctaatttttttccttgttgatttaaataactgcaaagagtataacaaatcggcttggtgcaatggctcacacctgtaatcccagtactttgggaggccgaggcaggtggataacgaggtcaggagttcaagaccagcctggctaacatagtgaaaccctgtctgtactaaaaatacaaaaattagctgggcatggtggcgtatgcctgtaatcccagctactcgggaggctgaagcacaagaattgcttgaacctgggaggcggtggttgcagtgagccgatatcataccactgcattccagcctgggcaacagagcgagactccatctcagaaaaaaaaaaagagtgtaacagatcttgtgtcttatataaatattgacattgtaaaataaaactgtcaactgggcacggtggctcacgcctgtaattctagcactttgggaggccgaggcaggcggatcacgaggtcaagggatcgagaccagcctggccaacatggtgaaaccccatctctactaaaaatacaaaaattagctgggcgtggtggcacgcgcctgtagtcccagctaatgaggaggctgaggcaggagaatagcttgaacccaggaggaggaggttgcagtgagctaagatcacaccactgcactccagcctggctgacagagccaaactccatctcaaaaaaacaaaaacaggctgggtgcggtggctcacgcttgtaatcacagcactatgggaggccgagacaggcggatcacgaggtcaggagatcgagacaatcctgactaacacggtgaaaccccgtctctactaaaaatacaaaaaaattagccgggcatagtggcgggcgcctgtagtcccagctactcgggaggctgaggcagaatggcgtgaacctgggaggcggagcttgcagtgagccaagatcgcgccactgcactccagcctgggcaacagagccaggctccatctcaaaaaaacaaacaaaacaaaaacaacaaaaaaaaacaaaaaactgtctggctgggtgcagtggctcacgcctgtaatcctagcactttgggaggctgaggtgagtggatcacctgaggtcaggagttcagaccaatctggccaacatagtgaaaccttgtctctaccaaaaatacaaaaattagccaggcatggtggcacatgcctgtaatcccagctactcccgggttcaagcaattcttgtgcctcagcctcccaagtagatgggattacaggtgtgcaccaccacacacctggctaatatttttgtatttttagtagagatggggtttcaccatgttggctaggctggtctggaactcctgacctcaggtaatctgctcgcctcagcctcccaaaatgctgggattacaggcatgagccaccacacctggccacaaaataaataaggaaataaataaatatatatatgtaaaatatatatatgtaatatatgtaaaatatatatgttatatatgtaaatatatatatatatacacacatatagtttgtttgtttttgagatggagttttgctcttgttgcccaggctggagtgcaatggcacgatcttggctcactgcaacctccgcctcccgggttcaagcgattctcctgcctcagcctcctgagtagctgggaatacaggcatgcaccaccacgcctggataattttttatttttagtagagattgggtttctccatattggtcaggctggtctcgaactcctgacctcaggtgatccacccacctcggcctcccaaagtgctgagattataggtgtgagccactgcacccagcccgctctgtcttaaatatgagtgcccagttaaggaacaccagatatttgaggaagacttcagacatgagcaaaaacccaaaattaaaagtaaaaacgacacagcattgtgctcttcgccttccctcatcgtctggcgcagggcagcccacttctggtgtttggcgctggaattaaacaaccaccatgtggagcaaaaaggcaagaccaagaccaccaaaaagctccctcagcgcacaacatccaacgtgtttgccatgtttgaccagtcacagattcaggagttcaaagaggccttcaacatgattgatcagaacagagatggtttcatcaacaaagaagatttgcatgatatgcttgtttccctagggaagaatcccaccgatgcataccttgatgccataatgaatgaggcaccagggcccatcgatttcaccatgttcctcaccatatttggtgagaagttaaatggcacagatcctgaagatgtcattggaaatgcttttgcttgctttgatgaagaagcaacaggcattattcaggaagattacctgagagagctgctgataaccatgtgggatcggtttacggatgaggaagtggatgagctgtacagagaagcgcctattaacaaaaaggggaatttcaattacatcgagttcacatgcatcctgaaacatggagcaaaagacaaagacgactgaaaagaactttagctaaaaccttccaactacattgtcttactctgttttatttctcagacacttcccccatcctcatagaacctgttgcatgcaacttagtttcacagctttgcctcttttttttttttatgtatttattccagacctttctgtcacacagcacttgtataatcagactgaaaatggggatgagggtgtaaattgtattgaaaaagagatcatggccgggcgcagtggctcacgcctgtaatcccagcaacttgggaggccgaggcgggtggataacctgaggtcaggcgttcaagaccacgctgaccaacatggtgaaaccccgtctctactaaaaatacaaaaagttagttgggcgtggtggcgggcacctgtaatcccagctactcaggaggctgaggcaggagaatcgcttgaacccaggaggcagaagttgcagtgaaccaagatcacaccgttgcaccccagcctgggcaacaagagcaaaattcagtcaaaaaaaaaaaaaagaaagaaagaaaagaaaagaaggccaggcacggtggctcacgcctgtaatcccagcactttgggaggctgaggcgggtggatcacgaggtcaggagatcgagaccatcctggctaacacggtgaaaccccgtctctactaaaaatacaaaaacattagtcaggcatggtggtgggctcctgttgtcccagctactcgggaggctgaggcaggagaatggcatgaagccaggaggcagagcttgcagtgagccgagattgagccactgcactccggcctgggcgacagagtgagactccgtctcaaaaaaaaaaaaaaagaaaagaagaaaaagaaaaagtgatagcaaataaaaatcaacaaatgtgaaaaaaaaaaagtaaaaacaaacatggaggaaagagacagaagaggaaaacttcatataaactataataaatttccacactgatgagagaaaatgagtatcagaagaagaagaagagttgtaagatcaacaggatatgagaaatgaaaacttgagccaggtgcagtggctcacacctgtaatcccagcactttgggaggctgaggcagccagatcacttgaggtcaggagttcaagaccagcctggccaacatggtgaaaccctgtctctactaaaaacacgaaaattagtcgggtgtggtcatgggtgcctgtaatcccagctatgcaggaggctgaggcaggagaatcgcttgagcctgggaggcggtggttgcagtgagccgagatcgcaccactgcactctagcctgggtgacagagtgagactccatctcaaaaaaaaaaaagaagaaaaaagaaaaaaaaacttgaacccaattataagatctagattttggccaggtgcggtagctcatgcctgtaatctcaacacttaagaggctgaggtaggaggattgcttgagcccagacatttgagaccaacctgggtaacatagggagacttgtctctacaaataatttaaaaattaacaggcagggcgcagtggctcatgcctgtaatcccagcactttgggaggccagggcaggcagatcatgtgaggtcaggagttcgagaccagcatgaccaaaatggtgaaaccccatctctactaaaaatacaaaaaaaaattagcggggcatggtggctcgcacctgtaatcccagctacttgggaggctgagacaggggaattatttgaacccagcaggtggaagttgcagtgagccaagatcgcaccattgcattccagcctgtgtgacagaaagactctgtctcaagaggaaaaaaaaaaacattagccagggccggtcgcggtggttcatgcctgtattcccagcactttgggatcccaaggtgggcagatcacttgaggttaggaattcgagaccagcctgaccaacatgatgaaaccccgtccctactaaaaatacaaaaaaattagctgggtgtggtggtgcatgcctgtaatcccagttactcgtgaggctaaggcaggagaattgcttgaacttcggagattttgcagtgagccaagattgggccacttgcactccagcctgggtgacaaagcaagacttcctctcaaaaaaaagaaatccatggccgggcgcagtggctcacgcctgtaatcccagcactttgggaggccgagatgggtggatcacgaggtcaggagatctagaccatcccggctaacatggtgaaaccccatttccactaaaaatacaaaaaattagccaggcatggtggcgggcacctctagtcccagctacttgggaggctgaggcaagagaatggtgtgaatccgggaggcggagcttgcagtgagccgagattgtgccactgcactccagcctggacaacagggagagactctgtcaaaaaaaaaaaaaaaaaaagaaatctcaaaaaagaaagaaaaatggccaggcacagtggctcatgcctgtaatcccagcagtttgggaggctgaggtgggcacatcaacttaggtcaggagttcgagactagcatgatcaacatggtgaactctgtctctactaaaaatacaaaattagcctgatgtagtggcacatgcctctagtcccagctactcaggaggctgagacaggagaatcacttgacaggaggcagaggttctggtgagctgagatcacaccattgcactccaacctgggcaacaagagtgaaaccccagtttaaaaaaaaaaggaaaaaaaaagaaaaaaaaaaaaccacggtagcgtgcacctgtgtttccagctattcaggaggctgaggcaggaggatcatctgacctggaggtcaaggctgcagtgagccatgatcacaccactgcactccagcttgggcaacatagtgagactctgtcacgaagcctgcagtgcagtgacgagatcttggctcactgcaatctctgcatctcaggttcaaatgattctctgcctcagcctcccaagtagctgggatttactggcatttgccaccatgcctggctagtttttgaatttttttagtagagacagtgttttgccatgttggccaggctggtctgtacctaattttgtatttatacttttggttttttttttttttttgagacggagtctcgttctgttgccctggctggagtgcagtggcgtgatctcagctcactgcaacctccgcctcctgggttcaagcgattctcctgcctcagcctcctgagtaactgggattataggcactcaccaccgtgcctggctaatttttatatttttttttagtaaagatggggtttggccatgttggccaagctggtctcaaactcctgacttcaggtgatctgcccacctcggcctcccaaagtgctgggatacttttggtattctttctcttaaaacaggtatccaaaattgtacacgtgtcagcctcccaccaacctacatctgctgcacttgcagagatagagtctatatatataagcatgtattaatatatataagtgtatatgtataaatgtatacatacatataaatacatgatcactactcttttccttgcttttcctcacttaataccttgaaatcaaacagagaggtgcttccttctttttttttttcggagtcggagtcttgttctgttgcccaggctggagtgcagtggcccaatctcggctcactgcaaccttcacctcacaggtttaagtttttcttctgcctcagcctcccaagtaacttggactacaggcgcacaccaccatgcctggctaatttttgtatttttagtagagatggggtttcaccatattggccaggctggtctcgaactcctgacctcatgatccttctgacttggcctcccaaagtgctgagattacaggcttgagccaccacgcccagcctctttttttttttttttttttaaatttaatttaatggagatgagttctctcaatatgttacccagagtagtctcaaattcttgggctcaagtgatccacctaccttggcctcccaaagtgctgggattataggagtgagccaccgcacccgaccccttgtttgttatagtgctcccttgactctcaaaaatgtccagtgtaggccaggcgtggtggttcacacctataatcccagcactttgggaggccaaggcaggtggatcacttgaggtcaggagtttaagacttgccgggctaacatggtaaaaccctgtctacaaaaaatacaaaaattagctgtgcgtggtggtgcgcacctgtaatcccagctactcaggaggctgactgaggcaggaagactgcttgaacctgggaggcagaggcggaggttgtagtgagctgagattgtgccaccgcactctagagcaagactccatctcaaaaaaaaaatgtctagtgtaaatgtatgttctttgaagtagaattgctaggtcaaagaatacgtaaatacttgatttgggtagatatttttaaaatgctttctgtagaagccgcaccagtgtaccttccttcctgtcggcaatgtgtgacagtaccagtttcctttccccaccccatcagctgagtgtgttatcaaactttttttttttttttttttttgagacagagtctctctccatcgctcagcctggagtgcagtggcatgatctcggctcaatgcaacctccacctcctaggttcaagccattctcatgcctcagccaatagctgtgattacaggtgcatgccaccaccggctgatttctgtatttttagtagagacagggttttgccatgtttttttgtttgttttgagacaggatctttctctgttgcccaggctagagtgcagtggcatgaacatggatggttcactgcagcctcgacctcctgggttcaagtgatccttttgtctcagcctcccaagtagctgggattccaggtgggagccaccatgccctcctaaactctaccttttggtgagagtgactagccaccaaggcacactgtaaaggcctcagataacaggaagtggtagagaactgcagccaatctaacacctagacaaattcaaggtgggacctatcaggtactatgcttgttacttgggtgattaaattacctgtacaccaaagccccatgacacacactttacctatataaggaacctacacatgtacccctgaacctaaagtaaaagttaaaaaataaaataatataattcaaagtttgggctacagagtataagtgagagatattcagctactgggagtttataaaagacacacaaacatcgcacaagagcaaaagtcaatttgaacatccaccacagccagaggaaaccaaaaccacttccagtgtatggccgtcaggtaaagcattttgtccccctcacctcctctgcttctggctgtgagggagagggtggagagtcagacacaggaaggcaagaaagaaattcttgaggaagccagccactctgccagtttcacactggcagcttcccatgtcaaaccactcagtcggagctggccgagagaaaaaacgtaattcagaatgatgcttggaggatttttttttttgttccaaggattgagcaggtatgctctgtggcctgcctgagttatctttcatgggcaatggaagaactagccccacacaacatatttaaaggggtggggacacttgagtgtggggggtgcacagcaacatattcaagcttatgtacatggcatctgaggtcggggcatggaagaatactgaggcactgtgtgtatgttatttgtgcgtgagaatgaaattccttgaccctgaaaacaggacagggagtggagtgtgtggtgtgataaggaacgctgaaaacagcctcctgagaatgcggtttgagtgcttttacgaggccgcaggtgtctcacgacccgacctcaaaaagccatctagtggatgtttgtggtttaacaagcactttcaataaatacttggcagacggatgctggggcgggttctcttagaagaaatgccccccccattcccccggccccactcagctggaattgtctaagaactcattcttggcgttcactgcaagctataaactctgcaagtggtgcacccgacgtgatcgccttgaagttatgcgtgaaaggaggagagctcatcaattttaagaaaatcccggtaagggacagtcctgactaccatcaggtggacaggacccacgcgaaaaataccaggggttcggttatcatgggtcaggaaatgaacaaagaataatttttttttttttttgagatggagtctcactctgtcgcccaggctggagtgcagtagcgtgatcccggctcactgcaacctccacctccctggttcaagctattctcctgcctcagcctcctgaatagctgggattacaggtgcacgtcaccccacaacaggacttaattaaccttgccttcaaggtgtacaataatagagaaaagttacaattacttgcctctgctgtgagacaaaacccagctgcacctccagcacacgagaacttcaaaatgcctaagccgcacatgcctaaaccgcagtggtcaagcattcctacaggaccttcttcatcaggatcttgcttcaagtgccagaaatctggccactgggccaagaaatgcccacagcccgggattcctcctaagccgtgtcccatctgtgcaggaccccactgaaaatcagactgtcccactcgcctcgcagtcactcccagagctctgggatctctggcccaagactctctgactgactccttcccagatcttctcagcttagcggctgaagactgatgctgtctgatcaccttcgaagcctcccgggccatcacggacactttgggtaactcttacagtggagggtaagtcacccttcttaatcaatatggaggctaccaactccacattaccttcttttcaaaggcctatttcctttgcctccataactgttgtgggtattcatggccaggcttctaaacctcttaaaactccccaactctggtgccaacttggacaatattcttttatgcactcctttttagttatccccacctgcccagctcccttattaggtcgagacattttaactaaattatctgcttccctgactaatcctaggctacagccacatttcgttgctgcccttttccccagttcaaagcctccttcacgtccttctcttttatctcctcaccttaatccacaggtatgggacacctctactccctccctggtgaactatccacgcccattactatcccattaaaacctaatcacccttaccccgctcaatgccagtatcccatcccacagcatgctttaaaaggattaaatcctgttatcactcacctgttacagcatggccttttaaagcctataaactctccttacaattcccccattttacctgtccaaaaaccagataagccttacaggttagttcaggatctgcgccatatcgaccaaattgttttgcctatccaccctgtggtgccaaacccatatactctcctatcctcaatacctccctccacaacccattattctgttctagataaacctagctgaccccatagatcctaaatcctttctcctctcccctttccattccttaaaacacagctcccacactagctctccatgactcatcccgacccttttcattacacacagccgaagtgcagggctgtacagtcagaattcttacacaaggaccaggaccgcaccctgtagcctttttgtccaaacaacttgacttactgttttaggctggccatcatgtctccgtgcagtggctgccactgccctaatacttttacaggccctcaaaatcacaaactatgctcaactcactctctacagttctcataaatctattttcttcctcacatctaacacgtatactttctgctccccggctccttcagctgtactcattctttgttgagtctcccacagttaccattgttcctggccaggacttcaatccagcctcccacattattcctgataccacacctgacccccatgactgtatctctctgatccacctgacattcaccccatttccccgtatttccttctttcctgttcctcaccctgatcacacttggtttattgatggtagttctaccaggcctaattgccacacaccagcaaaggcaggctatgctatagtatcttccacatctatcattgaggctactgctctgcccctctccactacctctcagcaagctgaactcattgccttaactcgagccctcacttttgcaaagggactacatgtcaatatttatacaactctaaatatgccttccatatcctgcaccaccatattgttatatgggcaaaaagaggtttcctcactacgcaagggtcctctgtcattaatgcctctttaataaaaactcttctcaaggccgctttacttccaaaggaagctggagtcatttactccaagggccatcaaaaggcgtcagatcccatcgctcagggcaatgcttttgctgataaggtagctaaagaagcagctagcattccaaattctgtccctcacggccaatttttctcattctcatgggtcactcccacctactctcctgctgaaacttctacctatcagtctcttcccacacaaggcaaatggttcttggaccaaggaaaatatctcctaacagcctcacaggcccattctattctgctgtcatttcataacctcttccatgtaagttacaagctgctagcccacctcttagaacctctcatttcctttccatcgtggaaatctatcctcaaggaaatcacttcttagtgttccatctgctattctactactcctcagggagtgttcaggctccctcccctccctacacatcaagctcagggatttgcccctgcccaggactggcaaattgactttactcacatgccccaagtcaggaaactaaaatacctcttggtctgggtagacactttcactggatgggtagaggcctttccaacagggtctgagaaggccactgcggtcatttcttcccttctgtcagacataattcctcgctttggccttcccacctctatacagtccaataacagactggcctttattagtcaaatcacccaagcagtttctcaggctcttggtattcagtggaaccttcataccccttaccatcctcaatcttcagaaaaagtaaaacagactaatagtcttttaaagacacacctcaccaagctcagcctccaacttaaaaagactggacagtacttttaccacttgcccttctcagaattcgggcctgtcctcggaatgctgcaggatacagcccatttgagctcctgtatggatgctcctttttattaggccccagtcttattccagacaccagcccaactcggactgcaccccaaaaacttgtcatcccttctatcttctgtctagtcatactcctattcaccattctcaactactcataaatgccctgctcttgtttacactgccggtttacactgtttctccaagccgtcacagctggtatctcctggtgctatccccagaccgccactcttaactccctcttaaagtaaataaataatatttgctggcagggcacactccaatactttcaccctgatgaagtcctattctttacttttatactcactcctattcttgttcccatttttatgccaccctctacctctccccagctagctccaccacactatcaatctcattcactctctcctagccgtttctaatccctcatcaaaccattgctgaatttgcatttccctttcttcctgcgcctacacagctgtccccgccttacatacagactgggcaacctctcctatctccctacacctccaaacttcctttaacagccctcacctttaccttcctaaagaacttctttactttctagacaggtccagcaagacttccccagacatttcacttcagcaagctgccgccctcctccacacttacttaaaaaacctttctccttatatcaactctactccccccatatttggacccctcacaacacaaactactattcctgtggccgttcctttatgtatctctcggcaaagacccactggaattcccctaggtaatctttcaccttctcgatgttcctttactcttcatctccgaagcccaactacacacatcactgaaacaattggagcctcccagctctgtattacagataagccctctatcaatactggcaaacttaaacacattagcagttattattgcttaggaagacacttaccctgtatttcactccatccttggctaccttccccttgcttgtcagactctcctcccaggccctcttcttgtttgcttatactcagccccgtaaataacagtgaaaggttgctcgtagacactcaaagttttctcatacaccatgaaaatcaaacctccccctctacgtagttaccccatcagtccccattacaacctctgacggctgccgccctagctggatccctaggagtctgggtacaagacacctctttcagcactccttctcatctttttactttgcatttccggttttgctccgcacaaggtctcttcttcctctgtggatcctctacctacatgtgtctacctgctaattggacaggcacatgcacactagttttccttactcccaaaatcaatttgcaaatgggactgaacatcttcctgttcccctcatgacaccgacacaacaaaaaagagttattccgctaattcccttgcttgtcggtttaggactttctgcctccactattgctctcggtactggaatagtaggcatttcaacctctgtcacgaccttccatagcctctctaatgacttctctgctagcatcacacacatatcacaaactttatcagtccttcaggcccaagttgactctttagctgcagttgtcctccaaaaccaccgaggccttgacttactcactgctgaaaaaggaggactctgtatattttttaatgaagagtgttgtttttacctaaatcaatctggcctggtgtatgacaacataaaagaactcaaggatagaggccaaaaactcgccaaccaagcaagtaattactctgaacccccttgggcactctctaattggatgtcctgggtgctcccaattcttagtcctttaatacctgtttttctccttcccttattcggaccttgtatcttccgtttagtctctcaattcatccaaaactgtatccaggccatcgccaatcattgtatacgacaaatgctccttctgggattacaggcgtgagacaccgtgcccagccattttttttttcctaaagatgataaccattcttttccagctgtcttttcttttttttttttttttttttgagacagagtctcactctgtcacccaggctggagtgcagtggcgcgatctcagctcattgcaacctccacctcctggggttcaagcaattctcccacctcagcctcctgagtagctaggattacaggcacccgccatcatgtccggctaatttttgtttttttttttttttggagagatggggtttcaccatgtcagctaggctggtcttgaactcctgaccttaggtgatccgcccgcctcagcctcccaaagtgctgggattataggcgtcagccaccacaccgggcaacaaatgctccttctaacaaccccacaatatcaccccttaccacaaaatcttccttcagcttaatatctcccactctaggctcccacaccgcccctaatcccgctcgaagaagccctgagaaacatcacccattatctctccataccacctccaaaaattttcgcagccccaacacttcaccactattttgtttattaatataaggagataggaatgtcaggcctctgagcccaagttaagccatcatatcccctgtgacctgcaggtatacatccagatggcctgaagcaattaaagatccacaaaagaagtgaaaatagcctcaactgatgacattccaccattgtgatttgttcctgtcccaccctaactgataaatatattctcccccacccttacgaaggtactttgtaatattctcccctgcccttaagaatgtagtttgtatgcctatcccaaacctataagaactaatgataatcccaccaccctttgctgactctcttttcggactcagcccgcctgcacccaggtgaaataaacagctttattgctcacacaaagcctgtttggtggtctcttcacacagacgccggtgacactattttcctaagccgtctggctagtagcccctaattgttcagctattcctctaacagcatctctagtgtagttaataaatcgctattggttgtaatagacgtagtttacccaatctacacttttattaattgttacccaccaaaatgttgacttaaatcctgcagcaatttgattttgggctttaaattgatctggtattccccatgggactcttaattgtgtctaaatagacgtgagagtcgaaagacccataaagggcttctcttgctttatgatacttatttttccttcctctcgttgatgaaataacagggtgaaagggatagccaattggaataaagcacaagtgccattccagttatttggcagtgtccagtaaagatccaccacaataccaccacacatccactcggggatgaacaagggctgactgattgataagctcttgaaaattcttaagctcactgcatccttcaggtctccaaggaatgctaagtttcctccctattgggagagacacgaagtgaacttagtgttgggagacagaagctggatggccctcgggggctgacgcgcagggtgccggacttcaggatatagcagagagagagcttggcgtgagttattactccaggctgtagaatcctggaaaagagctaccatgcagcccacacctggtcgactggaggaccaccttagtggaaaggggacaatctgggcctctggcctgccatgtgcacaagcataacaattgcttttgtttaatgtggacggaatatttgatccattccaaccaggcatttgcatcttggtatcctgtgttaattgccaaaatgttttttaagtctttaacttctatgatcctctagtaaaatgaatatatggttttaggaaattacaaaaactgattggggcagtccatacttgctctttagtgatccacagaacgttggaccgactacggcataaaagctctacattgggggtcaagaatcctggttgacattgggatctttatcgaaatccccccggattcagtggtcctaatttactaatgcccagtgtgaggagagtcaggagggacagaggtacttttcagaagtagagagctgtctttgacttggcaagttcctacgggatataacaaggcaagcactaaatgcaatagtttgaggcgaaattgacttggttatgttaataactagatggtcagcaatagagcgaggaaaggagaaagagtaatagaatagatgaaagagttaaatttttcttagctttaatttggtagggtttccccctgggactatggcccacaactctggagggggtggtgctttcttgactcgggtgtgatgaatccatccctttttcgctgtacaaactgcagtctcggtggttggcagcacaaggtagggtccttcccaggctggctcgagttttccttctttccaccctctgatgacaacatgatcttcaggctggtgctggtttaccagaaattttaggggtggtacctgtgctaaaatatttttagttttgagggagaggaaagtggaagataaaccaagcatataatttctaagaaatcgaccttttgttttaaatgtggggacatcagcagtggactttatagtccttggtgccttcttactgagaaatttcctttagcacttatttttattagtttttttagaccaaagaacgccaaacaccattttatatttgacagtgcttcctgtatgatttttataccagataagctaaatttcacctttatattagtgtgttattaatttttttttttgaaacggagtctcactctgttgcccaggctggagtgcagtggcgcgatcttggctcactgcaacctctgcctcccgggttcaagcagttctcctgcctcagcctcccaagtagctgggactacaggcacacgctgccacgcccggctaatttttttgtattttagtagagacggggtttcaccttgttgcccaggctggtcgcgaactcctgagctcaggcaatctgcccgccttggcctcccaaagtgctgggattacaagcgtgagccaccgcgcccggcctattaatgttaaacttagttttaataacactttgtagacatatttatccaatttttaatgtctgatcataaggtaagtttttgttttttgtttttttttttttttttgagatggagtcttgctctgtcgcccaggctgaaatgcagtggcacgatctcggctcactgcaagctccacctctcgggttcacgccattctcctgcctcagcctcccaagtagctgggactacaggcgcccaccaccacgcctggctaattttttgtatttttagtagagacagggttttacttgttagccagggtggtctctatctcctgacctcatgatccacccacctcggcctcccatagtgctgggattataggcgtgagccaccgtgcccggcccataaggtaagatttttatagactgtttttttttttctttttgagaaggagtttcactcttgttgcccaggctggagtgcaatggtgcaatcttggctcactgcaatctctgcctcccgggttcaaggaattctcctgtctcagcctcccaagtagctgggattacaggcatgcaccaccacacccagctaattttggatttttagcagagatgggggtttctccatgttggtcaggctggtctcgaactcccgacctcaggtgatctgcctgcctcggcctcccaaagtgctgggattacaggcatgagccactgagcctggcctgtttttaactttttataatttttgttaaacagcgggttagtgctttaagaaaaacccgttgtgtttttattttaatgctcagttcacagaaaaactgggtgatacccttttaaccttagccaatatgtttacacacataatttccattacaattaacattttaaaacttgcttaaaccttcaaaacaaattttttttttcttttttgagatggagtcccactctgtcacccaggctggagtgcaatggtgcgatcttggctcactgcaacctccgcctcccacgttcaagtgattctcctgcctcagcctcctgagtgagtagctgggattacaggtgcccaccacaacgcccagctaattttcgtatttttagttgagacggggtttcaccaggttggccaggctggtctcaaactcctgatctcaggtgatccacccacctcggcctcccaaagtgctaggtaggattacaggtgtgagccaccatgcctggccacaaaatttttttttaaccttttaatgtaggtaaaaatccacattcttatgcctccttataatccttttactaaaagtatattttactttccttatacatcttgcacataaattgtttcttcaatagttttacattcagggtaacacccctggtggcctttggaatgtgtccagacttgctggcttcttgcttctagcactcccattatctcaagtagccatacatttcaaagaaaatgctaaaccatcacatctgtagttcattagcttgatacatcgcttcctttcaacccccacatcctcaccccctgtttgtttgatcaccaataaatagtgtgggcttccagagctccgggcctttgcaacctccatactagtattggccccctggtcccactttctctctgaacttgtgttttctcattcctttgactctgctggacttcgtagcccccacggcctggtgttgggtctgatcaccccaaaaggttgatggccttttttttttttcctgcattgctgagagcttgggttattccttgcactgggtaggtcttgatttttcacgcctgaggccgccacaatagggcggggttcacctcctcaagagagagaaccagagaccacccccagaggggaatgtaatcccagacaagcccccaaattgttatatataaagtttcggtgccgcaaaaggaatatcactcaaatataaaattttccttttaattctcagcaaggctaggtacttctatatagaagggtgcacccttacagatggaacaatggtgagcgcacacttggacaagggaggggaaggggttcttatccctaatgcacgtggcccctgctgctgtttcgttcccctattggctagggttagacagcacaggctaaactaattctgactggctaatttaaagagaatgacgggatgagtgctttggcgggagtcagggcagagcaggtggcaggtgatcaaaatgagttagggtggagcaggagatcagaatgagtcagggtggagtaggtaatcaaaaaagattgctttacgaggaagttaagtttaaaagtagaaggtaaagaattgaacataatgacaattatttgaaaagaaatttagaactcatatctaataccctggaatataagaggaagttgcatgctgcctcctcggttttatcccaggtagctctagctttcttgctgcccacagaggcctggagcaggagagatgctaagatgccatggagtgcccatttggccactggcagtctgggcaggttgcccctttctgggtttgtggtgacggaggggaggccaaaaggcgcagactgagtccccaggtggctgcaggcagctccagcccagtcctgaggatcctcctcaccatggtcacctgccttagtaactgtgcccaggaagtggcctgctgcttgctgtgctgctgcttttcctacttctgcccttccctgccacccctcacatgtctcagttgacaagcaattccttgtctcccctggccccctagggaaagggctaagaaacagtccatgtacaccccgaccttactagcctaaggtgggcaaaggagtgtggagcagcctagagtacagagccctgggggaggagcccgctaataagggacgctctcctatagccatatttaaatgctagctaggctgaggtggacaagctctgccagctgctgtcatcttcagaagatagacgcagcagtaaggaatatttgttttgcttttttataaaatgtttaaaagcactgtggctaagaaacttcaggccgggcgcggtggctcatgcctgtaatcccagcactttgggaagccgaggtgggcggatcacgaggtcaggagatcgagaccatcctggctaacacggtgaaaccccgtctctaaattagcccgctgtggtggcgggcgcctgtagtcccagctactcgggaggctgaggcaggagaatgctgggagtggtggcatgcgcctgtagttccagctactctggaggtcaagatgggagtccagggcggttgaggctgcagtgagccaagatcgtgccactacaacccagcctgggcaacggagcgagaccttgtctcaaaaaattaaaataaaataaaaactcccacaaggaagaaagtagtcatctttatagagtcctctccatgtagtgttagcacaatcgctcaagaggcacccaatgtagagaaacgacggtgaggttagcagtaccaaggagcagggtttgaatcccggctcttgctcttttttttttttttttttttttttttttagtatttattgatcattcttgggtgtttctcagagagggggatgtggcagggtcataggatagtagtggagagaaggtcagcagataaacacgtgaacaaaggtctctggttttcctaggcagaagtccctgcggccctcggcagtgtttgtgtccctgggtatttgagattagggagtggtgatgactcttaagcatgctgccttcaagcatctgtttaacaaagcacatcttgcaccgcccttaatccatttaaccctgagttgacacagcacatgtttcagagagcacagggttgagggtaaggttatagattaacagcatcccaaggcagaagaatttttcttagtatagaacaaaatggtgtctcctatgtctacttctttctatgcagacacagtaacaatctgatctctctttcttttccccacatttcccccttttcttttcgacaaaaccgccatcgtcatcatggcccgttctcgatggtcgctgtctcttcagagctgttgcgtacacttcccagacagggcagcctggcagaggcgctcctcacctcccagacggggtggccgggcagaggcgcccacttcccagacggggcggccgaatcccggctctttcatgttttagctgttgggctttggggaagttattctacctctttcagcctgtgcaccctgtctcatcattaaaaaatgagaatgaggccaagtgcagtggctcatgcctgtaatcccaacgcttggggaagcggaggcaagagaattgcttgaggccaggagtttgagaccagcctgggcaacataatgagatcccaatctctgcaaaaaaatttaaaaattatctgggcatggtagcacacgcctgcagttccagctactcaggaggctgaggtgggaggatcacttgagcccaggaatttgaggctgtagtgattgctccactgcactctagcctgggtgacagaatgagaccctgcctcaaaaaaaaaaaaaaaaaagtgaaaagtgaaaatgataatacctactatgaaggattgctttaagaagaaatgagataatgtacacaaaagtacatcacatatcgcttagcatgtggctgagactcagaaaaaatcctggctttgttttcctgcattgggagtttattgttgtcaaagtgatggttccaagaagtcaaaggagagccagagaactggacagctcagcagcagttggtttgggtcaccaaatgcctctcttccctccctattgccactgacttagatcctggagatgtaaggttttaaaaacagcagcctattatcttttatttttggtaatccttgtaacctggttccctatcttaatgaaaaaaaccaatggttctggctttattacctaaagaaaggaatgacagtataataccaattataaataaatgggtcaaatttttggctttagagtttcaaagacttatggcattaaaaaaaaaaaaaagaaaaaatggaccgggcgcagtggctcacgcctgtaatcccagcactttgggaggctgacgcgggtggatcacttgcagtcaggagtttgagaccatcctggccaacatggtgaaaccccgtctctactaaaaatacaaaaattagccgggtgttgtggcacgtgcctggaatcccagctacttgggagactgaggcatgagaatcccttgaacccgggaggcagaggttgcaatgagctcactgcactccagcctgggcgacagagcaagactctgtctcaaaaaaaaaaaagaaaagaaaagaaaaaaagagaaaatgaagagttccttttctcaacactctcatcaatacatgcatgcacacacactcttgcatgcagccatgaattctcatgtgtgcatacacacattcaaaggactagataaagattctccagactttgcaatagggaagtcaggtggaagcagggagctagaatggataatgtatgaagaaactattaatgtgttttttccttttatactcttttgccttcagcaagtaaatgacctctttcttatttggttgtggcatcaaactgcttgtgaggagattaagattgtttcagaagaaatataaagagaaggaaatggtaatatgcatctattgaaattcaaaataggattttgcagcaagacaatggacttgaaaactggactatgagaaagaaattgttttctgcattcatttagctcccatttaacataatcaagagccagatctagaatcaagtttctaccaaaggaggaggtaatttaatctctcatctttgatttcctatatgtccataatgaggataataacagctacctcaacagattgtttccaaagggaacccttgtcttttgaagtggcaattagagctaggaagccaaagataagatatgaaaagaataaaagagaagcctaccacttctcatcttggagtttcaacaagacgaaggcagggaggtgagagtcaaggagatgccttggaattgggggaatggcttcagaaacatccagaaaacagaagagatcactgaagctgctacaaaattttgcccattgtagataagtgggcaaatcaggatgcactggcagggagacagggtctgttttgtgttaccagcccttttccagtgatgggtattgaattgagagccatgggcctgccatggggcatggggggtaggaagagggtgacctggcagcagaggcatgtggtttgcataacttggttaggagctgaatgggagacatggtagagattcaggggtcccactgggctaccgagagccacagggaggttgagtcagccagaaagcaccagtgagatcagatccagccaagagatccacgagaaactctaaatgttgactttagccaaaggcccccaggatgaatgtgaccaagtacatactgactcataaaccggaggagctggaggacactctgagaacccaaggacccttgctgtcctcctatacctgtccccaggagattgcttaagccactctatttattttcatgctcatgggtttgtgagttgtctgtggtttgtctaatcaggctgggcttgacagggcttggtaggactcctttagtcctggtccagtgtctattctgggtcacagctgaaggggcaatggatatctggaatttgcctttctcttgtcagatcacaggagtgcaagaggccaagccaaactacaaaagcacattgaaagcatctgcttgcatcgtgtcctctgacattctgttggcacaagcaagtcacacagcaaaggggatggatgtacacttaaataataaggaggaagcaaaggattgggaataacagtccaaaccaccacagggccctacctacccccaagaagtaatatcctcagattgatctgggaaatccaagagcagatgatgtttcccatgtgccaagaatatcagtggagtatcacacagagggccccaaaagccagcacgccaaggatgatggagcaggatgaagagaccctgggtcttagataatatcgttagggggcttactggctgctgacctccggacatttttgaaatatgaaacaattaaatgtctttattaactgacattattagctgagttttctgttgctttcatctgaatgcatcctcactgttgcaggactctatttttatttttatttatttatttatttttgagatggagtttcactcttgtcgcccaggctggagtgcaatggtgccatcttggctcactgcaacctccacctcccgagttcaagtgattctcccaccttagcctccccagtagctgggactacaggcatgtgccactatgccaggctaattttgtatttttagtggtgacaggtttcaccgtgttggccaggctagtcctgacctcaggtgatctgcccacctcgacctcccaaagtgctgggattacaggcttgagccaccacgcccagccttgttgcaggactcttattaaccctatttgtccatgagacccagagacataaaggcgggagtttgggttttttgttttgttgttttttcaggcagccctctgaaccaaaatgggttcagagagactccctggaggttgggtttgatctcagactttgtctccagagcacatgcttttacccaccattgtgttatcctaccttccaagcttgcgtgaggctgaagtgtcttatgtacttgtagtttattcaaaggataaagtggtaaaatgccctcatagtgaaaaagtgaaaggtctgtgcatggcagtaaaaaagtgccaatgtgaccttggtctggccggtagctggtcaactcaggaaagagtcagctcccagagacccctactcagttgtaaggcttgtcttgggattgccccagctttactcagagaggaatgttgtagtgaaggtgactccatccaacaatttagtcaaacctgcttgcttgaatcaggccctctcaagtacctcctcccttcattactctattctcctttgagatactgggaaggaaatttagcaaatagctggtctaagccatcagctctcagatccactctatagattaagatatctggatcacatggaaatatttgtctaagttgataccagggacagacccaaccatggtctgcccccaggaggtgctcagtcaggatttactaataaacaaacaaaccatcatctagtattaaggactgatgattgtcactaggatccagcgataacttgacttaaagttctatttgccagaatattcagggttattgacattcaagggaactgactgacgctagccaaagtcacacgagactgataggtaagctagaatacctgggacattgatttttccagtgagtagtgaattcttgttcctcagcctaaggcacttcctggtactaaggtgcagatgcagactaaacaagatgattacccaacatgagccagagggtcagaacctggtgagggaagtttctccagggccctgcagaagccactgagctatccgtgccttgggtggatttaggaattttgaaagtgtgacttaggccgggtgtggtggctgacgcctgtaatcccagcactttgggaggccgaggcgggtagatcacgaggtcaggaaatcgagaccatcctggctaacacgctgaaaccccgtctctactaaaaaatacaaaaaattagccaggcgtggtggtgggcgcctgtagtcccagctactcgggaggctgaggcaggagaatggcatgaacgcgggaggcggagcttgcagtgagccaagatcgcaccactacactccagcctgggcgacagagtgagactccgtctcaaaaaaaaaaacaaaacaaaaacaaaaacaaaacaaaacaaaaaaactggaaaatctagtcctgcccaagctcctctctctgtctttgaggggagccaatctccagaaatcgctgctgtcttccccattaccctgcatggctgctggctcccaggtgaccatcccagaatctccaagtgttcagggccacctctgctgcatctgccagaactcccaagcttcactgacctcctatgatgatggggcccctggtgctgacacagctcagcctctttatgagaggctcctgcacagagggaccaggactgcactgacacctccttgcctagggctctgcttccacagctgggctgtagcccttctttcttccggtcttctcctttgttctgaagcaggaggacttcccagggcattccagtttgccgtgtttctttcactcattccgccaaacatatttattggtggccaattttgtgacatcaatgtgctaagcactggggtagtggtgaacaaaagttaggtccctgtccatgtagtttagggtccagctgagaataccaacatttaatgagacatcacaatgaaatgtgctgagagtcatggaacagagacacctaatctagtgggagagaaagcaaagccctttctaacaatgtgaagtttatgatgagaactggagaatgagtagaaattagccccgtaaaagaatgggggcgaagaggcttactgttttatacaaattgcttccaatagcagaaaaatgcttcatgagataattacctagatacagagttataaccaacattaaaaacaaaacaagcggccaggcgtggtggctcacgtctgtaatcccagcactttaggaggccgatgtgggcagatcacgaggtcaggaattcgagaccagcctggggaagccaacatggagaaaccttgtctctactaaaaatacaaaaattaaccgggcgtggtggtgggcgtctgtaatcccagctactcaagaggctgaggcaggagaatcgcttggacctgggaggcagaggttgcagtgagccgagattgtgccactgcactccagcctgggcaacagagcaagactccgtctcaaaaacataaaaaaaaacaaagaaaagaaaactaaaaacaaacaagcaaagaaaaaaaaatgcctttcaaaaagagagtatactttcaaactattttataagacttaatataacctagtctggtagcagtggctcatgcctgtaaccccagcattttgggaagccaaggcgggtggatctcttgaggccaggagttcgagaccagcctggccaacatggcaaaaccccatctctactaaaaatttaaaaacatttttttaaaaaattaggcgaccatggtggcacatgcctgtaatcccagctattcgggatgctgagacacaagaatagcttgaaccttggaggtggaggttgcaatgagctgagattgtgccactgcactccagcttgggtgacagagcgagactcttatctcaaaaaaaaaaattaatataacctctataacaatattagacaaagacagtgaaagaaaggaaagctataggctaatctcactgacaaacatacctggaaaaatcctaaataaaagttttgcaaatgaaaccaagctgtgtgtgtgagcatgtgtgtgtatttgtgtacaatgctaacttgacaatgaaaaataaaaaatccataaataatgacttatttcacttagcataatgtttttgaggttcctcaccgttgtagcatataatgtatcactaccacattcctttttttttttctttccttgagacagggtcttaccattgcccaggctggagtgtagtggtgtgatcatgtttcactgtagtctccgcctcctgggctcaagtgatactccaacctcttgccttccgagtagctgggaccacaggcacgagtcaccatgtccggctaatttttttttttttttgaggaagcaatttctttaattttatcagaatccaggacacaagaagaaaaacacccaaaaaccacatggagacagaagacaagacacaactcctcccccactgcctccctgctctagagtggggacaaagtgggggtgagacagctggggggagacctgaacctcagtccagccctacaggctccaggcctgcagggaaggagggtaacggggaggcagggcccagccccccagtgtggggaaacagctgagggaaggcccccctcaaaaggctccacctcctcaccagcactcctgcccagggacagggagcccacagcagcaaggggacccccggggccatggccacgttcatgactgagaagcagctgagtggaggcaggagacacaagattatctgggcagaatcagttggggcaggggcctgggagggccccatgggccaaaccctaaggttacaggagggggcccaaagtggggctagtgagtgaggtcctgagtgagtgggtcagtggctgggcctctttctccagctgcctgtagcccctccaatactgctgccaggggggcccgcctccagggaaatgggataagaaagcagcctgcccctactgcagacagagccaggtggctgaggccaggaaggaaggcccagccaggccttgccacctgcccctagaggcctgtgggaaaaggacaggtcaggaagggtggggacaggggctcgaccagctcagacccaagatggtgccatgcttacttgctgagtcccccatgagctggggtactgcactggggccagcgactagttagacaggaggcagcagcttctcaagaaattccttcacagctgccatctcctgaggacaggagctgtgcatgacacccaggtatgtctggaactggaccctggcaggtgtgacaacagaccggagcttctcagccatcagggccccaaaccgtacgggcaccatggggtccagctccccatggcactggaggatggccaggtccttggcactgccattagctgcctgggggaaggcccggtgcagaggcggccagcagctcaaagccaggatgccagccagagggtgggggcaggtgagggccatgtagagggacagggcccggccctgtgaaaagcctcccaggatgatttgattggcagggatcccgttcttcatttcatgctcaatcaaggccttgatgttctctgctgccttcttgatgccagcctcgtcctctggggcatctggactcagccccatcaggtcaaaccaggagggcatcaccatcttcatgttgagggtcacagggatcctaggctcatgggaacagatgtacttgacgtgagggagccgaatggtggagagggcgtcagcccagctgtgccctgtgtctccaagtccatgtaaaaaaataaccacggccgtttcccgctcagctccagacacggtggcagcatcgttgagcaggggcacagacatggtgttaccacacatacaccacacggctccatggcaggggcctccactccctgggacttctgaggccgcttgggtgattctcctctttctcccgcagacacacactcttccccctcggccgcccccgccggaacactaatttttttatttttttatttttagtggacatggggtctccctatgttacttacctagcctggtctcaaactcctaggctccagggatcctcttgcctcagcctcccaaagtgctgggattaccacgctcagcccatcactccctgtgttcctttcatttatttttttctttgagacagagtcttactctgtcacccaggctggagtgcagtggtatggtcatggctcactgcaacctcaacctcccaggctcaagtgatcctcccatctcaacctccctagtagctggcattcctttttatggctgaataatactccattgcctgtacagatcacaatttatttatccattcatcagttagtgggcatttgggctgttttcaccttttggctattataaataatgttgctataaacatttgtatacaagtttctgtgtggatatatatcttcatttttcgtgggtatatacctgggagtagaattgctggatcatctcatagataaacaaagccagacactagctaaagtggtaaggacaggacaggcacagaggctcacgcctgtaatcccagcgctttgggaggccgaggcaggcggatcacttgaggcaaggaattcgagaccagcctgaccaacatggtgaaaccccatctctactaaaaaacaaaaattagctgggcatggtggtgcacacctgtaatcccagctactcaggaggctgaggcaggagaatcgcctgaactcgggaggcagattttgcagtaaaccaagattgtgccattgcactccagcctaggccacatagcaagtctccgtctcaaaataataaataaataaataaataaataaataaataaagtggtaagaacagattttaatcagtgacatattattgcaatagggaaaagagcctagcttgaactgaactcaactttgatttgtagagataactgggcattttaaagcaagaatgaaagaacagagagggtgagtggggactcaatgacgtcagagaagtgacagattacaaaaagtgggaagggggttggtctgtgttaagcccacctggccttgttagctggggcttatcattaggctcctacactctcacagcagctgggaaacaggggccttaccttcatctgtgggctggaacaaacagtacattcttttggcagccttgagttctctcagtcagacactttaaagggcattagggtcatcctagagatgtggccttgaactgttagaaactatgttagtgttcatgaaagtctttatcaagtcggacgcagtagctcatgcctataatcccagcactttgggaggccgaggtgggcgggtcacttgaggtcaggagttcgaaaccagcctggccaacatggtgaaaccccatctctactaaaaatacaaaaaaaactagctgggcttgggggcaggcgcctgtaatcccagctactcaggaggctgaggcaggagaattgcttgaacccgagaggtggaggttgcagtgagctaagaacgggccattgcactccagcctgggggcaacaagagtgaaactctgtctcaaaaaaaaaaaaaaatcctggtttttttttttttacctttttttttttttttgagacggagtcttgctctgctgcctaggctggagtgcagtggtgcgatctcggctcactgcaacctccgcctccctggttcacgccattctccttcctcagcctcccaggtagctgggactacaggcgcctgccaacacaccccgctaattttttgtatttttagtagaggtggggtttcactgtgttagccaggatggtctcgatctcctgacctcgtgatctgcccgcctcagcctcccaaagtgctgggattacaggtgtgagccaccgtgcccagcccctggttatctttttgtaccttttgaaatatatgtaaatatgctggttttgcaaacattaaattaataataaaagccatgccatagcagactacatcatatataggtatataaccaataaagaattactgtctagaatttacaaagaactccacaaatcgatatgaaaaagacaaccaacccaagagaaaaaaaaatttaaatataggaaagacaatccctcaaagagaaaatagaaaatgcaaattaatactgacattttgggcttcaaaaaaaagcaaattaaaataacgacaagggctgggttcagtggctcacgcctgtaatcccagcgctttgggaggctgaggagggtggatcatgaggtcaggagttcaagaccagcctggccaagatggtgaaaccccatctctactaaaaatacaaaaattagccaggtgtggtggcaggtgcctataattcccgttactcaggaggcagaggcaggagagttgcttgaacccagggagggggtgggggcgcagaggttgtagtgagctgagatcataccactgcactccagcctgggcaacagtgagactccgtcttaaaataaataaataaataaataaatacatacatacatacataaaataaaataacgatgaggtgaaaaaaataaaattaataaaattaaaaataaaataataaaataacaaggcgacattcattaaattggcaaagacaggtttgggaatatcagatgttgctgaagctccagggcaacagggactttcttctagtggatgggagcgtaaaccagaaaaaccactgtggagaccatttggcaatatctagtagagttgataatacaactctacttatgagcttatacccagcctctcccacatttgctcaagaaggcatgcagaagtatgttcattgcagcattttttaatataacagtatataaagtaattggaaatactttaaaatccataaacagaagaatggatacattatttgtgatatatttatataattgaatattaaagagctgcgttatcccacatggtagcaatgagccacatgaggctatttaaacttaaatttaaataattaaaattacgtctatgtttcacattttaaaaatttaaatttagttccttggccaggcacggtggctcacgcctgtaatcccaccactttgccgaggcgggcggatcaggaggtcaagagatcgagaccatcctggccaacagggtgaaaccccatctctactaaaaatacacaaattagctgggtgtggtggcacatgcctatagtcccagctactcaggaggctgaggcaagagaatcgctcgaaccctggaggtggaggttgcagtgagctgagatcacgccactgcactccagcctggcgacagagcaagactccgtctcaaaaattagttcctttgtcacattagccacatttcaagtgctcagtagccacatgtgattagtgagtacccatattagacaatgctgatatagaaaatttccatcattgcagaaagttctattggacagcactgttctacaacataaaatgagctaactgggtctaaatatttcaaaaagaaaaaaaaacaaaaaacatcaaaatataagactcaaaaatatgaagttcatcagaaaaagaaggcaagttgtagaacacatagaatatcctcctatttaaaatttggtacagcatgatgactatagttaataacaatgtattgtaggcgcggtggctcacacctgtaatcccagcactttgcaaggctgaggagggcagatcacctgaggtcaggagttcgagaccagcctggccaatatggtgaaaccccattgctactaaaaatacaaaaattagctgggtgtggtggtgcgcacctgtagtcccagctacttgggaggctggggcaggagaatctcatgaacccggaaggcagaggttgcagtgagacgagatcacaccattgtacctcagcctgggcgtcatagcaagactccctctcaaaacaaacaaagcaaaacaggccaggcatggtggctcacgcctgtaatcccagcactttgggaggccgaggggggcggataacgaggtcaggagattgagaccatcctggctaacacggtgaaaccccgtctctactaaaaatacaaaaaaaaaattagctgtgtgatggctgacgccggtagtcccagctacttgggaggctgaggcagaagaatggcatgaacccaggaggcggagcttgcagtgagccgagatcgcgccactgcacttcagcctgggtgacagagcgaaactccgtctcaagaaaaagacaaaccaaaccaaaccaaaccaatatattgtattcttgaaaaatgttaagagattgaatgttgtgttctcaccacaaaaatggtaattatgtgaggtaatgcatatatgttaattagctagatttagtcattccaagtttatatatgcttcaaaatagcatgtaatacctatggaaactaagaattaggctgggcacagaggctcacacctgaaatcccagtgctttggtaggccaaggcaagaggattgcgtgaacccaagaatttgaaaccagcttgggcaacataggcaggccatgtctctacaaaaaatacaaaaaattagctgggagtggtggctggagcctgtagtcccagctataggctgaggtgggaggatcactggagcccaggtgtttgagactgcagtgagccttgactgtggcagtgcaccccagcctgggagacttgtctcaagaaaatactgaaaataaaaataaaaaagcaggccaggcgcggtggcttacgcctgtaatcccagcacttcgggaggctgatgtggatggatcacttgaggccaggagctcaggaacagtctggacaacaaggagaaaccccatctctatcaaaaaatacaaaaattaactggacatggtggtgcatgcttgtagtcccagctactctggaggctgaggcatgagaatctcttgaatccaggaggttgaatttgcagtgagccaagaagatcactctactgcactccagtctgggtgacagagctagaatttgtctcaaaaataaataaataaatatttaataaataaataatcaaaccaaaaccaaaccatcatgtcctatatgataaatatgtaaaatttatctgtcagtttaaaaataataggctgggcacattggctcatgcctgtaatcccagcactttggaaggccaaggcaagtggatcacctgaggtcaggagtttgagaccagcctggccaacatagtgaaaccctgtctctactaaaaatacaaaaattacctgggcgtgtaatcccagcactttgggaggccgaggcaggtggatcatgaggtcaggagattgagaccaaaaaaaaaaaatttttttgagacagagtactctgtcacccaggctggactgcagtggtgtgatcttggctcactgcaacctctgcctccccagttcaagggattctcctgcctcagcctcccgagtagctgggattacaggtgcccacaaccatgcctggctaatttttgtatttttagtagagatggggtttcgccatgttggccaggctggtctcgaactccttacctcaggtgatctgcccatctcggcctcccaaagtactgagattacaggcgtgagccaccacacctggcctctaagaactcttttttttttttccgagacggagtcttgctctgtcacccaggctggagtgcagtggcccggccataaaaactcttgaacaagaatggatgggggctgggcacggtggctcatgcctgtaatcctagccctttgctgaggttggcaaatcacttgaggtcaggagttggagaccagcctggccaacatagcaaaacactgtctctactaaaaatacaaaaagtagccaggcgtggtggaaggtgcctgtaatctctgctactcagaaggctgaggctggataatcccttgaacccaagaggtggaggttgcagtgagccgagatcttgccattgcactctggcctaggcaacagagtgcaactgcctctcaaaagaaaaaaaaaaagaattgatgggttggcagggtactgacacttggaggtgctgggagggtggtgcccagatgggccatggaagcgccaagcctcttcctcccaaaagctcaccctatgcatcttttaaatccagctattcatctatatctttaaaacgtcctgcataattaagtgataaacgtgtttccctgagttctgttagcaatcctagcaaattatgaagccaaggagggggttgtaggaaccctgatttatagcaggtttgtcagaagcacagatcacagccttggtcttggaattggcatctaaagtgggaggcagtcttttgggactcagccctccccctgtggaatctgataccatctccaggtagctagtggctgaattgaatcaaataggccactcagtatttgctggatagttaactgtttggtgtgtggagaaaaagtcccatacatctggtcacaagtgttttgtgttgtgtgagcagacagggagggtcttcagggattacagaaatttaatcaccctgagcaattggcttgttttacagcctcctgccgtgcagcctcttttttcctaaaccctgtgttgactgcagtcacctagttggttaaaactggctcctggcagaccccagaaacttgtagataaacctgagtgaaagttcctcattaccatgctgaaatctccatcctgggaggagctgtggcttcattctcatagcatgtgacctgtgtgcgggcgtgaggattcactgtgtttccaaaactgggacccctcctctacatgcaatgaggcaccctctcccctccccatcaccccctaaaatcctcctgtcacttctctccgggagacactgctttgaagaatcctcccagtgctctccttacttgtaattaaactcctgttgattaaaacctgccttgtggagagtcatttgttatttgccaggcaaacaaaccctgttttttttcaggtaacaagagtatggtggaagaaaacagtttaggtcaggcacagtggtgcatgcctataatcccagcactttgggaggccgaggcaggtgggaggaacacttgagcccaggtgttggagaccagcctgggcaacatagtgagacaccccccaactccacccccataaaaaaaaaaagaaaaaaagatgtaatcccagcactttgggaggctgaggcaggcggatcacttgaggtcaagagttggagaccagcctgggcaacatggtgaaaccccgtttctattcaaaatataaaaaaattagccaagcatggtggtgggcgcctgtaatcccagctactccagaggctgaggcaggagaattgcttgaacccgggaggtggaggttgcagtgagccgagatcctgccattgcactccagcctgggtgacagatcgacacttagtctccaaaaaaaaaaaaaaagaggccaggcacagtggctcacacctgtaatcctagcactttgggaggccgaagcgggtggctcacctgaggtcaggagtttgagaccagcctggccaacatggtgaaaccccatctctactaaaaatacaaaaattagccgggtggggtggcacgggcctgtaatcccagctacttgggagactgaggcaagaattgtttgacccgggaggtagaggttgctgtgagttgagatcgtgccaatgcactccagcctgggtgacagggtgggactctgtctcaaaaaaaaaaaaaaaaaaaaaagtttgtgtttacagttgtataaggaagtggtgtctgtgaggtttgctgaggctcagaaattaataccccaaaatatgccaacatgctgaactgaagaagaaacttcaaggtttctctgacctctcttctcaaccagctctcccacaggcaggatgagttattctctgaagttcctttatctgcttcaagtccagacataccacaaagaataattgttttctcttcccctccctgtaagatcaggaatggaatcacacctgagcaggtcctttcccaaaagagtctgtctctcagctcattcacattccacagggaactattcaaaactcaatctctatctctgggcccattcattctccctaataatcgcctatggcccctcaagagaattcctgttccctatcccataacctgttttgccaggatggtaaataagctcctgaaccctgttgtggattggttaatcactctgtggttctctctgtgtacacattaatccatttatatgcctcttctccaatgcaccttttttttttttgttttgttttgttttgttttttggacagactcttgctctgtcgacagggctggaatgcaatggcacaatctcagctcactgcaacctccacctcctgggctcaagtgattctcctgtctcagcttcccgagtagctgggattacaagcacacgccactgtgcccagctaatttttatattttcaccatgtttccaggctggttttgaactcctgacctcaggtgatccacccgactcagccccccaaagtgctgggattacagatgtgaaccaccgtgcccagcctgcatctatctttcgtgagttaattttccagccaaccttcagagggcgaaagggaagttttcctttggcccatacaggttcattatagctattctatgtagttttctacttaagtatgtcataatttcaaaagagaaaaagagaagggagaaaattgttctaagctttcaatgtgaaggcctggcacttttaaagaataacagcttctgtggccagacttttagtatcagtatggactttccctggagaagtccagccagatgggcagactgggcagatgcttatactgattagctagatttagctaatgggcagagccgtcacaatgcactggttgaaatggtgcaaaaaaataatgtaaggcttttttttttttggtacaggatctggctctgttgcctatgctggagtacagttgctcaatcttggctcactgtaacctccgtttcctggactcatgccatcctctcgcttcagccttctgagaagctgggactacaggaatgcaccatcacacccggctaatttttgtattttttgtagagatggggtttcaccgtgttaactaggctggtctcataaccgcccaatgtgtttaccttgcccgctgcctagacagagccgatttctcaagacagaggaattgcaatatagaaagagtaattcacgcagagcctgctgtgtgggagacaggagttttattattactcaaatcagtctgcccaagaattcgaggagcagagtttgtttttgttgttgttgttttgttctgttttttgagatggagtctctctctgtcacccaggctggagtgcaatggcaaaatcttggctcactgcaacctccacctcccaggttcaagtgattctcctgcctcagcctcagtagctgggattacaggcctgtgccaccatacccagctgatttttgtatttttagagacaggatttcaccaagttggccaggctggtcttaaactcctgacctcaggtgatccacctgcctcagcctcccaaagtgctgggattagaggcacgagccacctcgcccagcctggggagcagagtttttaaggacaacttggtgggtcaggggaagccagtgagccaggagtgctgattggtcagagatgaaatcatagggagtctaagctgtcttcttgcgctgagtcagttcctgggtgggggccataagatcagatgagccagttaatcaatctgggtggtaccggctgatccatcaagtgcagggtcgacaaaatgtctcaagcactgatcttaggagatgtttagggagggtcagaatcttgtagccttcacctgcatgactcctaaaccgtaatttctttctttctgttttgttttcttttttttcttgagacagagtttcgctcttgttgtccaggctggagtgcaatggcgcaatctcggctcactgcaatttctgcctctggggttcaacccattctcctgtctcagcctcctgagtagctgggattacaggcacatgccaccacgcccagctactttttgtatttttagtagagataggggttcatgatattggtcaggctggtctcgaactcctgacctcaggtgatccgcccgcctctgcctcccaaagtgctgggattacaggcatgagccactgcacccagcctaaaccataatttctaatctgtgttagtcctacaaaggcaatctagtccccaggcaagaaggaggtctgttattgtctttgttttaaagggctattaaaacaaagggaaagggctattattgtctttgttttaaattataaaccaagtttctcccaaagttagttcagcttaggcccaggaatgaatgacagcttggaggttagaagcaaaatggagtcggttaagttagatttctttcactgtctcagtcataattttgcaaaggcagtttcagtctctaactcctgcgctcaagcaattcacccacctcggcctcccaaagtgttgggattacaggcatgagcaaccatgcccaacctgtaaggcctttttaaaaaaatataaaatcagatatgaagttttctttggactgggcgtggtggctcacgcctgtagtcccagcactttgggaggctgaagcacgtggatcacctgaggtcaggagttcgagaccagcctggccaacatggtgaaatctcatctttactaaaaataaaaataaaaactatccagccgtggtgatgggcgcctgtaatcccagctactcaggaggctgaggcaggagaatcatttgaacctgggaggtggaggctgcagtgagccgagatctcgccatcgcaaatcagcctgggcaacaagagggaaacacacaactctgtctcaaaaaaaaaaaaaggtttctttgaagaattgttgccagaaagtggtcatgatccaaaccccaagagagagttcttggatctcatgcaacaaagaattcaaggcaaatccataaagtgaaagcaagtttattagagaagttaagaaacgaaagaaggttactccaaaggcagtgcagccctgagggctgctgtttgcccattgttaagttatttcttgattatatgctaaacaagaggcaaattattcatgcctcccctttttagatcatatagggtaacttcctgatgtttccatggcatttgtaaactgtcaggttgctggtgggagtgtagcagtgaggacaaccagaggtcattctcatcgccatctttgtttcggtgggtttcagccggcttctttactgcaacctcttttatcagcaaggtctttgtgacctatgtcttgtgccgatctcctatctcatcctatgacctagaatgcctcaagtgtctgggaatgcagcccagtacgtttcagcctcattttatccaacccctattcaagatggagttgctctggttcaaatgtctctgacagaatggaagtcccctttctatttgtttgttttaaaaaataaagtcaggccgggcgcggtggctcatgcctgtaatcccagcactttggaaggccgaggcaggcggctcatgagccgggcgtggcgagcgcctgtagtcccagctactcgggaggctgaggccggagaatggtgtgaacccgggaggcggagcttgcagttagccaagatcgcaccactgcactccatccagcctgggcgacagagcgagactccgtctcaaaataaataaataaataaataaataaataaataaataaataaataaataattaaaaaaataaaaaataaagtcagagtttctgctatattgcccaggctggagttcagtgactattcactgacgagatcactgtgcactataacctggaaatcctacagtcttgaactcctggactcaagggatcctcctgcttcagcctccagcgtagctgggactacaggcacgcaccaccacatcaggctcagaagatcacttttaattagcaaacggctcactagcaagatttgaaaaacttcaaaaagctaagtataactctcaaatcgaatgcatttttactttgcacatactgttctcaagattctggcatccaagaaaaaaaaaataatacttctcctagggctaataaatttgtaaagacttgctattacatgacttgtttcaaatgtttgcagcatattgtttatataaattataatggtttccgtgaaatttaataatggttcaaaatttgtatcatttgagataagtgaggcatcagtgaatttactatgcttttcccacgttgtgttatattcaaagacaaaaatctatggctaggtatggtggcatacgcctgtagtcccaactactcctcagactgaggcgagagaatcgcttgaacctgggaggcagaggttgcagtgagctgagatcgtgccactgcactccagcctgggtgacagagcaagactttatctcaaaaatttaaaaataggccgggagcagtggctcacacgtgtaatcccagcactttgggaggccgaggcaggcggatcacgaggtcaagagattgagatcatcctgcccaacctggtgaaaccccgtctttactaaaaatacaaaaattagcagggcattgtggttcgcacccgtggtcccagctactcagaaggctgaggcaggagaatcgccaagatcacgccactgcactctggcctaggcgacagagcaagactccatctcaaaaaaaaaaaaaaaaaaaaatagaaacacagtggctcacaccagtcagtaatcccagcactttgggaggccaaggcaggtggatcacgagatcaagagttcgagaccagcctgaccaacttggcaaaaccccatcacaaaaaacaaacaaacaaaaaaactctcggcaaaacagagcaaggctccatctcaaaaaaaaaaaaaaaaaaaaaaattagccaggcgcgatggcggttgcctgtaataccagctactcaagaggctgaggcaggagaatcacttgaacccgggagctggaggttgcactgagctgacatcgcaccattgcactccagcctgggtgacagagcgcgactctgtctcaaaaaaaaaaaaaagaaagtgatcacattttgggaatgcattgactataccctaaaaagctcaggagaatatacagttgaggctgggtgtgatggctaacgcctgtaatcccagcactttgggagggcgaggcaggtggatcacctgaggacaggagtttaagaccagcctggccaacatggtgaaaccccatctctacaaaaatacaaaaattagccgggcatgatagtgggtgcctgtaatcccagctatttgggaggctgaggcaggaaaatcgcttgaacccgggaggcggaggctgcaatgagccgagatggcgccatggcactccaggctgggtgacagagcgagactccgtcttgaaaaaaatgacatcactatacttcacatgggctcatttattgtcattattattattattttttgagacagagtctcactctgtcgcccaggctggagtgcagaggtgtgatctcggctcactgcaacctccacctcccgggttcaagtgattctcctgcctcagcctcctgagtagctgagactacaggtgcccgccaccacgcccagctaattttttgtatttttagtagagaccgggtttcaccatattggccaggatggtcttgatctcttgacctcgtcatccgcccgcttcggcctcccaaagtgctgggattacaggtgtggcgctcatgtattttgtaatatattttcttttcttctttctttttttttttttgtgtgtgtctgtgtgtgtgtgtgtagaggcatggtctaaatatgttgcctgggctagtctcaaactcctgggcttaagtaatccacccactttagcctcctaaagtgttgggattacaggcatgagccattgtgcccagcctgttatagactttaaaataaatttgtttatgtatttgcttataccctgcacaccctaagtgcagtgtagcctcaacatgtccaagcagagcccttgaccttctccacaaaactcctcctcttttggtgcctgtctccctgtgactgactttgccagccacccagttgctcaagccaaaaatctgacattctccctccaactaccttctctgctcgccccacccatttcatgtcttatccatctccaggtcctgctggttctgcctgttaagaaccttccacatctctgacctctctgcatcttcacaactacacttttgttcaggtcctcttgcctcttgcctggatgactacagtggtgtcctaactatctttcctcatcctcacccaattactgccaatctattctccattttgtagctagcgtgttctttcaaaaatgcaaataccttcacatcactgcctaaattaaagagcaccccctctcattgctgaagtgtaaagtcccatgatctgatatgttcccttatcaactaacaagggccctacagttaagaaaaccaaagttacttctggctgggagtggtggctcatgcctgtaatcccagcactttgggaggctgaggcgggtggatcatgaggtcaggagttcaagatcagcctgaccaacatggtgaaaccctgtctctactaaaagtacaaaaaattagctacgcatggtggcgggcgtctgtaatcccagctactcaggaggctgaggcagagaattgcttaaacctgggaggcggaggttgcagtgagccgagatcgcaccactgcactccagcctgggcgacagagggagactccatctcaaaaaaaaaaaaaaagaaaagaaaaaaagaaaactaaagttacctacaggtagagggttcagagtctggctggcatggcaaatttctaaattcctatggctataagaaaagccatagtcttactataaactctctaacaatagggagttaggagctatcagacccctcttaactatgatttacaacccagatcactacaactccgagtagacgaaggacaggccttccaaacattctgtttttattttattttattttattttatttttttgagacggagtctcactctgtcgccaggctggagtgcagtggtgcgatcttggctcactgcaacctctgcctcccgggttcaagtgattctcctgcctcagcctcctgaatagctgggactacaggtgtgccaccatgcccggccaattttttttgtattttcagtagagatggggtttcaccatgttggtcaggctgttcttgaactcctgacctcaggtgatccaccagccttgggctcccaaagtgctgggactacaggcgttagccaccatgcctggctgaatgtgatcgccttcaatgatggcagcacccctacattttacacaggaccaccagtagggtggataggtgagcggcctgtaggtggaatgagaagggcagtccctttcttttccttctttttttagtagagaagtggtctcactatgttgcccaggctgatgctgaattcctggtctcaagcaatcctcccaccttggccttccaaagtgctgggattataagggtaagccactgcaccaggccaagcagtcactttgacataaagaaagtccatcccttgaccagcacagctaacctgggagagcagaaggtcagcacatcaattgaagagaagagaggacattaatgggaagagcctgttgggttgtggaacaaccttcctgaaagctttgagaggagataggcagagctattcccagaggacaatctggcatgtagcacagaggctgtggagtggatgggatgactttcctgggtgccagtgaagcatgtggcgcgacaccatcagtgagggacacacaggacgaaggactcctttgactacctgccactctaaggtaacagagataccaccacagttggaacacaaagaatgggggcgggggagccatcactaggacccacacatacagctcaagcttaagggtcaaagtggaccagccggtagcccaatcatgtgcgatccataaaagaaatacctctctgctagcagaattgatcctacaaggctacagaaccccatgagcgcccaatgggagcgagttctctgctggcacaggctggcccttggctctgtagagtgacttaggaaatttcaaggaagatactccaaagtgcagagtcccttcaaacacagggtccgaggcagggcccaggccactcaggctactccacggtactctgtggaggcatagcaacaatgtctaggctgggtgcagtggctcatgcctgtaatcccagcactttgggaggccatggaaggcagatggcttgagtccaggagtttgagaaataacagtggcttaaacaagagacaagtgaatttttcctgtaagcaaattctgagataaccagtccaggactggtgcagaacttccaagattaccaggaaggcaagacatttctaatttgtggttcttttttctttttttttttttttttttgagatggagtctcactctgtcgcctaggctggagtgcagtggcacaatcttggctcactgcaaacttcccctcccgggttcaagcgattctcctgcctcagcctcccaactcccaagtagctgggattacaggcacatgccaccacgcccagctaatttttgtatttttagtagagacggggtttcaccgtgttggccaggctggtctcaaactcctgacctcaggcgatctgccctccttggcctcccaaagtgctgagattagaggtgtgagccaccacgcccggtgaagcttgtggttcttctattctcaacaaatggcatggtttgacggggaagggcatactccttcctttagggctctccctgaaatgtggatatattacttccatttgtgctctattggccagagcactgtccattgccatacctagtctcaagagaggctgggagttgagatcttttttggtggccatgtgtcttgcaaaaaaaaaaatctagggtttattaacacgaaaagattggagaaacaatactggggggaaactaacagcctctatcaaaggctcagtgtcagtatcagtattatgctcagctgtgagaggctggaccaaggttgagagcctgagccacagcaccctgtgtgggcaggacacccctgggcaggcctgtagcactcgaggtggccgggcagaaaaccttgccctgtggggatctctatagcagatggtggcaaactgcatgatgcagaagaaaaggagtgtttactctttttccccatgttgcccaggctggtcttgaattcctgggctcactccagcacagactttgcccctgtaaaccttcacccttccccatcctggaagtagggaatcccgaccaactgacagatttgtaggagactcctgctcctatccccagggtaaagccttcatggtctgccccctcctacccatcccgccagcctcagctccccagactgttccgtgctgcagcccttctcagttctgcacacttgatgagcccggctctggcctgtcgtgccctgctgctgctgctcagggatacgtacaattgtacagactgtgctaagaacttcacatgcatgatctcttttagtttttgtcgctgcctctctgctcatctgtactcctcactgggcaggaactttgagaaatggaggcccacatctgttgtgttcactgctgtaatcccagcaagcagcatggtgcggcaccttcacagggcctctggctccagatcgttggcacacagtaagtgtttctttttttaaaattattattattatttttatcgagaaggagtctcgctgtgttagcccaggctggagttcagtggtgcgatcttggctcactgcaacctccgcctcctgggttcaagcaattctcctgcctcagcctcctgaatagctgggattagaggcccgccaccacgcccaactaatttttatatttttagtagaaacgcggtttcaccatgttggtcaggctggtctcgaactcctgacctcatgatccgcctgcctcaccctcccaaagtgctgggattacaggcgtgagccactgcacccagccataagtgtttcttatgttgaatttgcagcttgtataaaaatgaaccaagacattatgaaatacagtcactttttttttttccttttgtgactaatttttcttaaggagcagtgatcagggaaaggaagatgtttccctagaactcctctagagggcatatcttccctggatctttgacattgattttcggagcggtaatggatcttacacaaggagtggccatcccctaggaggcctgtccacgcagatggagggtgtggtggtgctgagtgatgtctccctggcagcttggactggagaccctagagggaggtcttcatgtccaaaggcagggatctggaagaaggggaatgtgtgtgcacagactgccccctgcccttttttttttttctttgaagacaggatctcactctgtcacccaggctgaagtacagtggtgtgatcattactcactgcagcctcgacctcccaggctcaggtgatcctcccacttcagcctcccgagtagctgggactacacctatgtgccaccatgcctggctaattttttgtagagacagggtttccccatgtttcccaggctagtcttgaactcctgggctcaagcaatccacccactttggcctcccaaagtcctgggactacgggcatgagctactgtgcctggtctagactcccccttttttttttttttaatgagatggagtttcactcttgttgcccaggctggagtccaatggcgcaatcttggctcaccacaacctctgcctcccgggttctagaaattctcctgcctgaacctcctgagtagctgggattacaggcatgcaccaccacgtctgggtagttttgtatttttagtagagatagggtttctccatgctggtcaggctggtctcaactccccacctcaggtgatctgccagcctcagtctcccaaagtgctgggattacagattacaggcatgagccaccgtgcccggcttttttttttaggcggagttttgctcttgtcgcccaggctggagtggaatggtgcgatcttggctcactgcaacctccgcctcctgggttcaagcaattctcctgcctcagcctcccaagtagctgggattacaggcacccaccaccacgcccagccaatttttgtatttttagtagagatggtgtttcaccatattggccaggctggtcttgaactcctgacttcaggtgatccacctgactcagcctctcaaagtgctgggattacaggcgtgagccaccacaccgggcctagactcccatttttatttaacgtcttccatttcttatcagagaaatgataataaaatatagaaaagcacaattctttattttaaccccacctctcgctcacttaaatgaccagttatttccaagtctggatctgaaaatttctattatgagagactctccaggaccttcattcagttccacgtgtagttgtgacattgtgtgatattggcacacggttggaaataacacttgtgtagcagtttgagatgaaatataggcaatgcctggcttctgaaagtgccttcaggcctgatgttacacaagcattctcagcccaacttgcctcccctcctatttctatctctacctttagctgggtatttggatagttcaggggaaaaaggggtaaagatgagatgacaaaagacaccccagccgctgggcccagcactttgggaggctgaggtgggtggattactgaggtcaggagttcgagaccagcctggccaacatggcaaaaccctgtctctacaaaaaatacaaaatttagctgggcatggggtgcaggcttgcagtcccagctatttgcggggggaggggagctgaagcaggagaatagcttgaacttgcaaggtggagtctgcagtgagccgagattgtgccactgcactccagcctgggtgacaaagtaagaccctggctaaaaacaaacacacacaaaaatatatcattatgcatttctgaaagcaaatgtgctataatactgctttgatctgaatgtcccccaaaattcatatgttgacatttaatctcaactttggtggtattaagaggtgaggttgtttgggaagtaattaagtcatgaggactccactcccatgaatgaattgagggaaagggctggagggaagggctggagggaactagcttcggcccttttttgtccttctaccatgtgaggacacagcattcatctcctccggaggatgcaacaacaaggctctatgtgaagaaggaaccaggtccctcaccagacactgtacctgccggcaccttgatctttcacttcccagccctccagatctgtgagaaacacatttctgttgtttataaattactctgtctcaggtattttgttatagtagcacaaacagacttagacaaataacgttttatgtttacaacccataggaggaaaattctggatttggaatctatcttggcaagataatacatagatatgattataagaaaatcagtgaggtcataaacagtggcttaccaacataggttggtatacaaatataacttcacataacaaatatagttgacttgaagtaaacaaacacaatctactatagcattctgacaaatgtagtttcctataacaaataatcaaagccttaagtttcaggttacagttttcagagttagtagtagccaattactgccaggcatagtggctcaaacctgtaatcccagcactttgggaggccaaggtgggaggactgcatgagcccaggagtttgagaccagcctgagcaacatggtgagaccctgtctctattttatttcattaaaaattttaaaatattggccaggagcagtggctcatgcctgtaatctcagcactttgggaagctgaggcaggcggatcacttgagatcaggagttccagaccagcctagccaacatggtgaaaccccctctctactaaaaatacaaaaattagcctggcatggtggtgcacacctgtaatcccagccacttgggagactgagtcagagtcgtttgaacctgggaggcagaggatgcagtgagtccagatcgcaccactgcactccagcctgagtgatagagtaagactctgtcttaaaataaataaaaaaaaattatttaaaaaaagaagtagcctatctcagaggctacgcgactttattacagttttaaaaatggaatggtaggccaggtgcggtggctcacacctataatcccagcactttgggaggctaaggcgggcagatcacgaggtcaggagttcgagaccagcctggccaatatggtgaaaccccgtttctactaaaaatgccaaaattagctgggcatggtggcggatgtctgtaatcccagctactcaggaggctgaggcaggagaatcgcttgaacccgtgaggcagaggttgcagtgagccgagaacacgccactgcactccagcctgggggacagtgcaagactccgtctccttggccaggcacagtggctcatgcctgtcatcccagcactttgggaggctgaggcgggtggatcaggaggtcaggagatcgagaccatcctggctaacatggtgaagccccatctctattaaaaatataaaaaattagctgggcgtagtggcgggcgcctgtagtcccagctacttgggaggctgaggcaggagaatggcatgaaccccggaggcagagcttgcagcaagccgagattgcgccagagccagactctgtctcaaaaaaaaaaaaaaaaaaaaaaagactccatctccaaaaaataaaaaattttaaaaatggaatggtagttacctttgctagagactgagcatgcataaaagtaatcttaaataactttttcgcctttggccaaatgttggttcattgtgatttggagtctaccattactataactgtatctgtacctataccaatatctgtacctgtacctatacctacatatgtacttatacctataccatctgtcctcccctgaaagacctcatcaaagttctcatcttgcaatgtttcctgttaaatatcatcatgactacttttaacctatttgaatcaaggctgagttacagccttttaaatttttgaataatttttttttttttttgagatggagtattgccctcgttgcccaggctggagtgtggtggcacaatctcggctcaccaaaacatccacctcacgggttcaagcaattctcctgcctcagcctcctgagtagctggaattacaggcacatgccacaatgcccggctaattttttttgtatttttagtagagatgggatctcaccatgttggccaggctggtctggaactcctgacctcaagtggtccttctgccttggccttccaaagtgctgggattataggcatgatccaccatgcctggcaatttttttttaagagcacaaatccacgtttatttattgacttttcttttttctttcttctctttttttctctttttctttttttcttttttttgagacggagtctcgctctgttgcccaggctagagtgcagtggcacgatctcgactcactgcaacctccaccttccaggttcaagcagttctctgcctcagcctcccaagtagctgggattacaggtgcccgccaccacacccggcttttttgtatttttagtagagacggggtttcaccatcttggccaggctggtcttgaactcctgacctcgtgattcacccgcctcagcctcccaaagtgctgggatgacaggcgtgagccaccgcacccggcctattgacttttcattagtttaaatccttgaagggtacagcatcactcggattctgtgtccaatagccttagtgggaagattgcttcagaatttggcacgaatcatgtcactgtttccgtgggcctgcctcagcctcccgagtagctgggattacaggcggccgccaccacgcctggctaacttttttggttttttttttttttttttttttttgagatggagtctcgctctgtcttccaggctgtagtgcagtggcgcgatctccgctcactgcaagctccgcctgccgggttcacgccattctcctgcctcagcctcctgagtagctgggactacaggcgcccgccaccacgcccggctaattttttttgtatttttagtacagagagtttttcaccatgttagccaggatggtctcgatctcctgacctcgtgatccgcccgcctcggcctcccaaagtgctaggattacaggtatgagccaacgcgcccggccaccaaatagtgtaatttttacagttacactttgtaactagtgttgctgaagacggaaatgcaattgattttgaaaattgattttttcctcttactgattttttatccatcaaccttgctaaacttatttatcaattctatctgaattttattttagggatgctgcacatgcaataatttcatctgcgaatattaacattaatgtttcttgtagtccttatatatttgttgcttattggactggctacaacttccattgttttattgatgaggattattgagagcaggcatccttgccttgttccccatcttgaaaggaacgctttcaacatttccccattatggtgatgtgttttgcgaaatttttgaagatgtcctttatcagcttctggagttttaaaaaaaatatcaacgggtgttgaatattttgagtgactttgctgcatcaattgagatgaatacattttccccctttaatctgctaatgggtctatatttctccattccatttaaatttttttttaatttgataaatatcttttgctatatgtttcttctcaggtctcccttctcagttatccccctttaccttccattgttggttttctctagtttcttccttttctttttactgtgttctcttcaagctcttgctttttggagttttcccaggatatcaaaggttggggggatggcaacatggttttcagacagtgtgtctccccacaatctgcttctctctacaagcttgtttgaagccaagttaaagcaatggatagaagacggcagcgcgggtgtcagacctgccaatttccaactgcacaccaaatccccgaacatatgcttgaggcccctgcctttcggtttcataaataaaaccctgtcctgactacctccaggattggatggaaactcggatgagtaaatatggtagaacgactttgcaaactagcaccctattcacacgtaaggggttgctcttgtcaccgagactgttagaggcaacgtgagttaacagaaatagcttggattttgaagctaatggaatctagatccattcctaaccagcagtgtgaccttattgtgtaatctttctgaacctgtctccatccatctctacaaagaatgtggcacaatgtaggaactcagtgaattttcgtgattaaaagacgagataatacaggtgcacaatctgcaaaacataaaatactccataaatggaagcagtaaatcttccccgagctcgagactccaaaggccctgagcccagtaccagtaacagcacccaggtaagtaggctggctgagagaagagggctataaagaaaagttctttcctgagctttgaatccccactgtcaggcttcaatggagcgcaaaaattcctaaatttggtgagaaatggcaacattaccagggaatgaacagaccaggccactcacatccacgtgagggctccaggagccacttccgggcccagtcaaccacgaccaggagaggcagcgctggagcctcaatcacgtcgacggaaaacaagtgcgctccctactgcagtcaccaggaggcgctagtcccgcctgtctcccggcacgggtcctcgtttgcgcacgcgtcatttctttcctccagcgtccccgccccttctcctccggccgccaccagtttcgcttggccagttgcgttcgtgcggcgacgtccacgcattttctgacgtagcgagcgacggcggggagccgagcggaagtccagcactattgccgctagaggaggggaggggtgagaagcataagtggcaccggaagtggaattaatccgcctacctctcctgcgcctgcgaaacagaaaagacaaggcgcctgtcgggcggggtgtggcttcgggtggcggagaacgctgcgattggccctcggctgtggcgacagcgacgattggtccctgcgtgcagagcgcggtgagagtgggtggtggccgttggaattcaaaagtggcgggtgtggcgcggggctggtagcggccggagccgtgcgagttctctaccctgcttcgcgagcgggcgagagaacgcgagtcccaggatccccggcacccagttctcttccactgcattcccccggcgcgtgtgggaccgaggtggacatggatccgcaggtgagtaggggcggcgcaggtgtcctgccctggggatggggacgaaggctgaccgctccgatgctgtcgcgcccccggctcccggtcggcctttgtcatgtctaccgggagagcgaaggtccgtgcgcccccgcacaagtggaaaggggcggaggcaggagtggagacggcttagagcacccggggaggtcggaaggcacgtctgtctgccctcccctagcttcaagtttctggagcccctcccttaactttcatgtctccgagatttctcatttcgaattctcaggctcgtctgacacatttccacttctttattcctactcagggtgtgattgcagtgtgtaagaagggagagttctgatatgacttcttccttttggggacatggtgtctgaggccacatccttgctgaggtccttttgtgttaatcgcctctccttatcactgctgcttcggagtgtaggaaagggagaaggagagtagggtaatctgggccaaaagacttctcattctctctctcctttcccaaattgtgcagattcctgcccaatgaaactgattgatttagttctttctcttaaatggtgccctgctgcaccccacaaccatatgcagcttcctgtctccagtgaagagagatgaatgtgtgtgacagctggagtgtacttatctctggtgccaggaaaggtctgcctgaatcctttgtttactagtatttcacgttcaggtttccctgaagttaggattcagccttaagagagattctttctctcgtgacaaccagagagcagagtagtattatgtgacagtaagaagtagtaaaagccttctcagatctattaatcaagtatttattgagcacctactacatgctaggcgtggttgtaggtacttaggatgcagcagtgaacaagggacaaatcgttgccatcgtggagctgccattctatggggatacagacaataaatgtaataaatgaattatataactgccagaaggccgtaagtgctgtggagaaaaggagaaattcaaggttgaggacataggggaggccaactggcgggttagagtattaaatagggtggtctcagtaacccccatggaaaagatgagttgaataaagacttgaaggaagtgagggagacagacaagcagatagtgagggaagaacatttcaggcagagggaatctgctagagcagagtccctaaagagttgtaaggagggaagtgtggctggaatgaagtgagcaaggggaaaagttgtgggaaaggaagtcaggtaatgggtagtggggttgctgatcacagtttgtccttgtgggggtcgttgtgaggacttttactctgagtgagatggggaatcattggatgattttaagcagagagataagatttgttgggtccaccagattttcgtaaccatagcaccattgcctttttttttttttttttttttttgagacaggttctctttctctgttcccaggctggagtgcagtggcatgatcatggctcactggagccttaacttcctgggctcaagtgatcctcccacctcagcctcctgagtagctgggactacaggcagctgccaccatgcctggctgattttttgtatttttaatagagacagggttttgccatgttgcccaggctggtctggaactaactcctgggctcaagcaattcgcctgcctcggcctccgagagtgctgggattacaggcatgagccaccgtgccctgcaacatttttttttttttttttgagaagtagtcacgctctgtcgccagcctggagtgcagtggcgcggtctcggctcactgcaacctccgcctcccgggttcaggcgattctcctgcctcagcctcccgagtagctgggactacaggcgcctgccaccacgcccggctaattttttgtatttttagtatagacagggtttcaccgcgttagcccggatggtctcaatttcctgacctcatgatcctcccacctcggcctcccaaagtgctcggattacaggcatgagccactgcacctggccaacattttttattgtcgtgactaggtggggggttgctactggcatctagtgggtagagggcagggatgctgctaggcatctgacagtgtacaggactgcattggacattgtcaaatgtcaccttggggataaaatcacccccagttgagaaccactggtttatgataatctaggtgccagatgatggtgtcttaggtcagggtgatagcagtggaagaaacagtaaaaagtgattggattctggatatattttgaaggtacaatcagccatgctttgctgacagattagatgtggtatgtaggagaaagagaggactctgggtttttggcttgagcaactgaaagatggagttatatcaattgagatggagaaagctgcaaaaggagcaagttcaaagcagggttggacatcaagaggtcagttattagacttccaaatggagattttttttgatacggagtctctcactctgttgcccaggctggagtgcagtggtgtgatctcagctcactgcaacttctacctcccagcttcaagcaatcctcccacctcaatctcccgagtagctgggattacaggcacgtgccagcacacctggctaatttttgtatttttagtagagacagggttttgccatgttggccaggctggtctcgaactcctgaactcaagtgatccgcccgcctcggcctcccaaagtgctgggattacaggcatgaggcaccactcccagccttaaatagcgatgttgacgatgcagttcagtataggtgcaggatcgaggtctgagctggacatataaatttggaaactgtcagcatatcaatgatatttaaaggcatgggagtggatagtgagtatagatagagaatgctgttaaaatctggagagatgaggaggacctgccagtgaggtaagaaagagtggtctcctggaagctaactgaagaaagcctattaaggaaaagggagtaatcagttgtatcagatgctgtttgatgggtcaagaaaatgaagataaagaattgacttagcaacatgaagttacttgtgatcttgaggatagcaatttcgatggaatggtgggaatgaaagcctgattgcaatgggcttaggagagaaattggccacgatgaatacactagaggtaatactttagagttttgctgcgaaaggcggcaaggaaaaaggatagtacctgttagggaaagcagagttcagattcttttagtttcgaagaaataatagagtttgtggtatgccaattggagtgatgccatagagtacaaagctgatggtgcagaggtgagaagggaggattgctggaggaatgttcctgaaactgggaggatttggcgagtccaggatttggtgaggagggatgggaatgtgatgcatatatgaaagggttgccttaggagcagggccatccacctctgatcttgtggtgaggtggatgtaggcagggttgcatgaatatctgttcttatagaaggttaagtgcttatgcttctcactgtggaaagttggagggcatcattctagctttatattaatagatgggaaaaatatatatactgtggtctttggagttgtcctgaataaacaaacctttaaacacattttctgaaccggcataaattccaaggaggtaggtctgtagcagatccactacggtagtgtagagaggaggaagggcacaggttatttttaaaaattagtgtttgactttggaatacttaaagaaaaatttggtttccatactatatttgattacactaaattaaaataagctttctttgtgcacacttctgtaggtggcaggaaaaatgctacctctttttttccctttttatttttatagaagccaatggtatggatatatcacagtttaagtattgccccactgatgaacattcaatttcattccttcaaaaactgtagagtcctaccatgtagcagacattgtactaggccctctggttatatagttatgaacaaaacagatgaattcttatggtgctcacagtcttatgtaggggttatgataataaaaacaaaagaaaacagtgtatcaggttgtttcatgatttttaaaaataatgatgctctgtgaacttccttgagtaaatctcactgtatcacgggtagctcaaactcactttcccaaaattgaacttagcatccatgaaaccaatcctgctgggtccagtggcatgtgcttgttgtcctaggcacttaagaggctaaggcaggaggagcacttgaactcaaagttcaaagccagcttgggcaaccctgtctcaaaaacaaataaacaaaaaacaactcttcaggtactcagatctctgtgttatttcttttctttttctttttctttcttttcttttctttttttttttttttttttgagacaggatctcaatatgtcgcccaggctggagtgctggagtgcagtggcatgatcacggctcactgcagccttgatctgggcccaagccatcctcccacctcagcctcccttgtagctgggaccacaggcaaatgtcatctggttcgctaaggtggatgtctgcctagcttagccctcaagcttctagaatagcccctttcaactaggttccatgagaattaatttcttttttttttttttgagaccggagtctcgctctgtcacccaggctggagtgcagtggcacaatcttggctcactgcaagctccgcctcccgggttcacgccattctcctgcctcagcctccccaggagctgggactacaggcgcctgccaccacgcccggctaattttttgtattttttagtagagacgggatttcaccgtgttagctaggatggtcttgatctcctgaccttgtgatctgcccgcctcggcctcccaaagtgctgggattataggcataagccaccgcgcctggccaagttcttttttttttttttttttttgagacgtagtctcgctctgtcacccaggctggagtgcagtgttgtgatctcggctcaccgcaacctccaccaatcgttcaagcgattctcctccttggcctcccaagtagctggattacaggcacatgccaccatgcctgggtaatttttgtagaaacagggtttcaccatgttggtcaggctggtcttgaactcctgacctcaagtaatctgcccgcctcagcctcccaaaatgctggaattacaggcataagccaccgtgctcgcccagaattaagttctaatgccctttttttttttttttttttgagacggagtcttactctattgcccaggttggagtgcagtggcgtgatctcggctcaccgcaacctctgcctcccaggttcaggcgattctcctgactcagcctcccgagtagctgggattgcaggcatgtgccaccacacccagctaatttttgtatttttagtagagacgggatttcaccatgttggtcaggctagtctcaaactcctgaccttgtgatctgcccacctctgcctcccaaagtgctgggattacaggcataagccactgcacccggtccaggtgaaacatttcaaacatggctcagtaaatattgcctgattctcccaagcagtcttcaacactcacatatcttccactctctcccttgtttatgattctcagctccagccaaaagggccagttggtttcttagccatgctatgtacatatttgaatttttgccttccaggaagagcatccattcctctctgcttgtttgagtcccacccttaaagttagtcaagtccagcttttcccctagaggttattcccacttttaggttatgtcctcacttctgttcatgctgtctggcacataattcagcttttggcacaagtggtgctcagtgcttggtggtggtgttgacaattgaggctgggggccaagacaggaagttcttgggacatttgggctcctgggtattgtcttaagggtctcttttcccaacagaggtcccccctattggaagtaaaggggaacatagaactgaagagacctctgattaaggccccttcccagctgcctctctcaggaagcagactcaagaggaggcctgaccagatggaagatggcctggagcctgagaaggtgagctgggcatggagagctgtgcatgtgtgtggggggtgtgtgtgtgtgaaagaaaggagagagagagtataaaccattagggagggtgactatggaccttgtctttatctttccccagaaacggacaagaggcctgggtgcaacgaccaaaattaccacatcccacccaagagttccatccctcactacagtgccacagacacaaggccagaccacaggtgggctctcaggatggatagactccaaggacatggaagtccagtgctcttcaactcacttgtttcttttctttcaattttattttattttttttgagacagagtctcgctctatcgcccaggctggagtgcagtggctcaatctcactcactgcaacctcctcctcccaggttcaaacgattctcctacctcagcctcccgagtagctgggattacaggtgcccacaccatgcccagctaatttttgtatttttttcagtagagatggggtttcgccatgttggccaggctggtcttgaactcctgacctcaggtgatccacccgcctctgccttccaaagtgctgggattataggtgtgaggcaccgcacccagcctattttgaataggtaataacatttcatttggttcaaaattccaaaggcacaaaggttgttgtatagtgaagtttgcttcctatttctgtcctccagccacccaattctgctacccagggcaactgtgtgttcttccagggaaattctattggtattcaagcaagtaagactatactcccccaccttttttacataaatggtggcatactttagacatggtcctgcttttacttatcttaatccaaattgctttttggcatatggagtacagttggccctctgtatccgtgggttctgcttctgcagattcaaccaaccatcggttgaaaatattcaaggagagtgggcacagtggctcatgcctgtaatcccagcactttggggggccaaggtgtgtagattacctgaggtccggagttccagaccagcctggccaatatggttgaaaccctgtctctactaaaaatataaaattagccagacgtgatggcccgtgcctgtaatcccagctactctggaggctgaggcaggagaattgcttagaacccaggaggtggaggttgcagtgagccgagattgtgccagcctggcgacagagcgagactcggtctcaaaaaaaaaaatgagaaaatattcatggaaaataaaaaataaaaccaaaaaatacagtataacagttatggtcatgtgtcacttggcaatgcagatacattatcagaaatgcattattgtggaaacatcatagaatgtacttactgaaacctagatgatctagcctgctacacacctaggctatctgcgatagcctattgttcttgggcaacaagcctgtgtggcgtgttactatactgaagcatggtaggtaacataacacagtggtaaccatttgtgtatataaacatacctaaacatagaaaaggtacagttaaaatataatataaatgataaaaaatggcacacctgtacagggtactaaccattaaatggagcatgtttgaatggaagttgctctgggtgagttagtgagtgagtggtgagtgaatgtgaaggcctagggccttactgtacactgctgtagactttagaaacatggtacagttaggctacatcaaatttataaaaaatagttcttttataataaattaaccttagtttactataactattttactttataaacttaacattttttttcccacttgccaaggctgatgtaacattttaatctttttttaacttttttttttcgaccagttgtcaaatgatcctttattgaaatattttcctttgtgcttaactagctgggcattccacagcaccactgttgatgtcatctatgatgtcatgagggtggtggccatcaacattacagcccatagactgggcagtccccggaatctctttaatggttccagagagttctctggctaaggatcggtgccgcatctgtcgagcaatgttgacgatctcatcaaaagtgatattcccattgtgtttaatgtttttctgtttctttctgtctcttggtggtttcttgagggctttgatgatcggggcagaggcagaaggcaccacctcaatctgggcctgtctgttctcaatggtcagtttcactgtaatcctcaggcccttccagtcacccgttgccttggcaatgtcatcaccaaccttttttggagacagacccagggggccgatcttgggggccagggcagaagtggcaccgacttcacctctggtgcacctcaggtatacgaccttgatctcgttggggtcgaacttcggtggcatggtggaggcagctggtgtcggatgaacccagattcaggatgaccgaagaaagttgcaccttggcctcctccgagccgaaagccgagagcttctctctcttttttttttgagatggagtctcgctctgtcgcccaggctggagtgcagtggcacaatctcggctcactgcaagctccgcctcccgggttcccgccattttcctgcctcagccttccgcgtagctgggactacaggcgccctccaccacacttggctaattttgtttttttgtatttttaatagagacagggtttcaccatgttagccaggatggtctcgatctcctgacctcgtgatctgcctgcctcagcttcccaaagtgttgggattacaggcgtgagccactgcgcccggctaactttttgactcttgtaataacaactgaaaacacaaacattgtatagctttacagaaatattttattcctttatatccttattcctcatgctttttttctatctaaattttgttttgggcggggagcatatattcagggcaatatgaatctctgtctcctggcttgaaaataaaatttttgttttttgttttttgtttttgagacagagtctcgctctttcgcccaggctggagtgcaatggcgtgatctcggctcagtgtaacctccgcctcctgggttcaagtgattctcctgcctcagcctcccgagtagctgggactataggtgtgtgccatcatacccagctaattttttgtatttttagtagagatggggtttcaccgtattagtcaggatggtctcgatctcctgacctcgtgatccgcccgcctcagcctcccaaagtgctgggattacagacatgagttactgcgccccgcctgaaattctttttttaatttaaaattttatttatttgtattttttccaagaaataagcttaaatttgaaaaattttaaatattattttgcttttcaaactttttgttaaaaacgaagaaatatacacattagcctaggcctacatagggtcaggatcatcaacatcactggctttcacctccacatcttgtctcactggaagatcttcaggggcagtaacacacatggagatgtgacttcctgtgataacaatgctttcttctggattgcctttttttttttttttgagacggagtctcgcactgtcgcccaggctagagtgcagtggcatgatctcggctcactgcaagctccgtctcctgggttcacaccattctcctgcctcagcctccggagtagctgggactacaggtgcccgccaccacgcctggttaattttgtttttgtatttttaggagagacggggtttcaccgtgttagccaggatggtctcaatctcctgaccccttgatctgcccacctcggcctcccaaagtgctgggattacaggcgtgagccacagtgcctggcctggaatgccttttgaatgacatgcctgaggctgttttatagttaactgtttttgcaaatagaaggagtataccctaaaataacaataaaaagtacagtacggtaaatatataaactagtaacatagtcattatcattattaggtattatgtactatatgtaattatatgtgttatacttttatacaactggcagtgcattaggttcgtttatatcagaatcaccacaaacaggtgaggaatgctatgacattaccatggctataatgtcactaggcaataggaatttttagctccattataatgttacggggctactgttgtatatgcagtctgtcattgaccgaaatgtcattatgggcacatgactgtattaacatagcatttacattgtgttagatattataagtaatctaaagatgatttaaagtatatgcggctggatgtggtggctcacgcctgtaatcccagcactttgggaggctgaggcaggcagatcacctgaggtcaggagtttgagaccagcctggccaacatgctgaaaacctgtctctactaaaaatacaaaaaaaaaaaaattagccaggcgtggtggcgcttgcctgtaatcccagctactcaggaggctgaggcagaagaattgcttgaaccctggaggtggaggttgtagtgagctgagatcgcgccattgcattccagcctgggtgagaagagtgcaactccatctcaaaaaaaaaacaaaatggaggccaaggcaggcagatcaccagaggtcaggagtttgaggccagcctaatcaacatggtgaaaccccgtctttactaaaaatacaaaattagttgggcgtggtggcgcatacctataatcccagctactcgggaggctgaggcgggagaatcgcttgaaccctggaggtagagtttgctgtgagctgagatcatgccattgcacttcagcctggacaacaagtgaaactctgtctcagtcaatcaataaataaagtatatgggagcgtgtgcatagactatatttaatactatatacctatttatgtaagggacttgggcatccttggattttggtattcttggggggtgctggaatcaaccccttttggatactgagggatgactgtaatttctggttctaggggaggtatcattaggagctggccagacttagggataagggaaggaagttatcctatttctaattctgagaaaagcacttcttctgcccctgtcctagcaagtgtacatgccatcttaagaatgatcattctacctttgctctctcccatctcctgggcagctcaaaaagtttccaagaagacaggaccccggtgttccacagctattgccacaggtaactgtgctcaagagctgggtctgagaagggatttggggtatgtgtaaagggagaatgatggaggtggagggacactggtcctgtaattcctaagtcacctcctcaattctgtagggttgaagaaccagaagccagttcctgctgttcctgtccagaagtctggcagtaagtgacaaacataaccactgggtgagaggctgggatagggaagagaagatggtgagtgaccagaaaaatccatttggtctctaaggggaaggagatgtagcatcaggtgtggatcccataaaggctagaagggaggagggatagagagcctagacttcactgacctttgtcctttctgtgttcatcttagcatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggaggtaagggccagattttcaccagatgtcagccccgctttcctggcagaggtcatgcctcccctcccttccaggtacccctcaagtctgggctgagaactcctgagcacctatctttagcagtataggtgctgctgaagatacctctctcttgacctgtctgcaccccagcccactcctgactgtcttgctttctgccacgcttcttcctacccttgactgtttgcaaagctctcatttagatctgtgtctttcttagtcctccatccctctttctttgggttcccatcctgatcacaaattcctgtggtactctctttccctcctcccatgtccacttgactccttcctggtgagcaccaactagattaagttatttgcagtctcttaaatgactcaactttcacttctgggcattctgcatatgtgcttccctctttctggaatgttctttgtatactacatccttccttggttcactcctgtacttctgggtgtcaccctagatatcatcttccttgtgctcctctttgtgcttggacatacccatagcactccctgtcttagtaccatgattccttattttctcatctttctttgtttaccagactttgaggtccttttgagcagggacctcacttccacccactccatacgccccacagtttgttcttcttcttggttgcatcttaccctctgtgtatgttgtgttctcttctgggcagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtgaggacccatgggcactggaactgggaaatggggaggagtgggcagggtgccacgagatggaggtagagggagaaaggagcaagagagaattgaaggatgaagtgcaagttatcaggctgggttaccacatccggttttggcctgtgggctgtcggtagatctgccttaacctgggagtggcgagggagtgatgcatctgccaaaacgaggagggtcactacatctcatgtctcatcttcttgctcagctcatcctagccatgctggcctcctggctgttcctcaaccagctagtcgtgctccccatctcagggcctttgcctggatgctctttcctggagatcttggctatcctgtcaaaacttgtgttccccaccccgcctttatacactccctattctatgtattccttaccattttcagacatactgtgcatcttattttgtttcttgacaggctagaaagcttcaagagggtgggggtgggctcttattcatttccatacatattactatgtactgacttctgcctgcctttttgccccttctgctcccatccccaggtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggtgggaatgggagtggggtgagatacgggacctgggggacagttggggttggctgtgcagaaccctgcctattcctaaacatctgtccccacctcaatcatctaggagtcccacgtgccttaccggaacagcaaactgacctacctgctgcagaactctctgggtggtagtgctaagatgtgagtgaaagggacagatggaaggggtcaggtaggaactgtgttggggtgaggggtagaaaggggaacagtggagacctgtccaggctctgctggcccctaatgctggggttgggcacattgtcttttcataggctcatgtttgtgaacatttctccactggaagagaacgtctccgagtccctcaactctctacgctttgcctccaaggtgcgattaccacccgtcagccttgtcaggacccgtgggtggttgtaggcttctccattccaatcccttttgtcttctagggcagggagcacatttgtgcagaaaggttttgcaggtatctgaggcactgctcacctggttccatttttaattattagcttttgagttaagttttttaaaaaacgggtgattaatttaacctgagaaagctgattaaaaaaaaaagaaaaggtgactaaaaggtctaaactggttgggcgtagtagctcatgcctataatccgaacacttcgggaggccaaggcaggaggattgcttgagcccaggagtttaaaatcagtctgggcaacatagtgagaccctgtctctacaaaaaataggaaaattagctgggtgtaatggctcacacctgtagttccagctactcaggaggctgaggtgggaggatcacctgaacctgggaggtggaggctgcagtgagccgtgatcctaccactgcacttcagcctgggtgacagagtaagaccttgtctcaaaaaaccaacacacaaaaaatccctaagattcctccctatcagcatacagagatcattatttttaggtctgcctagactccactatgtagctgcaccaaaatttatccaccagttccctctactggacacttggattgtttccacacttttttagtcacaaacaaggccacgttgactaactttgtacatacatcattttgtatttttcagttacatctaactagggaaatagtccttgaaatgggattactggatcaaagacttagaggtttttcagactattccaaatagtgtgaattcagactccaaacctcatgagggtcagccagtggctatatgaattctcactaatgagaattccttccactagaatctccttccactagtgttaagcaagtcagaaagtttccttactgtctgcctccacagtaatttttttctctggtacaccctcctcctgcgcgtatagccctttgatgggctctggctttatttgaggtctgatcaggtctgtcctgctgtgcgcttgggcctcctcccagtcagcactgattgttgctgtggagtagccagcacctgcaccctgatctggtattctactttgatgagggtttccctcactatcttgcaagttcaattttagagggtggtgatgttttttctaactttttattaatgttataccaatgtaacatccaacaacatgaactttaatatcctctaatacccagtttatgttaaatttcacccaactgtctcagaagtgtcttttatacataataggtttgttcaaatcaggatccaggcaagggccacccacttggttgaaatgtctcaagttccacaaccctatcccacactgccactattatgtcgtttgttgaaggtcatttgtcctatagaatatactattctggattttggctggttgcttcctctttcccccatactttcacttatttatcatatttgggtgttgtcaacctgacccatccatttacaagctccttattgactttttcacctagtgattttatccagcagtgaccatacctggatctttatttcattaaggggtttctaaatggggatttttctaatcttagttgttctgcattggttagtcacgattcttttatgaagacatttgccttgccatctacttggtttctctgaaattcaattcatacaggaaaaacaagataaatgctgaattatttattgattttcagtattgagttgatatcctagcagcttccaaaggtgaccaatgaatgtttatctgagggttatttttatttttattttttttgagacagggacttgctctgttgcccagactggaattcagtggctcaatcatagctcattgtagccaccaaaagtgttgggattataggcgtgagccacccagcccggccacagtcgttcttctttctgatgctcaaattgccccatctttagccaataggaacctcctggccgggcgcggtggctcatgcctgtaaccccagcactttgggaggctgaggtgggtggatcacgaggtcaggagatcgagaccatcctaacacggtgaaaccccgtctctactaaaaatacaaaaaattcaccgggcgtggtggcgggcgcctgtagtctcagctactttgggagtctgaggcagaatggcttgaacccgggaggtggagcttgcagtgagccgagatcgcgccactgcactccagcctgggcgacagagcaagactccgtctcaacaacaacaacaaaaaaaagagcctccttcagattggtgccagtgtcctttagacagaactctagtagtcttttcagattcaacttgtacatttccttccccagacttcaactgatccattttctaaggagtcctagttcctaaatgggtgttattactattttatctcggtttaagtgttttacagtgggagaggttggaggtctctagtacagggtattgctggaaatgaaagcctcctttctctgctcctgtattttcttctggggcttccatctcttctcaagccttttcacctcctccaaacctagtgtgcagaggagaacaaaccataactggcaccagcctgaaccagcctttggaggccttatttcggtatttctgagggcagccctagcattggaggatgggagatcttgggaaaaatgttgtattggttacgctgcaaacttttatcctgtctaaccccctgcccccaggtgaaccagtgtgttattggtactgctcaggccaacaggaagtgaagacggatccagatctgtgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaagtgggagctgtgatctgtaccctctgccaaacgtttacgtgggaggcgggagcgggggctgagggcttcgtcttttctcccctctgctatcaccggttctggaccttggcctggatcatcttcccctctgctaataccccctaccccgtccgtcacatcagggaggtgtgccctctagctatccacgccccctccttggtcactagttataggtaactttcacccttccgccggccaccccagccccagggaagaacgttcctttggtgggtgtcggcaaatggggaccggaccccagagtccagaggcggggctagcgcgcgctcccaaactgttggctctttcctcccgtcccgccctttccctgcctttccgttcgaacggctggggctctgcccgctcgctgcccattggctggctctcggtggcgtcaccgccttgggtcctcgcgcccttcgtctgcgccagccctggaagcacggggcgggacgtccacgggaagcggcgcgcacgcccgccgactccctcgcgccaaccgccgacggccgccgcccggtgaaggaggggctcagtcctcccaggtgccgcgcgcaggaggggacacgcgtgcgcaaaagggcggtgggtggggcgcgactcgtcacggggagggcggggcgcgcgagggaggagggcgtggtgggggcatcgagaagggtgaatggagggcggggctgtgaactggggccggggggcgggacttggagtgaccatggggggtggggcagctaacggatgtggcatggggcgggggaccaggccggaggcgggctgccgggaggggggattccctcgtgccccaagggcgaatctcaggtcggaggaaggggctgaggggattccctctcccaccgggtccgactcttcgctccccaagccgcggagggccagcctcttcttcggcgccctccaggcctgttggaggtgagggaggtggggtgaggtggtgcccgcccccccctccggctcctcctttcccccagtcctcccctcccaccaccctcccccccaaccggtccgtccctcccctccctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggtaaggaggcggcaggaggcgctggtggggggcagggagccgggggtcggcgcggggcgcgggcgggagagcctcgccgccttggcctcgggtccgggctgggccgacacaagtcccttctcggacttgccgtcctggggagtagagaccgggactgggacacgcccccctcccggggcactcagagaagttgtctaacccgggggcagggagccccgaatttgagggtgacctgacataacctggcaccaggatgattgttcttaatgagacgcgcaggcctggggagacagccgtttctgctctggaaaacatctccagaaaaggtcccaaaacacgtctctgggcaacaggacaccctaattatgatacctctaaactgagtagcctttgcttctacaaccataatttctcctaaaatttcaaggccagtatataatatcccaggagagctctggaagctgggaaactagcaactaggtttggggtcggggggagggctgttagttaccgagaggagagccagtcactagagttggaagaggactcaaaaagctggtgatgggtgcccagtggtttcctatcaaggtgtctcagggatttggagatgggggcacagatacttcattcttgatggcaaaataggcaaagaaaatggggaggctggccgggcccggtggctcacgcctgtaatcccagcactttgggaagctgaggtgggtggatcatgaggtcaggagttcgagaccagtttggccaacatggccaacacctcatctctactaaaaatacaaaaattagccaggcatggtggcatgcgcctgtaatcccacctacttgggagactgaggcaggagaattgcctgaacccgggaggtggaggttgcagtgagccaagattgtgccactgcactctggcctgggcgacagagcaaaactccatctcaggaaaaaaaaaaaaaaaagaaaaagaaaatggggaaggtttctcagcattcataaccttctcctccccatttcttttctggctaggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtaagaccttctacctctgaccttcttcctagttcccttatctaattctggttcccatttcatcctgtttgctcacccattccaggtggacagtgctagggaggtgtgtctggtccagtttgaggatgattcgcagtttctggttctatggaaagacattagccctggtaagactctagagacctgagattgcacatcccatggaaaacaaacctggcctagaggggcagaaagagacttaaaggcaggccctgtgacactgtgttctctcacagctgccctccctggagaggaactcctctgttgtgtctgtcgctctgagactgtggtccctgggaaccggctggtcagctgtgagaagtgtcgccatggtgagagggcaggtcacctgaatggtccagcttgctcttccctccaggatggtctctatatcacctgtcctggccttagtccccaagccactgctctggccaggctgcttagccttatcttagtcctcatccgctttcagcccagggagaagcagccatggaaaggggtggtataacctttgcaggcagaagatggtttaaatgcatccttttctaaccatatgacctcggacaagtcccttaacctctaggagcctcagttccctgacttgtaaaataaggataatgcaccccctcatcaagaccatggtcagggattaaatgagatgggtaaagactattcctgtcccaataccaagcacacacaggtatgcaataagtggtctactattatcactgcagcttatcaccaggactgccatgttcccagggctccagcccctggagagggagagggcacatcctgggtatgccgccagtgtgtctttgcgatcgccaccaaggtaaaggcacttccctgttacccttcctgtgggagcctcccatccacagcctctcccaagccttttcctctccccacccctctgaagccacccacctgtcctgtctctgcagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtgagtaatgagaggggagcagactgtggaatgaatgatgtggtggtggatcccaggaaatgaaggaaaaagaacaggatgagggtagcactcagggggataggaggtaagtttagggtttgggacagttatggggaagggggtttctggaggccagaagtcctgtgttccccctcaggtggaacctgaaaatgctgcagtgccggagctgcctgcagtggttccatgaggcctgcacccagtgtctgagcaagcccctcctctatggggacaggtgagaccaaggcagactctctaggagccaaggatgccctctttcttcgtgttccaccctcagttctcccacgcccttctccactccagtctcttcccaacctctgcagcgttacctcacctgtttgccccgtccttgcttgtgagtcttccaggggatggcacagttttcctgtgtaagtgtgtttgctccctcttgcccatgtccaggttctatgaatttgaatgctgtgtgtgtcgcgggggccctgagaaagtccggagactacagcttcgctggtgagctggattgggcatgacctcagtgtaactccacaccacagtatttcactctatatgccccaacctcccacctcaggactcccctggctcttaaaatgcctctgtggtcttgaaaactttgtttttccagggtggatgtggcccatcttgtcctgtatcacctcagtgtttgctgtaagaagaaatactttgattttgatcgtgagatcctccccttcacttctgagaattgggacagtttgctcctgggggaggtaaggggtagtgcagttttgggggttgggatgggacagggagatgtagcggaaaggggaagagaagaaatcactgctcccctggccccatttttcttcatttctcccagctttcagacacccccaaaggagaacgttcttccaggctcctctctgctcttaacagccacaaggaccggtgagttggagggaagaggaggcaaggatgaggctcggaaagagatggagagtggaagcctggaaggggaggggcttgcaacccacctggaagactgtgactgaaaaggattgaggaatggcgtaaggaggaaccgttttttacagcactgaccctatatcatttctcttcttgccccagtttcatttcagggagagagattaagaagaggaaatgtttgtttggtctccatgctcggatgcctccccctgtggagccccctactggagatggagcactcaccaggtcactggtccaggggggatgggggaaattctcagggtgttagtcctggggggtatatgtatagagatggggaggtcttgggggtgtccgggagggggctggggggataaggaggcctcttacagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggtactggagcagggggaacccgatggagcaaatggtggggtgtgggaaggagtcaaggattatctctcagtcctttgccccctcttctaggcctcagtgtctccaccatcccccagccctaaccagagttaccagggcagcagcggctacaacttccggcccacagatgcccgctgcctgcccaggtcagtgctcctctgcccctcccccacaaaatatgctcccaattattcacatcttctggactttatcacccagaattcttttccctctcccccttggctacccacttcttggcctagaccgacttctagaactagtgtctggtagccagtattctggggaagggagtcccttgggggtagtgtttgagctctgcacttcccagggggagaaggtcctgttcccctgcttcaggtcctgactttccccactccaaccccagcagccccatccggatgtttgcttccttccacccttctgccagcaccgcagggacctctggggacagtggacccccagacaggtgagattctgtcttctattaccagtgatgctcttcttcccctctatgtgctcaaggctcttagtctctaacactgtttctctgattcacatgtgctctccatttctgcccatttcttacaattgccttctctccctaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctgagtcattctgaaagatgtagagaatacagggactagaagcacttatattctcccaacaaatttgcatacatgacaaaaaacaggcaaaaggcagagagacccaaagacgggatttattgggggcccagtcatcacctggaagtcagaaggcgttgaagtatcgcggggatcttcatgatgagcaggaacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgtgtgaacccgaaactgccacttgctggctgaggagagccgctgcggcgttccactgtcacgtgagggggccggtcctcttcggcggcggcactcagtgagtgacgccaagtggccaatcacaggccagcctcgcaggccacgtgaggcgagagctggttccaggaaaggggggccagagaccccgcagagtcgatgcgtcaggctgtggagtggggaatcatccttaaaccccacaatgtgcctagtgacctcccctgcactgtttccgaggtcttaaggagtgggagggtctgagaaggacccttcaccccaaactcaggggttaagagagcgccccctgcccttttagttgggcagagatatgcctgggtttgggaatgaacaacggtgatctagaagcccgctgtccctgggtagcagggagtgattaggcaggcacgggcatggcaagacaatagctagctgaggaaagaagcattttaaaacagagcgagaccctgtggtagaggatggtgaaaatggggcctagccatcttaattgaaaacccaaagcttgagacagactactgaatcagagggaaggagaacgagggctgcaggatggggacagtggtgatggtccttctgtcccctcttccctgcctattccactccccaggattggtccacctctcagcctcgggtctcctttccctaacccatcccccaaggagccaggacctgccctacataacttccctggggcccaagcacatcctgtgacccaaaaatggagagaggggccaatgagaggcagagaggtgggaggaggtgcagagaaaaaagctcttgccactgcccccacccaatatttcccctcccttcaaggtctgaggtcattggtctggtggtggggatgcctcggagtttcccaggctgacgtcagggttatacctctcggaggttctagggcagggaagtggggaggggaggttccctgagatctctgtctttgagtttggagtttgtctctgagacagatttcggaggggtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgagaaatgcagaaaaaatgttactagggaagagatatcctgaaccattggatgcattgcttagtgtgtaccagaaggataattaacacatttgctcctggtttttctttactctggtggcaatctcggatgcctgtgttagagtgagagaagggctgggggaggaaagggggttgtcctgagacagagtggatgtggttgtacttttcacgtgaatgaaaggatgtttgtgcttctgagatatggggatacctttctgtggtcaggatcatggtgtactcaagcatgtatttcaggggttaaactggaattcccctgcatggggatatgtgtgtcttagggttataggtccatttctgtagtgtgctgtccacatgattgcccaagagacttgggccacaaagtccacaccagcagctctcatgtgggtcactgggttcaagtatgtactcccttgttgcagagctcacatatgtcaaagcatgtatcctgtggggtgtgtgggcctcagggtctcagaatgtggatccgtgctatgcccgtgctcacagttgtctgtatgtctcaaaagcacatagatccccagttatttttctgtattgtggttctcatatacacgtacctccatagctcagtatatgtttctgtactatacacctgttcctgagggagtgatagggttctcgtgtcatggggtccacatttttgtatgcaaacctcctaacacctgggttttacaggtaaagggaagctgaggactgattctagggcagtttgcaggcaatttgcaattctggaagcagacagtgaaaatataattgtggtcctcccttgttctgttctggaacctagagggttaacaggcagctcttccggtccacccccctccttccagcctgtagcttcttgttgccgtggagatggtggccccgccccgatgcagcacctgcccccccattggctgcagtggtgactgtggggctgaggggggagcccaggcctgggcagccattctggagctggagccggagcttggcatccccccacttacattctcttccagcccctcggcccctctaaattcccttgcagccgagcctcagcttcctttttcagcgcttgccatccctctaggctcttggcagactgagctgcatccgcattcacctcccctcctcctcctttccctatccttacttgggagtcccgagaacccccactgtccatccttcctgctccctgcccattcccctgcattctttgcttttcccctccccccaccaaccttctgagcccctgccactgcagtgcacgtggaaccggctccttctcccttccccccacctgccccttccttggattttctgtccccagcttctccccctgctactcttcacaggtctcttccaagacctccccctccagtccagggagggggtcatgggaggcagccctggccctccagacagacaggggttccaggaggtggggggcaggtggaagatgtgcccaccagggggaagaggaaagcctgcctatgggcaatgacctttaacccatctttccccccagctagccccttctggggtgggtgggcaccagggacctagcctccctggatctttggtgtccttcattactggggttttactgaccctctcagccatgctcccctgctgactgccagccccagtcatgggcctaaggcctcccaccccatccccctcagggggctcctgctcaggttccttgccccctccttcccgctgccagcctctccgccgtcgctgctcttcctgctgctttccggggggtaggtgaggccggagctgaggggcagagggaggtgggggcatgcactggggtcaggggtgggaacctgggttaacagcttcccttctggccccctccccaacttcccttctggccatttcctcccctccagaataccacttgggtcgctcgaggaggaagagtgtcccaggggggaagcagtacagcatggagggtgcccctgctgcgcccttccggccctcggtgagtggtgcctaccagatgtggctcagttgggccccctcccctccagccccaactggggccctaggagtctgagaaagagggcaggagggggagagagggagtgagagtgagaaaaagagtgtgtgtctgtgtgtgtctccccacctctttggtttcccccttcttggctctgcccccctgcttctgagaccagccctcccaccttctccaagctgtgtgtgtgtgtatatgtgtgtgtgtgtgtgcttgcactgtacccgtgggagcaaggaagacaaactggtattagggttcctatccccctttcctcgcctctggagacttcccttttccccatcccactttcatccaggggctctctaccagctgagggatgagtaggtagaactgaccctgccccaacccaccccatccccatttcccccccagcaaggcttcctgagccgacggctaaaaagctccatcaaacgaacgaagtcacaacccaaacttgaccggaccagcagctttcgccagatcctgcctcgcttccgaagtgctgaccatgaccggtacaggggctggagcatgtgggatgagattgatgtaatgtagggtctcctgtgtgagatgcagagggagggggttatctgtgtgcaaaggttgaaggattcaactcaagttggttgggggatgtcatggcacaggggacagaacagaaaagaactagaatagggatctgtgagcagcaggagaggggtagggtggcagagagaagacagacagacaggctggaaagggaatgaaggtgaagccaaggagggactcctcagggactcctcaggccaagaaggatgggctctagcccaggatcaaaggagctgtacaggaggagagtgaccctggaggaatgtttaaggaatgcagggaaggggttggtaggtgagtgagcaataggctgtaggtggaagggtgtcagggaaggtcaggaaatacaggggcagcaggttggagtggggctgggggtggctgaatgaatggatgatggctagggctcaaggacctcatcagtgagggaagagacagtatagagcatggcagagaaggggaggctgggacaggtgtgcagggtgacagaatgggaagcaacccatggactgaggcatgaagaagcagccagcggagaagtccagaaggcactgtccctgagaccaggctgaaggagacctccactgtttgcctttgttgcctgccatttggggttcctctctgggtttccccctcacccagtcactccccagggagaaccatgccctccctttcccccatgtctggccacccccaggattgggcaggtagggaggttgggataaagtgagtcacacctttccctgcccccctcccatgttgccagagctggatttggggccggcagggggtgagggcatggtattcctggccgcgggggcgggggggggggtccgggggccgggggagcgtcgcgctgacggcagccagagcctgcgatgacggggctgctataaataacttcttggaggctcccacacccaagctcccctcccgctttcccactgctctctactcttcatcccctgcccatctccataccgcttttgtattgctatcctacccctcattattccatgcccctagccccctttatcttctgccctcctgcagtgatttttttgcattccatcccctcttagccctcacctcggttctcccggccatctctccagttggccttcctcctcttctcctgtcctctgtcttgctgcacatacctttgtctccccctttcttcttcttgccctacctcctcttcttccctagtccgtgtattctgtcttttatcctctttgagctcttttctgcccacagctttctcctatttcttatgcttttccctcactctttcccctgcttctgctaaaacttgtcctcttatgctgtgttcattcattctttgaatcattaaatgtttatcaggcactagccgtgtgccaggcccaggctagacatatctcttctctgtgccttcacttctttacttccactttttcctttatactgaggctctggtttctggggttacctggaggtactacctagaagtgccccaggcccactttgttctctccttttttttttttcttttctgccatggtccatttctgggttgagatatttctagatgtccccagtcctcgcaatcccttaggtgtgagatggtgggagtttcttttttttcctttttttttttttaaatagaaatagggtctcactgtgttgcccagactggtcttgaactcctgggctcaagtgaccctcccacctcggcctttgaaatgttgggattacaggtgtgagccaccaggcccaggtggagcaggggagttccttaaaggattctgatttttctcacatccctcacgtccttcctgataggcagggtttctttctgtgtctgtttgggaagggtgttcagggggccttctctccaagtctccatcctggaacagactgatgatgcagggtacctatgtgtctaagaagagtaggggggccgggcgcggtggctcatgcctgtaatcccagcactttgggaggctgaatcacttgaggtcaggagtttgagaccagcctgaccaacagggtgaaaccccgtctcagctaaaaatacaaaaaaaaaaaagaaaaaaaaattagctgggtgtgctgaggcaggagagacgcttgagcccaggaggcagaagttgcagcaagccgagatcacaccactgtactccagcctgggcgacagagcaagactgtctcaaaaaaaaaaaaaaaaaaaaaaaaggaagagtgggaagccctgatcccttcctctcctgaacctcctgcctgccagggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtactgggtctggtgggctggggagggccaaaggacaggggtgatggaaggtggggggcagagaggtctagagaaagtggcacaggtggggacatcaaggaaacagaaacttctgggactggaggaaagggtaggccagggaggaagagaaggtagcagagtctcctcccctctgtagccctttccc

SEQ ID NO: 365 - DNA, 13581 bp, Homo sapiens
aacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgtgtgaacccgaaactgccacttgctggctgaggagagccgctgcggcgttccactgtcacgtgagggggccggtcctcttcggcggcggcactcagtgagtgacgccaagtggccaatcacaggccagcctcgcaggccacgtgaggcgagagctggttccaggaaaggggggccagagaccccgcagagtcgatgcgtcaggctgtggagtggggaatcatccttaaaccccacaatgtgcctagtgacctcccctgcactgtttccgaggtcttaaggagtgggagggtctgagaaggacccttcaccccaaactcaggggttaagagagcgccccctgcccttttagttgggcagagatatgcctgggtttgggaatgaacaacggtgatctagaagcccgctgtccctgggtagcagggagtgattaggcaggcacgggcatggcaagacaatagctagctgaggaaagaagcattttaaaacagagcgagaccctgtggtagaggatggtgaaaatggggcctagccatcttaattgaaaacccaaagcttgagacagactactgaatcagagggaaggagaacgagggctgcaggatggggacagtggtgatggtccttctgtcccctcttccctgcctattccactccccaggattggtccacctctcagcctcgggtctcctttccctaacccatcccccaaggagccaggacctgccctacataacttccctggggcccaagcacatcctgtgacccaaaaatggagagaggggccaatgagaggcagagaggtgggaggaggtgcagagaaaaaagctcttgccactgcccccacccaatatttcccctcccttcaaggtctgaggtcattggtctggtggtggggatgcctcggagtttcccaggctgacgtcagggttatacctctcggaggttctagggcagggaagtggggaggggaggttccctgagatctctgtctttgagtttggagtttgtctctgagacagatttcggaggggtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgag

SEQ ID NO: 366 - DNA, 14866 bp, Homo sapiens
cacaaaatatgctcccaattattcacatcttctggactttatcacccagaattcttttccctctcccccttggctacccacttcttggcctagaccgacttctagaactagtgtctggtagccagtattctggggaagggagtcccttgggggtagtgtttgagctctgcacttcccagggggagaaggtcctgttcccctgcttcaggtcctgactttccccactccaaccccagcagccccatccggatgtttgcttccttccacccttctgccagcaccgcagggacctctggggacagtggacccccagacaggtgagattctgtcttctattaccagtgatgctcttcttcccctctatgtgctcaaggctcttagtctctaacactgtttctctgattcacatgtgctctccatttctgcccatttcttacaattgccttctctccctaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctgagtcattctgaaagatgtagagaatacagggactagaagcacttatattctcccaacaaatttgcatacatgacaaaaaacaggcaaaaggcagagagacccaaagacgggatttattgggggcccagtcatcacctggaagtcagaaggcgttgaagtatcgcggggatcttcatgatgagcaggaacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgtgtgaacccgaaactgccacttgctggctgaggagagccgctgcggcgttccactgtcacgtgagggggccggtcctcttcggcggcggcactcagtgagtgacgccaagtggccaatcacaggccagcctcgcaggccacgtgaggcgagagctggttccaggaaaggggggccagagaccccgcagagtcgatgcgtcaggctgtggagtggggaatcatccttaaaccccacaatgtgcctagtgacctcccctgcactgtttccgaggtcttaaggagtgggagggtctgagaaggacccttcaccccaaactcaggggttaagagagcgccccctgcccttttagttgggcagagatatgcctgggtttgggaatgaacaacggtgatctagaagcccgctgtccctgggtagcagggagtgattaggcaggcacgggcatggcaagacaatagctagctgaggaaagaagcattttaaaacagagcgagaccctgtggtagaggatggtgaaaatggggcctagccatcttaattgaaaacccaaagcttgagacagactactgaatcagagggaaggagaacgagggctgcaggatggggacagtggtgatggtccttctgtcccctcttccctgcctattccactccccaggattggtccacctctcagcctcgggtctcctttccctaacccatcccccaaggagccaggacctgccctacataacttccctggggcccaagcacatcctgtgacccaaaaatggagagaggggccaatgagaggcagagaggtgggaggaggtgcagagaaaaaagctcttgccactgcccccacccaatatttcccctcccttcaaggtctgaggtcattggtctggtggtggggatgcctcggagtttcccaggctgacgtcagggttatacctctcggaggttctagggcagggaagtggggaggggaggttccctgagatctctgtctttgagtttggagtttgtctctgagacagatttcggaggggtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgag

SEQ ID NO: 367 - DNA, 4285 bp, Homo sapiens
cctttaaaaaggtaaagaagagaggaagaaaatgaacctaaatatagaacttatacctttttattaatttgggttaatgaaaattaattcaaaatggggcttggtgttgtgtgcctgtaatcccagctactcaagaggttgacaggggaggattgcttgagcctgggagttcaaagctgcagtatgctatgttgcatgtgtgatcagctactgcactccagcctgggcaacatagtgagaccccgtctcaagaaaaaaaaaagtaaaagcaaaatggatcataggccttaatgcaaaacacaaaactataaaacttctagaagaaaacacaggagaaagtagaggtgaccttgtgtttggtggtgagctttcagataaaacaccaaaagcattatccctgaaagaaaaaaaaattactagtttggacattattaatatttaaaaagatacttttaagagaatgaaaagatgaaccacaaattgggagaaaaatatttgagaacgcatatctgataaaggacttgtagtcaaaatatactaagaaatcttaaaactcaaaaatgaaaaaaacaaagaatctcatgggaaaagtggtcaaaaaatttgaacatactcctccgcaagaaaaaatatacggatggcaagtaaacatatgaaaagatgctcaacagcgctcgtcatagagaattgaaaattaaaacaagataccactacacacatattagaatgactagaacatgttttaaaagacaataataactgctagcaaaaatgtgaagcaacaagaactttcttgatgatgggaatataaaatggtatagtcactttgggagacaatttagaagtttcttacaaggctaaacgttaatcttatcacatgattcagcaaacagggtctcaggtatttactcaactcatttgaaaacactatgtccacacaaaaatctacatgcaaatgtttatagcagctttattcagaatcacagaaaggtggaagcaattaaggtgtcctttaataagtgaacggataacaaactgtggtacatctatgaaatggaatattattcagttataaaaagaaatgccatattgatatggtttggcttcatgtccccacccaaacctcatctcgaattctcatccccaggtaccacaggaaaatggaatactattcagttataaaaaagaaatgccatattgatatggtttggctctgtgtccccacccaatgctcatctggaattcttatcccaagctgtcaagggagtaacttggtggtgatgactggatcatgggggtggtttcccccctgctgttcttgtgatagtgactgagttctcatgagatcgaatggtttaaaagtgtgtggcagtttcctcatcacacgctctctcctgctgccatgtcaagaaagtccttgcttccccttcaccttccaccatgactgtaactttcctgaggcctccctgaccatgcaaaactgtgagtcaatttaaccttttttatttatacattacccagtcttgggtagttctttatagcagtgtaaaaacaactaatacaaattatcaaaccacaaagacacggattgatcttaaattcatatatgtaagtgagagaagccagtttgaaaaggctacctactgtatgcttccaatcacacaatattctggaaaaggcaaaactatgagggataaagggaaaggttgaagaggtggagcagaggcatttttcagggcagtgaaactattttgtatggaactgtaattgtggatacatgacaatatgtatttgtcaaaacccatcgaactttggcacaaagaatgaatcttaatgcatgcaaattttaaaaaatgatctaggaggtccatggaatcccaggatggaatacagaatgtgacaaatcaatctgtgttacaaatggtatgacacaaactcactgaaggggttcggagaaaagtgctgacttaagtaactttggaaatggctgggttctagaaaactcactgcaaaggaactatacataagcgttttagttgataaggttgtctcctatgggtaaattggttaacaattctgatattactgtacatgtaaactagacctaaacaagcaaataaatggtggatggtaggagccagattgcagtactgaagtgggggtttccagtaaacaaggggagaattctaggatgaccatataataatagcttacagttggagacatcagtgtaaacctatgtgttgttagtgttttttagagatgggttatcactctttcacccaatctggagtacagtggtgtaatcatagctcactgcaaccctgaactcctgggctcaagagatcctcctacctcagcattctgagtagctggggctacaggggcatgccaccacacctagctaatttaaaaaaataaatttaaggggtcttgtcaccttgccctggctggccttaaccccatgtttagttcagtatagatacagatggttacatctagaagtatagatatgtgtacatacatagtttagtatatatacatatatttcattattccgtcagctgaggggacctagaaataacaatgcctcagtagcaatacacaagatgagcctggaacatctttcagtgccagaaagaaagttctcaaaacacaggagctaacagttcccaatggccaagggtgcaacactttgagcaataaaagaaaaaaatttgtactggatcataacccaaagtataaaataagtatccataagtccatacttatgaaaatacatgatcaaactaaggaagggagggagggagggagggaaggaaggaagggaaggaagggaagggaggggagggagggagggaggaagggaggaagggaggaagggagggagggagggagggagggagggagggaggcaggcatctcccatatacaagaattccataatttataggtaatctgctctcatggagcaggagcataactcctgtttcttaagtgtagtctgtgcagtgactttctcccaaaggatacagtacggaaagagggaaaagttgtaacttcacggtagagaaacctgacaaacacacactccctccgccccgggtgatcaaggtcaacatcaacggtgacagtcatgttgacagtgtaagcctttgatacaatgtgatgaaaatggcccttcccctctgtgatcttcctcccctacacccatcaccccagtctaatcatgagaaaaccgtcagatgaatcccacttgagacagtctacaatatacatacccaatacttttcaaagctgtcaggatcatcgaaaataagaaaagtctgagaaactgtcacagccaaggggaactaaggagacaggacaagtaaatgcaccattgccaggcacagaaggacaaacaccacatgatctcacccacaggtgatctgaaaaggttgatcccatagaagttgaaagtagaacagtggttaccagaggttggggagaattgggggataggggtagggagaggctggttggtatagtcacagtgagatgagaggaataagttgtgttctattgcacagtaaagtgactgtaattaacaataacatgttgtatatttccaaagagttactaggttggtgcaaaagtaattgtgggttttgccattgacttttaatggtgaaacgcaaaattgcttttgcaccaacctagtagaagaaaggactttttaaaatgttcttccaacaaagaaatgataaatgtttgaagtgatgaatatgctaattaccctgatttgatcaatacacaatccacaaacgtgtaacattacactgtaacccataaatatgagttattgtatccattaaaaaataaaatacaattttttaaaaaggggcacgtcctttcatcttcccaagaggtacttcctacctcctgtcctgcctggacatggtctcaggagtcttggagagcaaggaaaaatgcaaaaaaaacaaacaaaaaaggtaccgttatatcctaaaatgagatccaagcacagaaaaaggacattaagtacaaacccgaggaaatctgcctaaatcatgagccttaataataatgtatcaaagtggttcattaaccgcagcacatgtaccatacttaagtaaaatgctaatgggcgatactgcgtgttggggatatgggcactctgtgctatctttgcaatgtttctgcaaattcaaaaccgttctaaaaaaagtttattcttaaaaaatttattctcatattgtctcccccatctgtgccctctccc

SEQ ID NO: 368 - DNA, 8752 bp, Homo sapiens
ctcaacttcactcaacttctctgttttaattcactacaactcttaccatgcaagaaaccaagtatgcctgtcggtctatgtaatagatggagaagtattataaatagggtatttgctactgaaacatagtatgtgaagagcagtgcagatagttagaaatagtgcacattgttttttattaatttgatgagttctccaacagagtcagaaaatccaatagtcagacaaagagaagattccacttaggttccacagccccatgccagctggataccagtcaagccccacaaatcagcaaacgccaagcttcaatgaaaatgaaagagtaaacatggggcctatgagaagacactgcaacacacaggaaggaaaacattgtcccaattctcaaagaaagagcctattccatcttaagaaacagaggtaggctgggtgcagtggctcatacctataataccaacactttgagaggatcatttgaagccaggagttccaggcctgcctggacaacatagcaagaccccgtctctacgaaaaatataaaaattagctgagcatggtggtgcgcatctgtagttccagctgctcaggaggctgaggcaggaggatcgcttgagcccatgacttctcatttacctgggcggtgaccgtgtctgttttcagttccctgcaagcttcatgtcctagcatcagagtcatattaagagagaaaccagctagacggctgctcagtgggttggtggatggatggatggatggatggatacatacattagattagatagatagatagatacatagatacatagatagatagtgttaaagtttgcttgagccctgagcctcacccaaggctgcagtgagctataaagccatggcactccagtctcggcaacagagcaagactctgtctcaaaaagaaaagaaacaagtaaattttagaaaccatgtcgatggggtcaccctaaaaggatgcaggaagacatggcctttgtgagactggggcagatcactgcaaagagagcacagcatagtgacagggaagccacaaacaagaaaataaggagagaggaatgaaacatccagcagctgaataaaaatgtacaacagaggcaataaagactagatgttttcctgaaaaataaaccaaagttttgatataagagaaaaactagaagagctctcccagaatgcagacggaaagcacaaagacataaacatgttgataaatgtgtattaaattatgcagagcaaagaatgaagatgcaacctaagaattataggtgttccttgcttttacactgttggtgagagtgtaaattagttcaaccattatggaagacagtgtggcgattcctcaaggatcgagaaccagaaataccatttgacccagcaatcctattactgggtatatacccaaaggattacaaatcattctactataaagatacatgcacatgtatgtttactgcagcactatttacattagcaaagagttggaaccaacccaaatgcccatgaatggtagactggataaagaaaatgtggcacatatataccacgaatactatgcagccataaaaaagaatgagttcatttgcaggggcatatgagtccttcgcaggggcatagttgagctggaagccatcattttcagcaaactaacacaggaacagaaacccgaacaccccgtgttctcactcataagcgggagctgaataatgagaacgtatggaaacagggagaggaacatcacacactggggcctgtcaggggcatgggggcaaggggagggagagcattaggacaaatacctaatgcatgcagggcttaaaacctagatgacgggttgataggtgcagcaaaccaccatggcacatgtatacttatgtaacctgcacgttctgcacatgtatcccagaacttaaagtaaaattttagaaaaagaattatagatgctccaagaaataagccaaacccatagaagagaggatatcataagaaaaatgcttaagaagttttttcctgaactgattaaagagtaagtatgaagttcaaagtggatcacaacttggcgaaatcaatgagaagagactcacaggtaatagttaacatttttgaaatttatgggtggaggggataaaatcactgcaatgtacaaacaaaacaaaaatgcaagccccttggatggaccctaagaggaatcaaagctgcaagtgttggagtcaagtccttcagctgatgggagcactgtccgtgggcatttccagctgtgacccagtaatggctatatccagggagattagcaataggaatttttctgtcagtgcaagacattcataggagagggccatcttgatgatgaacgatgagaaagggagaaaaatgacagccgtcaggcaagaaataaagagaatctgggctcacagacatgggagaaacacctctgcagagtctgggaggcttaagttcccaaagagtgagtgacagactgtcagaaaaatgcttcctggtgactgttattagaattgcatttttttatttcaatttttttagattcaaaggatacatgtgcaggttacatgggtatattgtgtaatgctgaggtttgaggtacaattttatccatcacccacgtagtgagcatagtacccaataggaagtttctcaacccttccccacctccctccctttctcctctagtagtcctcagtgtctgtttcttcggtctttatgtacacatgtacccaatgtttagctcccacttatacatgagaacatgcagtatttggatttctccttctgcattagttcaacctagcatgatagtctcccaggtgcacccatgttgctgtaaaggacaggatttcattttgttttttgagatggagtctcaccattgccaggctggagtgcaggagtgcgatcttggctcactgcaacctccacctcccgggttcaagcaattctcctgcctcagcctcccaagtagctgggactacaggtgcacgcctctacgcccagctaatttttgtatttttctagagatggggtttcaccatattggccgggatggtctccatctcttgacctcatgatccaccctcctcggcctcccaaagtgctgggattacgggcatgagccaccctgcccagccaggattttgttcttttttatggctgcatagtattccatggtgtatgtgtaccacattttctttatccaaatccaccgctgatgagcagctaggttgattccatgtctttgctattgtgaataatgctgcaatgaacgtaacggtacatgtgtcttcctggcagaacaatttattttcccttgggtctatattctgtaatgaggctgcggggtgaaaggacacttctgcttttagttctttgagaaatctccaaactgctttccacagtggttgaactaacttgcattcccaccaaaagtgtatgagcgttcccttttctctgcagcctcatcagcatgttattttttgactttttaactagtgtgaggaggtatctcattatggttttgatttgcctctctctggtggttagtgatgtggagcattttttcatgtttgttggctgcctgcatgtctaggatgtaatccccagagagcaggccctatgggatgccgtcttcacttctgtccccagcagctggcgcagatggtccttgtataactacaagtataggaccccatcttacctctaaggaagtgttctgggaagggacagagcagggagtctttacaatgacgaagagaaacgtcctgtctgaaaatttgttcctacccagtaaagagaataagcaatgatttcacagcttattttccaatccatagtgcagctaagggtggaggcatagatgagttggccctgttgtcccattagcatcacaataatccccctttttaaaatcttactttaagttctgggatatctgtgcagaacatgcaggtttgttacatagggatacatgttgacccagcaatcccattactgggtatatacccaaaggattataaatcattctactataaagacacgtgcacccatatgtttattgcagcactatttacaatagcaaagacttggaaccaacccaaatgcccatcaataataatccccatttcttatgcataaatgcattcctggatatgacttggaggaaggaggcggcaaaatgctttctccattactggcaggggacatttttgcagactgttgcctttaataaaatagtttttttccattatgtggacttacataaaactgtctctgagaagtgtagtttttccttgggaggtgagtgaatgtctgcaagtgtgtgcatattctctccaatatctactcctgggggattagaggaacacagagagaataaaaaacgtatgttgatttcaacaaatgctgctggaacaactgaatgatcgtacacaaagaaatgaacctttaaaaaggtaaagaagagaggaagaaaatgaacctaaatatagaacttatacctttttattaatttgggttaatgaaaattaattcaaaatggggcttggtgttgtgtgcctgtaatcccagctactcaagaggttgacaggggaggattgcttgagcctgggagttcaaagctgcagtatgctatgttgcatgtgtgatcagctactgcactccagcctgggcaacatagtgagaccccgtctcaagaaaaaaaaaagtaaaagcaaaatggatcataggccttaatgcaaaacacaaaactataaaacttctagaagaaaacacaggagaaagtagaggtgaccttgtgtttggtggtgagctttcagataaaacaccaaaagcattatccctgaaagaaaaaaaaattactagtttggacattattaatatttaaaaagatacttttaagagaatgaaaagatgaaccacaaattgggagaaaaatatttgagaacgcatatctgataaaggacttgtagtcaaaatatactaagaaatcttaaaactcaaaaatgaaaaaaacaaagaatctcatgggaaaagtggtcaaaaaatttgaacatactcctccgcaagaaaaaatatacggatggcaagtaaacatatgaaaagatgctcaacagcgctcgtcatagagaattgaaaattaaaacaagataccactacacacatattagaatgactagaacatgttttaaaagacaataataactgctagcaaaaatgtgaagcaacaagaactttcttgatgatgggaatataaaatggtatagtcactttgggagacaatttagaagtttcttacaaggctaaacgttaatcttatcacatgattcagcaaacagggtctcaggtatttactcaactcatttgaaaacactatgtccacacaaaaatctacatgcaaatgtttatagcagctttattcagaatcacagaaaggtggaagcaattaaggtgtcctttaataagtgaacggataacaaactgtggtacatctatgaaatggaatattattcagttataaaaagaaatgccatattgatatggtttggcttcatgtccccacccaaacctcatctcgaattctcatccccaggtaccacaggaaaatggaatactattcagttataaaaaagaaatgccatattgatatggtttggctctgtgtccccacccaatgctcatctggaattcttatcccaagctgtcaagggagtaacttggtggtgatgactggatcatgggggtggtttcccccctgctgttcttgtgatagtgactgagttctcatgagatcgaatggtttaaaagtgtgtggcagtttcctcatcacacgctctctcctgctgccatgtcaagaaagtccttgcttccccttcaccttccaccatgactgtaactttcctgaggcctccctgaccatgcaaaactgtgagtcaatttaaccttttttatttatacattacccagtcttgggtagttctttatagcagtgtaaaaacaactaatacaaattatcaaaccacaaagacacggattgatcttaaattcatatatgtaagtgagagaagccagtttgaaaaggctacctactgtatgcttccaatcacacaatattctggaaaaggcaaaactatgagggataaagggaaaggttgaagaggtggagcagaggcatttttcagggcagtgaaactattttgtatggaactgtaattgtggatacatgacaatatgtatttgtcaaaacccatcgaactttggcacaaagaatgaatcttaatgcatgcaaattttaaaaaatgatctaggaggtccatggaatcccaggatggaatacagaatgtgacaaatcaatctgtgttacaaatggtatgacacaaactcactgaaggggttcggagaaaagtgctgacttaagtaactttggaaatggctgggttctagaaaactcactgcaaaggaactatacataagcgttttagttgataaggttgtctcctatgggtaaattggttaacaattctgatattactgtacatgtaaactagacctaaacaagcaaataaatggtggatggtaggagccagattgcagtactgaagtgggggtttccagtaaacaaggggagaattctaggatgaccatataataatagcttacagttggagacatcagtgtaaacctatgtgttgttagtgttttttagagatgggttatcactctttcacccaatctggagtacagtggtgtaatcatagctcactgcaaccctgaactcctgggctcaagagatcctcctacctcagcattctgagtagctggggctacaggggcatgccaccacacctagctaatttaaaaaaataaatttaaggggtcttgtcaccttgccctggctggccttaaccccatgtttagttcagtatagatacagatggttacatctagaagtatagatatgtgtacatacatagtttagtatatatacatatatttcattattccgtcagctgaggggacctagaaataacaatgcctcagtagcaatacacaagatgagcctggaacatctttcagtgccagaaagaaagttctcaaaacacaggagctaacagttcccaatggccaagggtgcaacactttgagcaataaaagaaaaaaatttgtactggatcataacccaaagtataaaataagtatccataagtccatacttatgaaaatacatgatcaaactaaggaagggagggagggagggagggaaggaaggaagggaaggaagggaagggaggggagggagggagggaggaagggaggaagggaggaagggagggagggagggagggagggagggagggaggcaggcatctcccatatacaagaattccataatttataggtaatctgctctcatggagcaggagcataactcctgtttcttaagtgtagtctgtgcagtgactttctcccaaaggatacagtacggaaagagggaaaagttgtaacttcacggtagagaaacctgacaaacacacactccctccgccccgggtgatcaaggtcaacatcaacggtgacagtcatgttgacagtgtaagcctttgatacaatgtgatgaaaatggcccttcccctctgtgatcttcctcccctacacccatcaccccagtctaatcatgagaaaaccgtcagatgaatcccacttgagacagtctacaatatacatacccaatacttttcaaagctgtcaggatcatcgaaaataagaaaagtctgagaaactgtcacagccaaggggaactaaggagacaggacaagtaaatgcaccattgccaggcacagaaggacaaacaccacatgatctcacccacaggtgatctgaaaaggttgatcccatagaagttgaaagtagaacagtggttaccagaggttggggagaattgggggataggggtagggagaggctggttggtatagtcacagtgagatgagaggaataagttgtgttctattgcacagtaaagtgactgtaattaacaataacatgttgtatatttccaaagagttactaggttggtgcaaaagtaattgtgggttttgccattgacttttaatggtgaaacgcaaaattgcttttgcaccaacctagtagaagaaaggactttttaaaatgttcttccaacaaagaaatgataaatgtttgaagtgatgaatatgctaattaccctgatttgatcaatacacaatccacaaacgtgtaacattacactgtaacccataaatatgagttattgtatccattaaaaaataaaatacaattttttaaaaaggggcacgtcctttcatcttcccaagaggtacttcctacctcctgtcctgcctggacatggtctcaggagtcttggagagcaaggaaaaatgcaaaaaaaacaaacaaaaaaggtaccgttatatcctaaaatgagatccaagcacagaaaaaggacattaagtacaaacccgaggaaatctgcctaaatcatgagccttaataataatgtatcaaagtggttcattaaccgcagcacatgtaccatacttaagtaaaatgctaatgggcgatactgcgtgttggggatatgggcactctgtgctatctttgcaatgtttctgcaaattcaaaaccgttctaaaaaaagtttattcttaaaaaatttattctcatattgtctcccccatctgtgccctctccc

SEQ ID NO: 369 - DNA, 18461 bp, Homo sapiens
ctcaacttcactcaacttctctgttttaattcactacaactcttaccatgcaagaaaccaagtatgcctgtcggtctatgtaatagatggagaagtattataaatagggtatttgctactgaaacatagtatgtgaagagcagtgcagatagttagaaatagtgcacattgttttttattaatttgatgagttctccaacagagtcagaaaatccaatagtcagacaaagagaagattccacttaggttccacagccccatgccagctggataccagtcaagccccacaaatcagcaaacgccaagcttcaatgaaaatgaaagagtaaacatggggcctatgagaagacactgcaacacacaggaaggaaaacattgtcccaattctcaaagaaagagcctattccatcttaagaaacagaggtaggctgggtgcagtggctcatacctataataccaacactttgagaggatcatttgaagccaggagttccaggcctgcctggacaacatagcaagaccccgtctctacgaaaaatataaaaattagctgagcatggtggtgcgcatctgtagttccagctgctcaggaggctgaggcaggaggatcgcttgagcccatgacttctcatttacctgggcggtgaccgtgtctgttttcagttccctgcaagcttcatgtcctagcatcagagtcatattaagagagaaaccagctagacggctgctcagtgggttggtggatggatggatggatggatggatacatacattagattagatagatagatagatacatagatacatagatagatagtgttaaagtttgcttgagccctgagcctcacccaaggctgcagtgagctataaagccatggcactccagtctcggcaacagagcaagactctgtctcaaaaagaaaagaaacaagtaaattttagaaaccatgtcgatggggtcaccctaaaaggatgcaggaagacatggcctttgtgagactggggcagatcactgcaaagagagcacagcatagtgacagggaagccacaaacaagaaaataaggagagaggaatgaaacatccagcagctgaataaaaatgtacaacagaggcaataaagactagatgttttcctgaaaaataaaccaaagttttgatataagagaaaaactagaagagctctcccagaatgcagacggaaagcacaaagacataaacatgttgataaatgtgtattaaattatgcagagcaaagaatgaagatgcaacctaagaattataggtgttccttgcttttacactgttggtgagagtgtaaattagttcaaccattatggaagacagtgtggcgattcctcaaggatcgagaaccagaaataccatttgacccagcaatcctattactgggtatatacccaaaggattacaaatcattctactataaagatacatgcacatgtatgtttactgcagcactatttacattagcaaagagttggaaccaacccaaatgcccatgaatggtagactggataaagaaaatgtggcacatatataccacgaatactatgcagccataaaaaagaatgagttcatttgcaggggcatatgagtccttcgcaggggcatagttgagctggaagccatcattttcagcaaactaacacaggaacagaaacccgaacaccccgtgttctcactcataagcgggagctgaataatgagaacgtatggaaacagggagaggaacatcacacactggggcctgtcaggggcatgggggcaaggggagggagagcattaggacaaatacctaatgcatgcagggcttaaaacctagatgacgggttgataggtgcagcaaaccaccatggcacatgtatacttatgtaacctgcacgttctgcacatgtatcccagaacttaaagtaaaattttagaaaaagaattatagatgctccaagaaataagccaaacccatagaagagaggatatcataagaaaaatgcttaagaagttttttcctgaactgattaaagagtaagtatgaagttcaaagtggatcacaacttggcgaaatcaatgagaagagactcacaggtaatagttaacatttttgaaatttatgggtggaggggataaaatcactgcaatgtacaaacaaaacaaaaatgcaagccccttggatggaccctaagaggaatcaaagctgcaagtgttggagtcaagtccttcagctgatgggagcactgtccgtgggcatttccagctgtgacccagtaatggctatatccagggagattagcaataggaatttttctgtcagtgcaagacattcataggagagggccatcttgatgatgaacgatgagaaagggagaaaaatgacagccgtcaggcaagaaataaagagaatctgggctcacagacatgggagaaacacctctgcagagtctgggaggcttaagttcccaaagagtgagtgacagactgtcagaaaaatgcttcctggtgactgttattagaattgcatttttttatttcaatttttttagattcaaaggatacatgtgcaggttacatgggtatattgtgtaatgctgaggtttgaggtacaattttatccatcacccacgtagtgagcatagtacccaataggaagtttctcaacccttccccacctccctccctttctcctctagtagtcctcagtgtctgtttcttcggtctttatgtacacatgtacccaatgtttagctcccacttatacatgagaacatgcagtatttggatttctccttctgcattagttcaacctagcatgatagtctcccaggtgcacccatgttgctgtaaaggacaggatttcattttgttttttgagatggagtctcaccattgccaggctggagtgcaggagtgcgatcttggctcactgcaacctccacctcccgggttcaagcaattctcctgcctcagcctcccaagtagctgggactacaggtgcacgcctctacgcccagctaatttttgtatttttctagagatggggtttcaccatattggccgggatggtctccatctcttgacctcatgatccaccctcctcggcctcccaaagtgctgggattacgggcatgagccaccctgcccagccaggattttgttcttttttatggctgcatagtattccatggtgtatgtgtaccacattttctttatccaaatccaccgctgatgagcagctaggttgattccatgtctttgctattgtgaataatgctgcaatgaacgtaacggtacatgtgtcttcctggcagaacaatttattttcccttgggtctatattctgtaatgaggctgcggggtgaaaggacacttctgcttttagttctttgagaaatctccaaactgctttccacagtggttgaactaacttgcattcccaccaaaagtgtatgagcgttcccttttctctgcagcctcatcagcatgttattttttgactttttaactagtgtgaggaggtatctcattatggttttgatttgcctctctctggtggttagtgatgtggagcattttttcatgtttgttggctgcctgcatgtctaggatgtaatccccagagagcaggccctatgggatgccgtcttcacttctgtccccagcagctggcgcagatggtccttgtataactacaagtataggaccccatcttacctctaaggaagtgttctgggaagggacagagcagggagtctttacaatgacgaagagaaacgtcctgtctgaaaatttgttcctacccagtaaagagaataagcaatgatttcacagcttattttccaatccatagtgcagctaagggtggaggcatagatgagttggccctgttgtcccattagcatcacaataatccccctttttaaaatcttactttaagttctgggatatctgtgcagaacatgcaggtttgttacatagggatacatgttgacccagcaatcccattactgggtatatacccaaaggattataaatcattctactataaagacacgtgcacccatatgtttattgcagcactatttacaatagcaaagacttggaaccaacccaaatgcccatcaataataatccccatttcttatgcataaatgcattcctggatatgacttggaggaaggaggcggcaaaatgctttctccattactggcaggggacatttttgcagactgttgcctttaataaaatagtttttttccattatgtggacttacataaaactgtctctgagaagtgtagtttttccttgggaggtgagtgaatgtctgcaagtgtgtgcatattctctccaatatctactcctgggggattagaggaacacagagagaataaaaaacgtatgttgatttcaacaaatgctgctggaacaactgaatgatcgtacacaaagaaatgaacctttaaaaaggtaaagaagagaggaagaaaatgaacctaaatatagaacttatacctttttattaatttgggttaatgaaaattaattcaaaatggggcttggtgttgtgtgcctgtaatcccagctactcaagaggttgacaggggaggattgcttgagcctgggagttcaaagctgcagtatgctatgttgcatgtgtgatcagctactgcactccagcctgggcaacatagtgagaccccgtctcaagaaaaaaaaaagtaaaagcaaaatggatcataggccttaatgcaaaacacaaaactataaaacttctagaagaaaacacaggagaaagtagaggtgaccttgtgtttggtggtgagctttcagataaaacaccaaaagcattatccctgaaagaaaaaaaaattactagtttggacattattaatatttaaaaagatacttttaagagaatgaaaagatgaaccacaaattgggagaaaaatatttgagaacgcatatctgataaaggacttgtagtcaaaatatactaagaaatcttaaaactcaaaaatgaaaaaaacaaagaatctcatgggaaaagtggtcaaaaaatttgaacatactcctccgcaagaaaaaatatacggatggcaagtaaacatatgaaaagatgctcaacagcgctcgtcatagagaattgaaaattaaaacaagataccactacacacatattagaatgactagaacatgttttaaaagacaataataactgctagcaaaaatgtgaagcaacaagaactttcttgatgatgggaatataaaatggtatagtcactttgggagacaatttagaagtttcttacaaggctaaacgttaatcttatcacatgattcagcaaacagggtctcaggtatttactcaactcatttgaaaacactatgtccacacaaaaatctacatgcaaatgtttatagcagctttattcagaatcacagaaaggtggaagcaattaaggtgtcctttaataagtgaacggataacaaactgtggtacatctatgaaatggaatattattcagttataaaaagaaatgccatattgatatggtttggcttcatgtccccacccaaacctcatctcgaattctcatccccaggtaccacaggaaaatggaatactattcagttataaaaaagaaatgccatattgatatggtttggctctgtgtccccacccaatgctcatctggaattcttatcccaagctgtcaagggagtaacttggtggtgatgactggatcatgggggtggtttcccccctgctgttcttgtgatagtgactgagttctcatgagatcgaatggtttaaaagtgtgtggcagtttcctcatcacacgctctctcctgctgccatgtcaagaaagtccttgcttccccttcaccttccaccatgactgtaactttcctgaggcctccctgaccatgcaaaactgtgagtcaatttaaccttttttatttatacattacccagtcttgggtagttctttatagcagtgtaaaaacaactaatacaaattatcaaaccacaaagacacggattgatcttaaattcatatatgtaagtgagagaagccagtttgaaaaggctacctactgtatgcttccaatcacacaatattctggaaaaggcaaaactatgagggataaagggaaaggttgaagaggtggagcagaggcatttttcagggcagtgaaactattttgtatggaactgtaattgtggatacatgacaatatgtatttgtcaaaacccatcgaactttggcacaaagaatgaatcttaatgcatgcaaattttaaaaaatgatctaggaggtccatggaatcccaggatggaatacagaatgtgacaaatcaatctgtgttacaaatggtatgacacaaactcactgaaggggttcggagaaaagtgctgacttaagtaactttggaaatggctgggttctagaaaactcactgcaaaggaactatacataagcgttttagttgataaggttgtctcctatgggtaaattggttaacaattctgatattactgtacatgtaaactagacctaaacaagcaaataaatggtggatggtaggagccagattgcagtactgaagtgggggtttccagtaaacaaggggagaattctaggatgaccatataataatagcttacagttggagacatcagtgtaaacctatgtgttgttagtgttttttagagatgggttatcactctttcacccaatctggagtacagtggtgtaatcatagctcactgcaaccctgaactcctgggctcaagagatcctcctacctcagcattctgagtagctggggctacaggggcatgccaccacacctagctaatttaaaaaaataaatttaaggggtcttgtcaccttgccctggctggccttaaccccatgtttagttcagtatagatacagatggttacatctagaagtatagatatgtgtacatacatagtttagtatatatacatatatttcattattccgtcagctgaggggacctagaaataacaatgcctcagtagcaatacacaagatgagcctggaacatctttcagtgccagaaagaaagttctcaaaacacaggagctaacagttcccaatggccaagggtgcaacactttgagcaataaaagaaaaaaatttgtactggatcataacccaaagtataaaataagtatccataagtccatacttatgaaaatacatgatcaaactaaggaagggagggagggagggagggaaggaaggaagggaaggaagggaagggaggggagggagggagggaggaagggaggaagggaggaagggagggagggagggagggagggagggagggaggcaggcatctcccatatacaagaattccataatttataggtaatctgctctcatggagcaggagcataactcctgtttcttaagtgtagtctgtgcagtgactttctcccaaaggatacagtacggaaagagggaaaagttgtaacttcacggtagagaaacctgacaaacacacactccctccgccccgggtgatcaaggtcaacatcaacggtgacagtcatgttgacagtgtaagcctttgatacaatgtgatgaaaatggcccttcccctctgtgatcttcctcccctacacccatcaccccagtctaatcatgagaaaaccgtcagatgaatcccacttgagacagtctacaatatacatacccaatacttttcaaagctgtcaggatcatcgaaaataagaaaagtctgagaaactgtcacagccaaggggaactaaggagacaggacaagtaaatgcaccattgccaggcacagaaggacaaacaccacatgatctcacccacaggtgatctgaaaaggttgatcccatagaagttgaaagtagaacagtggttaccagaggttggggagaattgggggataggggtagggagaggctggttggtatagtcacagtgagatgagaggaataagttgtgttctattgcacagtaaagtgactgtaattaacaataacatgttgtatatttccaaagagttactaggttggtgcaaaagtaattgtgggttttgccattgacttttaatggtgaaacgcaaaattgcttttgcaccaacctagtagaagaaaggactttttaaaatgttcttccaacaaagaaatgataaatgtttgaagtgatgaatatgctaattaccctgatttgatcaatacacaatccacaaacgtgtaacattacactgtaacccataaatatgagttattgtatccattaaaaaataaaatacaattttttaaaaaggggcacgtcctttcatcttcccaagaggtacttcctacctcctgtcctgcctggacatggtctcaggagtcttggagagcaaggaaaaatgcaaaaaaaacaaacaaaaaaggtaccgttatatcctaaaatgagatccaagcacagaaaaaggacattaagtacaaacccgaggaaatctgcctaaatcatgagccttaataataatgtatcaaagtggttcattaaccgcagcacatgtaccatacttaagtaaaatgctaatgggcgatactgcgtgttggggatatgggcactctgtgctatctttgcaatgtttctgcaaattcaaaaccgttctaaaaaaagtttattcttaaaaaatttattctcatattgtctcccccatctgtgccctctccctaaaagatggcctaaaaatgcagagagagagagagaatcatggcttaagcatcctgcttgctgatcccacatacatgaccacagacacctgttggtctccagggggatgtgtcttgtcacccggtcgcaggtgtgcactggctggccaataatcctgaagttcagaactggtgcatttgggctccttctagttggtgcaatgctttcaggattcctggtatctgccctgagtgtttgggcttcctctcagctctgtgtggctgcagatcgctgggtctctattttgccctctctctagacctggaccagcaggccacgtccatcctctgttctggaaacaccctggcatccagcgcttccttcagttaccataaagctattgagtgagactcaggaaagctaccttgttgcgctctctactcatttaacttgcaagcagtattctgagcaggtgctctgtccggtgggctcccaaggtctccatggcggggcaacgcaggagcccctgtccctggtattcacatcaaacaccccctggggaccaatcccagagagaaggatgcaggaattcttccagttctcctgcctctttctcattttgcccttctcttctccaactttgaatcagaaagtagaagtttcctttacttctgtttcatagcctccttctttctggctccatcctcaaaattaagccttaaaagtgtccgaggcatcgtctttacattaggaaaataatttttaagccttaaaagtgtcagaggcatcttctttacactaggaaaagaattcaaaaatctgagtcttccctgttaggctttaattttgcaagctttcactgcccgtgaagcatggttttaaagtgtaacgtctccttaagaagtcaaatgactgttgttatcttgccctgggataaaaagtctcttgacttaagctcagttgcaatcaaataccaaggggctgagcttggtggcttgtgcctgtaatcccaacactttgggaggctgaggcaagtggatcacctgaggtcagcagttcgagactaacctggccaacatggtgaaaccctgtctctactaaaaatacaaaattagctaggcacagtggtgcatgcctgtaatcccagctactcgggaggctgaggcaggagaatcccttgaacccgggaggcggaggttgcagtgagccaagatcacgccattgcagccactgcactccagcctgggcaacaagagcaaaaccccatctaaaaaaaaaaaagaagaaagaaaagaaaaaaaaggggagaattaacaagcactagtttgatatttgccaaaatattattcccatggcttactgctggggtagtatgatgagttctatgggctggctgggtgggagaccaggttggctaaggaggggtaggacctttgccctgggaagacctgaaaaaagaagcactggctctaagaaataagggggattggggccgggcacggcgactcacccctgtaatcccagcactttgggaggccgaggcgggtgaatcatgaggtcaggagtcccagaccagcctggccaacgtcgtgaaacaccacctctactaaaaatacaaaaaaattagcggggcatggtggcaggcacctgtaatctcagctactcaggagggtgaggcaggagaatcacttgaacctgggaggcagaggttgtagtgagccgagatcacgccactgcactctagcctgggtgacagtgcaagactctgtctaaaaaagtaaaaattaaaaaaataaatgagagattggctgccctgagacagtgaaacgtggctgagaaactcaccagccagggggcccaagaatagaattcaagaggtccacaaatttggatgggaaagaatatacctttatttccattatcctataaatgaaatctagcattttcttcaattaggaatgcaagccacaaggcaccgtggaattagcaatgcccgactgtgccactattttactatcatgttcccactgtcccaattactttgaaatgttgtttatgcttaccctaacagcacttcaaaattatgattattatatctaccaatagcccttattatttaatacatcaacaaggaagcacatgtgttattatatcaacacatttgttctgtttagtatttttgataccatgcttatgtataatacatttccctttgttgttacctcaagtattctattttatgcatttagaaacataattcacaggcctcaccagactgccaaagggatccatgcaccaaaagtacccttaaaatatatttttttctgactctaagaagatttctttgtacattgtaatttttcctgacattgaaattctccagttactcccaagccttcggtaaaatctgatttatatacatatgctgtgtgttaatcggcttgtggagaattgagagaggatggagtaaaacaaatttcaccctccctacccacctcccaaccgcagaggctggtgacttggtagcagccacatattgaaagaagatggtagatccagagtcccagatgtagacccaaagtgaagctgcagagggctaagatggtacaaagcccagttagtttaggaaaaatgttaagagataaacactcttcaaacctaataatgatcagaggtatccacaggatcctcagattgctggaaggcatcttatcttgacttcccctagaatcctacttttccatttcacccagcaagacaccagaagatcccaaagaggtgcactgctaggaccaggcagcaaaaggacccagcatgatgaagaagaagtgtggtagttttaaaatatggcccctgatataatttggctatgtccccacccaaatctcatcttgaattgtagctcccataattcccacatgctgtgggagagacccagtgggagataattgaatcatggagggggtttccctcatactgttctcgtggtagtgagtaggtctcaaaagatctgatggtttaataaatgggagttcccctgcacaagtttttttgttttttgtttttgtttttgtttttgcctgccaccatgtaagacatgcctttcaccttctgccatgattgtgagccacacccccagccacatggaactgtgggtccatgaaccctcttttgctgtataaattacccagtctcaggtatgtctttatcagcagcatgaaaacagactaatacagtccccaaattcattcagcctccttctgttgagatgtggtgtctatgcctccactccctgaatctaagaggatttgcactgctttgacccctagagtatggcagaagcaatagcttacaaggttaagtcctaaaatgccaaccgggttccatctgtttctcttggaaggctcactgagatgctcccttttaggatgctcttcttacaacccagataccaagctgtcagaacacaagccacatggcaaaaccatatgtagatgctcccagctgagctagtccttcagccatcccatcccaggcacctgacatggaagtgatcaaataatgtcagcccccagccatctgcgtttctccaacagaggtaccagacatctcggagcagatacaagctgtctctactgaattcctgacctcgagattccacaagcgcaggatggttgttggtttatccccccgagtttggggcggtttattacaaagcaatagtaactggactcagagacaaaaagttcaggaagaggctcctgtacggccacatggttcatggatggagagctgaacggtgctgatgggagagactgaggaaggggcacatagtgaaacaggactgaaggtcaacttgtgtctctccagttccctttgcactgtgatgagtagaaatgacttgtacccagagtagtactgtctcatacggtctgctaacagcaagactatttagggcatgaactctattgactaatcctctcccttaccccactttctcaataggagcaaaatcctcaaattaaaatttggtacaggtcaatgcagtggcacatatctgtaatcccagcagtttgggaagccaaggtgggaggattgctggaggccagaagaattcaagaccagcctgggcaacatagcaagaccctgtttaaattaaaaaagaccctgtttcattaaaaaaaaaattaattagccagacatgttggcatgtacctgctgtcccagctacttcggaggctgaggtgggagaactgtttgatcccagaagttcaaggctgcaatgagctatgatctcaccactacactccacctgggcaacacagcaagactctgtcacttaaaaaaaaaattaatacaaacaccaggagtgtgttagatgaattcagtctctctcagtgattccaattttttccatgaaagggtttctaatgaaggacaattacagggtcatagcccaaagcagccccgccacaagcaagaaccatctttaaagtccaatatttttgccttaaaaactagcactccggctgggcgcagtggctcacacctgtaatcccagcacattgggaggccgaggcgtgtggatcatgaggccagatcaagaccatcctggctaacacggtgaaaccccatctctactaaaaatacaagaaattagccgggcatggtggcgggcacctgtagtcccagctactcgggaggctgaggcaggagaatggcgtgaacctgggaggcagagcttgcagtgagccgagatcgcgccactgcactccagactgggagagagagcaagactccgtctcaaaaaacaaaacaaacaaaaaaactagcattctacaccataacatatgaagtatgtttttaacagtacaatgtcttaaactacctgtcataaagcaaggaggacactgcatgaacatgtactctgttgatcatcagatgtcagatgtactctgtcccacagctgggccccccccaggcaaatgccaaaagaataggtatacagaattctgatgctccaaagcccttttgaaggaatcaggtgcctaggagtcggccatttagcttattgaccatagagcttttttttttttttttttctattttgagacagagtctcgctctgtcacccaggctgctgcacagtggcacaagctcagctcactgcaatctccacttcccaggcccaagcaatccctctgcctcagcatcctgagtagctaggattacaggcatgggccaccgtgcctggcctcggagcactcttaaatatttatcagcattgatgttaatcatcaagttgtggcatgttttattaaaagaatcacataggaagtaaatggatcctgagtgaacagatttccaagagatggggtcagcaaatctccaagaagatgaaaaagtgatcagaatttcttagctaagatcattggtaatatgtatggtggagtgcagaatttacactttgtgcatatagaatttttttcatcatgaagacacttctcttgatcctgcaccctctcacttcctcagggacatgactcaagcacttcctttctgtcacctccttcccctccactctggtgtcctcgtcctcaaaagcccttcccttaggtgaattggtatggtaattctggagagcaatttgacaaaacctagcaaaagaaaaaatgtacatgttttgacccagatgtttcacttctagaaaatgtagctttagctatgcttgcacaagtttgtaaggataaatgttgctcatacacagatgctctccaaagcattgcctgtgagaacaaaaacagagcatgacctgaacagacatcattacgggactggtccagtacattgcagtacaatagaaaaggatgctggtaatcaactgttgagtgaaaaaaaagttgcatagcaatgtgatcacattcataataataaactgcatattttgatgtatatatgcttatttaatctgagtgtatggcacaacttcaggggtaccattgactttttttttttttttttgagacacagtctcactatgttgcccaggctgaagtgcagtggcgcaatcgtagctcactgcagccttaaattcctgggatcaagcaatcctcccacctcagcctgctgagtagctgagactacaagggtaccaacatgcccgttttattttatttttttgtagagatggactctcactagattgcccgggctggtctcaaactgctggactcaagtgatcctcccacctcagcctcccaaagtgctgggattacaggcatgagccatcgtgcccagcctacattctattcttgtcttgtaagtgaatgaatggtacacatgggaactgcacatctgcgtatgtgtgtcacctgatgtgccccaggaacgccctgagcttgcatgtatcctaacacataaactctatggtaagtactaacctacctccccaagaccctgtagactgcatgaggaaaggattattcacctttttatctccaacatgcagcactgtacctggcacaccaatggcacttgaataaataagggtgtgagcattcatgggccccagaatatgtcagttatctatcatttgcattgatctaagaactaggcatgtccccgggagagaaaataaacacttaataggtggtttccaggctttagcaaacacatacacacacacgctgcgcacgcgcgcgcacacacacacacacacatatccagggttccaggctcaaactgtatttggaaaaactgagataaatgaagataaaccattttcttggctgtagggcatcactaagattttaatttgcattgatactctccaagaggcagatacagtatggagtatcatccgaattttactgaccatgaagcacctttagaggaacatttatttatattgatgttctgaggatcattcatctgtaacaggctgcattagaagaatcacaaaggaagtcaatggatcccaggtgaaagtcagattgccaagaggtggggtccaagaatctccaggagggtgaaagagtgatgaaaagtttcttaggtaagatcatttgaaactcccattggatgtcgaaaaccgagaaggaaaagatttggtcaatggaacaagagcaagcaaagcatgcttgttgagctgatagcagggtggcaaaaatcctccccctggggacttctgggaccttggcagggatgtcagggaaggagcccagtgatcagaattccaggagcttcctgaaaagcttctgatttaggaggtaggacctccaaatatatatattttaactcaccagatacattttgacgttgagctaaattttgaactggccattgcttgacatcgctccttctgctctgacactagctcttgttccctccagaatctgatcagcaaactgatgggagcagaggctacattacatgaggcgagattaagaaggaagtcaggccgggcacagtgtctcaagcctgtaatcctagcacttgggaagccaaggcaggcagatcacttaaagtcaggagttcgagaccagcctggtcagcatggtgaaactcttgtctctactaaaaaaaaaaaaaaaaaaaaaagaaagaaaaagaaaaattagctgggtttgctggcaggcacctgtaatcccagctactcggaatgctaaggcaggagaatcgcttggacctgggagacagaggttgtggtgagccaagatcatgccactgcactccagcttgggtgacaaaaggagactctgtctcaaaaaaaaaaaaaaaggaaacaaaaagtggagaaatagagcaatgtatgcaatttttcttgggggaagaaagaagacactggtgaataggacggaggaggtataattgatggaataaggtctctaaagacagtgtgtcggggaagagatatctgagcacatgtggcaagtggtccttggacttgggaaaggaccgtcctctactataatgggcagagaggggcaaagacagagctgaatgtagaaaaggtgacagttgggtgggtagggagttgaagatgtttctgcctggggtctttgttttaattgtgagggagaaggtgacaccattcttaagacaagtgagtcggggttgaaatagtcatggagacctgaccactagaaccatgactcacactgagaacttcgttgaggttgaaggttagaagtatataggatcatctatctgtgtcccatatccttgtagaatcttttagtagtagtagtaaaagtagtagtagaactagtaagacagggtctgtctgtgttgcccaggctggagtgcagtggcatgatcataattcactgcagcctccaaatcctgggctcaagcaatcctcccccctcagcctccaaagtggctaggactacaggcatccaccaccgtgcctggttaattttttttagttttgcagagatggagtctcactatgttgcccaggctggtctcaagctcctggcctcaagcaatcctcctgcctcagccatccaaagtgctgggattacaatcataagccatcatactcaacccatgtaggattttaccccggagcactccacatactgaagcagaagtaacaatagaaaacagctgtcagggaggatgccagagagaggcaggttgcagtgtaagcacccagagggtccacattctagaagatgacaagatcaaggttgaggccacaggagtcaaagtcaagaggatagaaggtcacaggagttgaagttgaggcaacaagaggtgagaatgttgcctggtcatctccatgctcattcatctccccagtatgatcaggacttgcagcagatataagaatgaataagctgctagggaattccaggagtgaaggggtgactagaagaaaagcaggtcacagcaatgaggaagagggagtcaggaaatgtgttcctcaatggggcagagatttttacacaatggttaggaacaagcacatgaaggtctaccagtagcctcttcaagtgaaggatctcactgctcctcttgggggatcttggagagcacccattctctctcacacacacacacacacacacacacacacacacacaccttgctccaaccaaagtgggtcctctaagtattagcctacccttaggacttactttagaaaagcttttatgagcaaaacaaaaaaaaattaaacaccattgatcatgcctagcccttccattataagccaaggatgagcttgatgaaggtacccactgctgcatcctgctagcatgccacgtgaggtacactctcccctaagacacagctcctggatgatgcatccttttagggccgatgagttcggcaccactgaagtccagaagagccaagcattgtggggaagtaggaccattggccagagaagggccatgatggaagcccttggacacctgttagggacagggaagagaggcaagaagaggagaaataaagatggcaagcaaagaggagtccagctgatgattccaatctagcaaggaagagcagctcagcgtccaggcaacaaaggctgagttccttcagcctctcactgtgcaggaccttccgtcacaaggaagtttacaggtcttgtttatgtgtagactttttataagctattcagagcaggggtgggagggaaaactagagagaaaagttccctttgaatttccattgctttcagagtcggcaatttaatgagtcaggcattctaaat

SEQ ID NO: 370 - DNA, 10915 bp, Homo sapiens
attttttagggatattggaggggacattgaaggatattggtgtgggaaaataatatgttgcatgatagtttgtaatttacaaaacaatagcacttgaagaagaatgaattaaagatgattgctctttgattttaaaatacttctgttttaaagtctattataggccgggcacggtggctcacacctgtaattccagcattttgggaggcctaggcgggcagatcacctcaggtcaggaatttgagaccagcctggccagcagggtgaaaccccgtctctactaaaaatacaaaaagtagctaggcatggtggcgtgcgcctgtaatcccagctactcaggaggctgaggcaggacaatcgcttgaacctgggaggcagaggttgcagtgagccaagatcgtgccactgaactgcagcctgggtgacagagtgagactccgtctccaaaaaaatacataaagtctactacaaacacttttatttaaaagagagaacataggcatagggcttagtatatagtacctctcacttaataaaccctcagtacatgattcttgttgatagtaatattattaaatgaggaaaaaatattagagacatgctacaaaataactaaccggttttctttataagagtcaaagtcttgaaagacaaggaacaattgaagaattatcacagatttaaggagactaaggagacatgcagtgtgggtcctggattgggtcctagaatgagaaaggatgttagtgggaaaaaagggcacatttgaatagttgtgtagtttagttgattatattgtagcagtgttaatttcctggttttgatcattgtattgcagttacatactatgttaatattaaggggaagctgctgagggtgtagtggtgagatcatgactcactgcagcctcgacctcccaggctcaagtaatcttcctgcctcagcctcctgagtagctgagaccacaggtgtgtgccaccactcccagctaatatttttaattttttttgtagaaatagggttccgtatgttgcccaggctggtcttgaatttctgggctcaagggatcctcccacctttgcctcacaaagtgcttgggataataggcatgagccattgcacccatctggaatcctatactttatgcaacttttctatttctttctttcttctttcttctttcttttctcttttttttttttctttttggaggcaaaaatcttgctttgttgcccaggcttggagtgcaatggagcgatcttgactcactgcaacctctgcctcccgggttcaagtgattctcttgcctcagcctcctgagtagctgggactacaggcacgtgccaccatgcttggctaatttttgtatctttagtatggtttcaccatgttagccgggctggtcttgaactcctggcctcaggtgatccgcctgcctcagcctcccatagtgctgggtttacaggcatgggccaccacacctaagcctgcaacttttctttaacttcttttgctttttttaaacttcttattcaaaaatagtaagtttaaaaatacaattttgttttagaaaagatttcaattttgtatttgaactaagttatctactgagaggtcggatgtcaacagaaagaatttagaatctcctacccgacagagcttttaagatccactaaagcccattaagcaatccactagaatagcttaaggcaagagtgggttcccttgaagacccagaagtagaacctctgaggtgcttccttgattaggctttgtctcagtggaatgttggagctagtttgattgtctatccagaccattaaaactttttatgtcagcactagggctgtttttgcctttgtgtgttcactggagtagcacttttaattccctttaagaacttgtcctttgcattcacagcttggcaaactggtgcaagaggcctgacttctaccctgtcttagctttgaacataccttcctcactctagcttttgatttaaagtgagagatgtgcaattcttcctttcacttgaacacataaagaccattgtaggggaattcattggcctgatttcaatattattgtatttcagggagtaggtccaaggagagggtgatagccgggggaatgattggtccgtgaagcagtcagagcacatgcaacacttctcagtttaagtttcctgttttctatgggtgtggtttgtggtgcccaaaacaattacaatagtgacatcaaagatcactgatcacagatcaccatgacagatatcataataatggaagtttgaaatattgcaagaattaccaaaatgtgacagacatgaagtaagcaccctgccacaaatcttcaatttgtaaaaaaaaacacagtatctgtgaagcacaatttaaaaaaaatttgaagtggaatagaatgaggtgtgcctatatatggaagatggcttgatctaatcagagataaaaagagatgaatgaggaccatatcaaaattatttccagtttgcagttaattctgctcccagtctccagtcctaggcaaccacaggccagcttttctggacacttcatctaaatggaatcatacaatacatactcttttgagtctgacttccagtttttgcctgttatgaataatgctgctatgaacctttgtgaccatgtgttcatgtgaatgtgtttttatttcttttgggtggattcttaggaacggaattggtaggttgtatggtaactttgtgtttacttttacgaaactgccaaacttttttcaaaattaccattttacattccttccagcaatgtatgagaattcagtattctctttatttctgattatagccatcagagtggttgtgtagtggtatctcattatggtttacatttacatttctctaatgatgttgagattatttttgtgtgcttgaaatacctgttcaaatctcttatccatttttaaattgggtttttaacttatattgtattataacaagttctttattctggatacaatctcttaatcagatatatgatttgcagtattttctcccagactgtgactttcttttcattttttgggggattttttttttttttttttgagaccgagtctcactctgtcgcccaggctggagtgcactggcgcgatctcagctcactgcaaactccacctcctgggttcaagcagttctcctgccttagcctcccaggtagctgggattacgggtgcctggctcatttttgtgtttttagtagagacaggctttcaccatgttggccaggctggtctggaacttctgacctggctgatattttttgaagtacaacttttttaatcttgatgaagttcagtgtatcaatatttttaataaagatttctcctagaagttttatagttttagtgattgcatttaggcctgtgatcctttttggattactttgtgtgtgttgtgtaaaggtctaagttcattttgctttgtttgtttgcttgtggtatccagttgaccctgtaccatatgttgaaaagattgtgttttcccttattgaattatctcagcacctttaaaaaatgaccataaatgtaagggtttatttctggactcttaggtctgttccattgatctgtcccatttttaatttcgtggattgtactttggtgttgtatctaaaaagtcatcaccaaatccatgcttacctagattttctcttgtattactgcttaggactttcatagttttgcattttacatttaggtctgcgatccattttgacttaatttttgtgaaaggtataaaccatatgtgcttttaaagactatatagtctgcagtcattgggtagagagttttatatatgtcagttatgttggttgatagtgttttttgagttttgtatattcttactgattttgtctttagttttatcaattgagagtgaggtactgaattattaacctgttttgttgaattgtgtatttttccttttgattctgtcagtttttccttcatttgttttgaggatatgttgctggtgtggatacatttagaattattatatcttcatgatgtaacaactttcatcattatgaaacaccgttctctaatattactctctgtctttatttctattttatctaatattaatagagccatttgtgttagtccactttgagttgctataaaggaatacccgaggctgggtaatttataaagaagagaggtttatttggctcacagttctgcaagctgtataagaagtgtggcaccagcatctgcttctggtaaggacctcagaaaactttcaatcatggaggaaggtgaaggaggagcaggcatgtcacatggtaagagagggagacagaggtgggggaggtgccacactcctttaaacaaccagttctcccataaactaatagagggagacttgctcggtactacagggaggcaccaagccattcttgagggatctgctcttatgactcatacatctcccactagaccccacctccaacattaggggccacattttaacatgagatttggaggggacaagtatccaaatgatatcactattctgtctttcttatggttctatgatggtatatatcttttttttttttttttttgagacaaagtcttgctcgacaggctgctgaagtgcagtggcgcgatctcagtttcctgcaacctctgcctcctgggttcaagtgattttcctgcctcagcctcccaagtagctgggattacaggcgcgtgccagcatgcctgtctaatttttgtatttttagtagagatagggttttgccatgttggccgggctggtttcgaactcctgacctcagatgatccacctgcctcggcctcccagagtgttgggattacaggtgtgagccaccgtgcccagtgggtatgtatctttttttatctgtttgctttcaactcttttgtgtctttgaatctaaggtgtgtcttttgtaaatagcatatagttggatcttgatgtttcatccagtctgacattctctaccttttgattgaggtataaaaaccattcacttttaatatagttattgatctggttagatttgcctttttattatttcttttctatacattcttgtctattttgtttctctgttcctccttgactgcctccttttatattaaatacatatttttagtttactgttttaactgttccattgattttttttaactatgtattttttggagttgttttcttagcagttgctgtagggattacagtgtacatgttaattatcagagtctacttcagattaatactaacttaattctggtaaaatatatatgctttgctccattatagcctcattctttcacccttttttgtgctattattctcatgtataatatctgtatatatttgtaaacccaaaacacagtgtcatagttacttccttaaggatgtttgtcttttaaagaagttaagagaaggtgtgaataaaaatatatttgtagaatcttctgtgttaactcacatatttacaatttttggtgttcctcagttcttcttggacttcaggtccccaaccgttgtcacttccttttaccctgaaaagacttttgttagtatttaatgttacaaattcactagcagattttctcagtttttgtttatctaggaatgtctttgtcttttttttttttgagggataaatttgattgaaatggaatttttggttgacaatttttttcccccagcactttatatatgccattctactctcttctagcctccattgtttcagacgagttgcttttctcttgctcatttcaggatttttttttcctttagctttccatagtttgtgataagtccaagttttgatctctttgtatttatcctacttggggcctttgagcttcttgaatgtgtggattaatatttttcatcagatttggtaagtttgtctcttctttccttctgggatttccattatgcatgtgttggcatgtttgttgttgttgcacagatctctaaggcactgttttattttctttaatcttttctctttgttctttagataatttctattttcaggttcactgattctttttcctgccatccccaaattgctattgagttgccccagtgaatttttcatttccattattatacttttcaactccaagatttctgtttggtttcttatttttaaaaattttatgtatgtatgtatttgtttgtttgttttgtagagacaaagtctcattatgttgcccggctggtctcaaactcctgggctcaagcaatgtgctgaccttggcctcccaaagtgctgggattacaggtgtgagccaccgtgcctggcctgctttttaaaatatatatataatttctgtctccttatagggaatctgaatttgtagattcattgttatatttttctttcttttattatgattttctgtagttctgtgagcttataattgctttgaaatttttgtctgctgtatctagtatcttcaatactcagaggcaatttctattgactgcatttttttcttgagtacgagtcacactcctgtttctttgtaggtcttataatttttttgttaagaactgggcattttagataatatagcagctgtggattctgatcctcccaaattgctgttgttacttttttgtctgttcattgctctttgtttagtaacatgtttgtcaaacctgtgaaatctttttcctgtggtttgtggccattaatgtctctacttttccaccccacaccctcctttttaaaagacgacaatcactttattatctctcagatttctgtgggtcagggattctggaagggctcagctgggcagttctgactttgttatgcagctgcagtcagttggtggctggagctgaaataacaggggctggagcagctgggggccgtctgggcagctctctttatttgtgtagtctcaggtcctctccatgtgtctgcttgctttttaaacttgcttatatctttacatctgctttcctaggggttgtccatatgtctgcatgggttaatagtcagttattgatcagaggttgtacttaaccaccttgatcaggaaggcttctgtcatctgtaaatggctctgcgtggcagggtagcacattcaaagttcaggccattttcaaatcttatcttttgttcactgctgaaccctttcacctctccccttggaatacacacaccctcagtgtcagctaggagcacgtgactggttgcaccctttcaggtctctgctgcaaatgcatacagccttagctaggagtaagcttgccctgaccacgaccacaacctcgtgttagtatagcttttggcactttccacttgcccatctctgagatagtcaattctactgatgacaccgctggatgtggatgctacctattgttccaaataagtcagcagccgcttcctgctaaagcaggaaagcttcctgttctcattacctgtcccattctggtacaacatctgcttcaactgaggcaggaaggttgggagaagcctcacatctcaatgacacagattctcactatttttacccaagttctttttttttttttgagatggagtcacactctgtcactcaggctagagtgcggtggcacaatctcggctcactgcaacctccaactcccaggtttaagcgattcttctgcctcagcctctgaagtagctgggactgcaggagcacaccaccatgcctggctaatttttgtatttttagtagagacggggtttcaccatattggctaggctgttctcaaactcctgacctcgtgatccgcctgcctcggcctccccaagtgttgggattacaggcgtgagccgccacacttggccaagttcattcatttttaaggcataaatgcttctcaaatttttatatgccattggttgattttccaaacctcaaaatggtttgaattatgtttgaatggtatgaattatgttcagctttatagttaccttttgcagagaggatatgttgatctcctcatttggatttatcaagaagtcccacttgtctgtccatgtggtttttttttttttggagatggagtctcactctgtcgcccaggttggagtgcagtggcgcagtcttggctcactgcaacctctgcctcctgagttcaagcgattctcgtacctcagtctcttgagtagctgcaattacaggtgtgtgccaccatgcctggctaatttttgtatttttagtagagacagcatttcgccacgttggctaggctggtcatggactccttgcctcaagtgatccacctgcctcggcctcccaaagtgctgggattacaggtgtgagccactgtgcctggccccccatttgcttttaatctagcttttaaagtagccagcatatagttgtcttgctgttttatatatgttgaaaatctgtctttttaatgatatctttaacactcttagatttagtgtaatttcagtgtggtggggttaaagtccactgttgctattttttttttttttatttgttctagttcgttctctttttttgagacaaagtcttgctttttctcccaggctctagtgcagtgttatgatcttggctcactgcaacctctacctcctgggttcaagcaattctcctactcctacctcagcctcctgagtagctggactacaggcacgtgctagttttttgtatttttcatagagacagggctccactatgttggccaggctggtctcgaactcctgacctcaagtgatccacctgcctcggcctcccaaagtgctgggattacaggtgccagccaccgtgcccggcctttgctcctgttctttattccttcctccctgcccacccatacctttttctgtctgctttaggattgagtctttttatgttccaatatttatctgcactgttgggttattatttttatgtatgaatatatgtattttttttctagagtgcagtggcacaatcatagctcactgtaaccttgaactcctgggctcaagtgatcctctagcctcagcctcctgaatagctaagactacaggcatgtaccaccatgcccagctaattaaaaaaaatactttttttagaaatgtggtcttattgtgttgttaagactggtctcaaacacctggcctcaagtcatcctcttgcctcagccccctgagtagttgggattgcaggtttgagctctcatgcctagcaagattcattatgtggttgtatcaatagtttgttccttttattgtttccttcttatggatataccatagactgtctatccatttgccagctgaaggaatcggggttgtttccagtatttggtgattataagtaaagccaacataagttttgtggcagttacaatatatgacagaattgcttcccaaaggatttaataaactaattcatagtaaaaacaatactatctgagcatttccatttcataatatcctcttcaacactgggcattacttaaggatttgttttctccaaaatggaagtatcttttattctgatcatgaaagtaacacgtgctcatgattttatgtcactcagccctctgatccgaaacctaaatatactccattttgtctcttttgttagagcatgacccccagaattggcatagtgttccaggtgtggattggatccagtgtcttttctgcatgatatattccttttaatacagcccaagtttaagtagcttttttggcagccacatgcacttgagtcatatcgaatcatctaaaactctaaagtgtttttcacatgtgctgacattaagccacacctcccccatcctgtatttctgcagatagtttttggaccttcagtgaaagactcacattcatccacagttcagtgtcacatgtagcctcagtttctagcttgttgaagccttttttgaatccccacgattaacacaccatgaggggcctcactcaagtcattaaagaatgtttaacacgacagaacctaggtcagagatccagggaaaagctcatcacagtcaacagacacagaactctttctgttaagaatacttttttattttccagtttctagttggtatttttgtgggaagtaaattgctatctcatatgcgattagtgagaactaacatttgtgattattatattaattgagactctttttggtatctgattatcagtaccatgcttattatgtatatcattaatgcagtttttattgtggtattttatcaccacaaactgtatttattactagtctatacttatttaaaacattgaagtgtttttcctgagactttaaaccacatcctaagaccacacttcccaaacatatggtagcagtgaccagagacataaaaatcacaccattgatgagagagtaatgattctaagacctgccccaaacctcaaataggatagcaatgtcatggctgctcctaatttagatgggacgaaatcaacaaaaaggaactgctggccgaggatagttaatattcaaaagcaaaagaaatgtatctgtaaataaggaagataaatctcattataatatccactgcttttttttggatgtggtcttccagcagtagtagataagtatattattaatgaaacaattgtgttagtgttccataattatacaaaaagggaaaataggacaaggcatgaataattaatgaaaggaaaccagactcttaagtggggtgggggggacatataagaaaaggtaacagccatctgtgagtctggtctgaggaccagaggatggctgacatttttggggccagatagactatctttctgctgttcttctcctttcctggcaatatactggaagagattgaaacagaacatcaaggcaaccccacacatgagatggaaattta

SEQ ID NO: 371 - DNA, 1518 bp, Homo sapiens
aactaccattaacaattgtcttgtttctgtcctgttaattttacataccccactgatgcgccaaactatgtttcccccaaatgatctatccctaacacatccctaatgactcaggccctcctttctttgccaatttgctgacgtaaacaatagagaaatgcaattaggcaagcccctctcggaagcccttctcagagttcctagatgcctctgcttttctgtgatattgtaggccaccccaccccccatccccggatggaaggcagtaaaccacccttactcttagagtggtcagctttctcttgacaccatccaccccagccccccatagtactctactgctggtgcacacgaagagtgtttcagacatgagatgtcacattgtcattgagaatggcgggaaacattattttctagttaacttctaaagcatgtaactattttagactccagtcctgacctacttttagagttttgcaagcggttccttgagagtccatgcatgtctactagatttttcttagaaaaccccccattttatctaagaaagccaaaagaataatgttctccctcaaccttccatgagttgagaacccaacatttttcacaccctgaagggactcatctgcagaagagcaaataaagcaggcaaagctttagagctaactgggcagagaatgagcatgccttcatttgtttgggctggatcgaggctggcaaggtggtccaggttggcactgcggaaaatacggcttggccccaatggtggaggagctgctgcacttttttttttccttactgggcccttattaacattataatcacagagtcagttttgtatcacagagtttgtacctccatttaagacttttctgacagccattctactttcataagttgaaattttctgttaatttgttaccgatcctcagagttaatggtcaaattgccttacagtttacaagaaacagaagggaaacatcagtgtgcaaacactgggaaatactttcaagcccttttgaaggaagaaaatataatttacagtgattttctaagttaactcattcatagctgtgtatgataggaaaggggaagcacgaccattgccatttacagaaggggaaatagaaacacagattaaagaactggccaaggtcacacagaagtcagggacggtgccaagaatagaacttgcttccttgattcccaattctctatccttgggaggatgtagtagatattttacagatacatatatagatccaataagtaatcaccaaatatgtttaatcttgtataatgcaaacataaatgctaaagacaagtggtattacctttatgttttacacgtggttggtgcctaataaatatttgtgtgatgagcagatggttgacagtatatttagattgaatatcagtgacgtgccaagttgctttgtaagatgtcagcaatattaatgcaatgtagacagaaatgtttctctacatattttgactagttatcacagatagcttata

SEQ ID NO: 372 - DNA, 2681 bp, Homo sapiens
aactaccattaacaattgtcttgtttctgtcctgttaattttacataccccactgatgcgccaaactatgtttcccccaaatgatctatccctaacacatccctaatgactcaggccctcctttctttgccaatttgctgacgtaaacaatagagaaatgcaattaggcaagcccctctcggaagcccttctcagagttcctagatgcctctgcttttctgtgatattgtaggccaccccaccccccatccccggatggaaggcagtaaaccacccttactcttagagtggtcagctttctcttgacaccatccaccccagccccccatagtactctactgctggtgcacacgaagagtgtttcagacatgagatgtcacattgtcattgagaatggcgggaaacattattttctagttaacttctaaagcatgtaactattttagactccagtcctgacctacttttagagttttgcaagcggttccttgagagtccatgcatgtctactagatttttcttagaaaaccccccattttatctaagaaagccaaaagaataatgttctccctcaaccttccatgagttgagaacccaacatttttcacaccctgaagggactcatctgcagaagagcaaataaagcaggcaaagctttagagctaactgggcagagaatgagcatgccttcatttgtttgggctggatcgaggctggcaaggtggtccaggttggcactgcggaaaatacggcttggccccaatggtggaggagctgctgcacttttttttttccttactgggcccttattaacattataatcacagagtcagttttgtatcacagagtttgtacctccatttaagacttttctgacagccattctactttcataagttgaaattttctgttaatttgttaccgatcctcagagttaatggtcaaattgccttacagtttacaagaaacagaagggaaacatcagtgtgcaaacactgggaaatactttcaagcccttttgaaggaagaaaatataatttacagtgattttctaagttaactcattcatagctgtgtatgataggaaaggggaagcacgaccattgccatttacagaaggggaaatagaaacacagattaaagaactggccaaggtcacacagaagtcagggacggtgccaagaatagaacttgcttccttgattcccaattctctatccttgggaggatgtagtagatattttacagatacatatatagatccaataagtaatcaccaaatatgtttaatcttgtataatgcaaacataaatgctaaagacaagtggtattacctttatgttttacacgtggttggtgcctaataaatatttgtgtgatgagcagatggttgacagtatatttagattgaatatcagtgacgtgccaagttgctttgtaagatgtcagcaatattaatgcaatgtagacagaaatgtttctctacatattttgactagttatcacagatagcttataaagaaaacgagttttttcacaaagaacccgatgttacctaagtttttttcccatgagtggggaataacttagtacgtggtacaactctgtctattataatcaatcagtgttacttcttcctttgaaactatgatttgtgataattatatagggagagagaattaaactggactgtgatctaaagaatgtgtgctctcaaaacaaaactgcagtaatcaaaggctgcaggcattgaacctccctagaataaagacccaaacacattcaacattttagaaacagatctttgttttagaaagaagaaaagacaatccagaaacaaccaggtggactctagacacccatggaggaggtgatcagagctcatgagagtaccaggaaggagatcagcagaagccccccaccatcccgtttgtggggaacagatgagcgcaaagacccattcaggccacacaattgtccagtcagctacccgagggtctccttggtattcaagcacacgtaaagaaaagtagactttcaacatcttagattcttcctgagaaaacagtgatctgcagcacaaactgattatgccaagactgtccttgccctatcctctcctgggttcctgaaatccaccctttccattccacagagaaggtccccttccctccagtcctgtattattattgttcctttagaaaccaaccaacctccttgccatggacaatcttatctaaatagtatctcctgtgaggctgcatcagtactctggcagagttcatggaggactgtaagatcaagcggagctcagtccttggggggtttactcgtactacttagttgttcaaaatgcaggcggaacgtgaagttctagaaattgaaagtggactggctgagcaggcatcagctcccccacatgcccagtcagcccaccccagcctcagccaacccacagggcagaaccacttcctctcatgacaggaaaccaatgaatggggcaggccacacgaactgggagaattacttcattccctcatgacacccttccatttactcttccttttacttttgtctaactcttctgtagttccttaatttttcttcttctgaaaagtcatattttcctgaattccacagccaccctccaccccagacctactaaattactattcttaaag

SEQ ID NO: 373 - DNA, 6496 bp, Homo sapiens
atctcaccaaaataaatatatttaccagaagagtcacagcagaatatcttgaaataagataataactgccattcaacagctgcatcatctacattaggtgtttctcctaatgctatcctcccctggccccccacccccagagaggccccggtgtgtgatgttcccctccctgtgcccatatgttctcattattcaactcccacttatgagtgagaacatgcggtgtttggttttctgttcctgtgttagtttgctgagaatgatggtttccagcttcatccatgtaccttgcaaaggacatgaactcattcttttttatggctgcctagtattccatggtgtgtatgtgccacattttctttatgcagtctgacattgatgggcatttgggttggttccaagtctttactatcatgaacagtgccgcaataaatatacatgtgcatgtgtctttatagtagaatgatttataatcctttgggtatatacccagtaatgggatggctgggtcaaatggtatttctagttctagatgcttgaggaatcgccacactgtcttccacaatggttgaactaacttacactcccactaacagtgtaaagcgttcctatttcttcacatcctctgcagcatctgtagtttcctgactttttaatgatcaccattctgactggcgtgagatggtatctcattgtggttttgatttgcatttctctaatgaccagtgatggtgagctttttttcatatgtttgttggctgcataaatgtcttcttttgagaagtgtctgttcatatccttcgcccactttttgttggggttgtttgcttttttcttgtaaatttaagttgcttgtagattgtggatattagccctttgtcagatggatagattgcaaaaattttctcccattctgtaggttgcctgttcactctgatggtagtttcttttgctgtgcagaagctcttcagtttaattatatctcatgtgtcaattttggcttttgttgccattgcttttgttgttttagtcatgaagtctttgcctatgcctgtgtcctgaatggtattgcctaggttttcttgtagggtttttatggttttagttcttatatttaaatccttaatccatcttgagttgatttttgtataaggtgcagggaaggggtccagtttcagttctctgcataaggctagccatttttccgaacgcaatttattaaatagggaatcctttccccattggttgtttttgtcaggtttgtcaaagatcagttggttgtagatgtgttgtgttatttctgaggcctctgttttgttccattgttctatatgtctgtttttgtaccagtaccatgctgttttggctactgtagccttgtagtatagcttgaagtcaggtggtgtgatgtctccagctttgtattttttgcttaggattgtcttggatatatgggcttttttttgcttctatatgaaatttaaagtagttttttctaattctttgaagaaagtcagtggtagcttgatgggaatagcattgaatctataaattactttgggtagtatggccattttcacgatattgattcttcatatccatgagcatggaatgtttcttcttttgtttgtgtcctctcttatttccttgagcagtggtttgtagttctccttgaagaggtccttcacatcccttgtaagttgtattcctagatattttattctctttgtagtaattgcgaatgggagtttggtcatgatttggctctctgttattggtatataggaatgcttgtgatttttgcacattgattttgtatcctgagactttgctgaagttgcttattagcttaaggagtgtttgggctgagatgatggggttttctaaatatacaatcatgtcatctgcaaacagagacaacttgacttcctctcttcctatatgaataccctttatttatttctcttgcctgattgccctggccagaacttccaatactatgttgaataggggtggtgagagagggcatccttgtcttgtgctggttttcaaagggaattcttccagcttttgcccattcagtatgatattgcctgtgagtttgtcataaatagctcttattattttgagatatgttccatcactacctagtttattgagtttttttttttttttttagcatgaaggggtgttggattttatcaaaggccttttctgcatctattgagataatcatgtggtttttgtcattggttctgtttatgtgatgaattacgtttactaatttgcatatgttgaaccagccttgcatcccagggatgaagccaacttgatcgtggtgggtaagctttttaatgtgctgcttgatttggtttgccagtattttattgaggatttttgcatcaatgttcatcagagatattggcctgaaattttctttttttgttgtgtctctgccaggttttggtatcaggatgatgctgacctcataaaatgagctagggaggattccctctttttctgttgattggaatagtttcagaaggaatggtaccagctcctccttgtacctctggtagaatttggctgtgaatccatctggtcctggacttttttggttggtaggctattaattactacgtcaatttcagaacttgttactgatctattcaggaatttgacttcttcctggtttagtcttgtgagggtgtgtgtgtccaggaatttatccatttcttctagattttctagtttgttcacatggagttctttatagtattctctgatggtagtttgtatttctgtgggatcagtggtgatatcccctttatcatttttccttgcatctatttgattcttctctcttttcttccttattagtctggctagtggtctatttattttgttaatcttttcagaacaccagctcatggattttttgaagggttttttgtgtctttatctccttcagttctgccctcatcttagttatttcttgtcttctgctagatttttactttgtttgctcttacttctgtagttcttttaattgtgatgtttgggtgttgattttagatttttcccgcttgatctcctgtgggtattttagtgctgtaaatttccctctaaacactgctttagctgtgtcccagagattctggtatgttgtgtctttgttctcattggtttcaaataacttatttatttctgccttaattttgttatttacctagtagtcattcaggagcaggttgttcagtttccatgtagctgtgcggttttgagtgaatttcttaatcctgagttctaatttgattgcactgtggtgtgagggactgttatgatttccatccttttgcatttgctgaggagtgatttacttccaattatgtggttgattttagaataagtgctatgtggcactgagaaaaatgtatattttgttgatttggggtggagagttctgtagttgtctgttaggtccgcttggtccagagctgaattcaagtcctgaatattgttaattttctgtctcgttgatctgtctaatattgacagtggggtgtcaaagtctcccactattattgtgtgggagtctaagtctctttgtaggtctctaagaacttgctttatgaatctgcatgctcatgtattgggtgcatatataattagggtagttagctcttggtgttgcattgatccctttaccattatgtaatgcccttctttgactttttgatctttgttggtttcaagtcttttttatcagagactaggattacaaccctgcttttttttgctttccatttgcttggtaaatcttcctccatccctttattttgagcctatgtgtgtctatgcacatgagatgggtctcctgaatacagtacaccgatgggtcttgactctttatccaatttgccattctctgtcttttaattggggcatttagcccatttacatttaaggttaatattgttatgtgtgaatttgatcctgttattatgatgctagctggttattttgcccattagttgatgcagtttcttcatcacgttgatggtcttttacgttttgttgtgtttttgcagtggctggtagcggtttttcccttccatatttagtgcttccttcaggagcccttgtaaggcaggcctggtggagccaaaatccctaagcatttgcttttctgtaaaggattttatttttcctttacttataaagcttagtttggctggatatgaaattctgggttgaaaattctttaagaatattgcatattggcccccattctcttctggcttgtagggtttctgcagagagatccgctgttagtctgatgggcttccctttgtggttaacctgacctttctctctggctgcccttaacgttttttccttcatttcaatgttgctgaatctgacgattatgtatcttggggttgttcttctagaagagtgtctttgtatttcgtgaatttgaatgttggcctatcttgctaggttggggaagttctcctggctaatatcctgaagagagttttccaacttgattccattctcccgatcactttcaggtacaccaatcaaatataggtttggtcttttcacatagtcccatatttcttggaggctttgttcattccattttattcttgtttctctaatcttgtcttcacgctttattttagtaagttagtgttcaatctctgatatcctttcttccgactgatcaatttggctatattgatacttgtgtatgcttcatgaagttctcgtgttgtgttttttggctgcatcaggtcatttatgttcttctcgaaattggtttttccagtttgcaattcctctaaccttttatcaatgttcttagcttccttgcattaggttagaatatgctcctttagcttggcggagtttattactcaccttctgaagcctacttctgtccatttgtcgaactcattgtctgtccagttttgttcccttgctgccaaggagttgtgatcctttgaaagacgaggcatcctggtttttggaatttttagcctttttgcctggtttttcctcatcttcctggatttatttaccattggtctttgctgttgatgaccttcggatggagtttttgcttggtccttcacggcacagtccctcatggcttctcttggctaggggaggaaatttcctgaacgcttgtgcttcccaggtgaggtgacgcccaccctgcttctgcttgcagtccgtggactgcacccgctctctaaccagtcccagtgagatgaaccaggtacctcagttggaaatgaagacatcacccgccttctgctttggcctcactgggagctgaagaccggagctgttcctatttcgacgtcttgcctgggaatcaacaatttcttgtgatctatcttcaggtttactgactctttccttgtcatctccattctgttattaagcttatctagtaaaagttttattttagatatatttttcaggtctaaaattaccatttggttcctttttataatttgatttatctgctgagttttttatctttttattcattataagcattttttttaaaccattgagtatattagttttataataactgctttaaagtcattgtatggtaattctaacatcagggtcatcttgaggttggcctctagtgatgatattttcccttaaggatgggtcacattctctttcttgatgagtttgtattggatactagacattgtggcaattctggattctattctattcctctaagagtgttactggtcttgctgtagaagaccattaacttggatgggctcagactgcagccttttcccttctgtggtggggaacagctcaaatattagttcagttatttttgccttagctgaaaactgcttaaatttgccatacacatgtgttgctctggagtcagccatagacttgggcagagattgtacccagaatattgggctctacctttgcggctttctcctttctaggatatcccaatcccattgcctcaggcttgggctctgtgtacttgttcttcaggcaagaaagttttatcgagttttgactgctgtgtgctgcaactcactgtggtcttctatcaggctaaaacataaaaatggaaaactcaccccatacccggttgttactcctttcttcttccaagctctctcttcttttctaagtcctcctgcttttgttgatgcttaagcgcttcaggcagttatttttttgcatattgtctggagtttatacttatgtgtaggagagtcagtctgaatttactctaccatactagaaatggaacctggtctccgtacttttcaatcatttgtgagcttctaaattgataccttcatagaagagatatggtccattctacagagtatctccaaataatgaacctgatccctgtggtttgacagagggccaacctgtgtcaactataatctcaatgtcatagacaagggtaattcta

SEQ ID NO: 374 - DNA, 6370 bp, Homo sapiens
atctcaccaaaataaatatatttaccagaagagtcacagcagaatatcttgaaataagataataactgccattcaacagctgcatcatctacattaggtgtttctcctaatgctatcctcccctggccccccacccccagagaggccccggtgtgtgatgttcccctccctgtgcccatatgttctcattattcaactcccacttatgagtgagaacatgcggtgtttggttttctgttcctgtgttagtttgctgagaatgatggtttccagcttcatccatgtaccttgcaaaggacatgaactcattcttttttatggctgcctagtattccatggtgtgtatgtgccacattttctttatgcagtctgacattgatgggcatttgggttggttccaagtctttactatcatgaacagtgccgcaataaatatacatgtgcatgtgtctttatagtagaatgatttataatcctttgggtatatacccagtaatgggatggctgggtcaaatggtatttctagttctagatgcttgaggaatcgccacactgtcttccacaatggttgaactaacttacactcccactaacagtgtaaagcgttcctatttcttcacatcctctgcagcatctgtagtttcctgactttttaatgatcaccattctgactggcgtgagatggtatctcattgtggttttgatttgcatttctctaatgaccagtgatggtgagctttttttcatatgtttgttggctgcataaatgtcttcttttgagaagtgtctgttcatatccttcgcccactttttgttggggttgtttgcttttttcttgtaaatttaagttgcttgtagattgtggatattagccctttgtcagatggatagattgcaaaaattttctcccattctgtaggttgcctgttcactctgatggtagtttcttttgctgtgcagaagctcttcagtttaattatatctcatgtgtcaattttggcttttgttgccattgcttttgttgttttagtcatgaagtctttgcctatgcctgtgtcctgaatggtattgcctaggttttcttgtagggtttttatggttttagttcttatatttaaatccttaatccatcttgagttgatttttgtataaggtgcagggaaggggtccagtttcagttctctgcataaggctagccatttttccgaacgcaatttattaaatagggaatcctttccccattggttgtttttgtcaggtttgtcaaagatcagttggttgtagatgtgttgtgttatttctgaggcctctgttttgttccattgttctatatgtctgtttttgtaccagtaccatgctgttttggctactgtagccttgtagtatagcttgaagtcaggtggtgtgatgtctccagctttgtattttttgcttaggattgtcttggatatatgggcttttttttgcttctatatgaaatttaaagtagttttttctaattctttgaagaaagtcagtggtagcttgatgggaatagcattgaatctataaattactttgggtagtatggccattttcacgatattgattcttcatatccatgagcatggaatgtttcttcttttgtttgtgtcctctcttatttccttgagcagtggtttgtagttctccttgaagaggtccttcacatcccttgtaagttgtattcctagatattttattctctttgtagtaattgcgaatgggagtttggtcatgatttggctctctgttattggtatataggaatgcttgtgatttttgcacattgattttgtatcctgagactttgctgaagttgcttattagcttaaggagtgtttgggctgagatgatggggttttctaaatatacaatcatgtcatctgcaaacagagacaacttgacttcctctcttcctatatgaataccctttatttatttctcttgcctgattgccctggccagaacttccaatactatgttgaataggggtggtgagagagggcatccttgtcttgtgctggttttcaaagggaattcttccagcttttgcccattcagtatgatattgcctgtgagtttgtcataaatagctcttattattttgagatatgttccatcactacctagtttattgagtttttttttttttttttagcatgaaggggtgttggattttatcaaaggccttttctgcatctattgagataatcatgtggtttttgtcattggttctgtttatgtgatgaattacgtttactaatttgcatatgttgaaccagccttgcatcccagggatgaagccaacttgatcgtggtgggtaagctttttaatgtgctgcttgatttggtttgccagtattttattgaggatttttgcatcaatgttcatcagagatattggcctgaaattttctttttttgttgtgtctctgccaggttttggtatcaggatgatgctgacctcataaaatgagctagggaggattccctctttttctgttgattggaatagtttcagaaggaatggtaccagctcctccttgtacctctggtagaatttggctgtgaatccatctggtcctggacttttttggttggtaggctattaattactacgtcaatttcagaacttgttactgatctattcaggaatttgacttcttcctggtttagtcttgtgagggtgtgtgtgtccaggaatttatccatttcttctagattttctagtttgttcacatggagttctttatagtattctctgatggtagtttgtatttctgtgggatcagtggtgatatcccctttatcatttttccttgcatctatttgattcttctctcttttcttccttattagtctggctagtggtctatttattttgttaatcttttcagaacaccagctcatggattttttgaagggttttttgtgtctttatctccttcagttctgccctcatcttagttatttcttgtcttctgctagatttttactttgtttgctcttacttctgtagttcttttaattgtgatgtttgggtgttgattttagatttttcccgcttgatctcctgtgggtattttagtgctgtaaatttccctctaaacactgctttagctgtgtcccagagattctggtatgttgtgtctttgttctcattggtttcaaataacttatttatttctgccttaattttgttatttacctagtagtcattcaggagcaggttgttcagtttccatgtagctgtgcggttttgagtgaatttcttaatcctgagttctaatttgattgcactgtggtgtgagggactgttatgatttccatccttttgcatttgctgaggagtgatttacttccaattatgtggttgattttagaataagtgctatgtggcactgagaaaaatgtatattttgttgatttggggtggagagttctgtagttgtctgttaggtccgcttggtccagagctgaattcaagtcctgaatattgttaattttctgtctcgttgatctgtctaatattgacagtggggtgtcaaagtctcccactattattgtgtgggagtctaagtctctttgtaggtctctaagaacttgctttatgaatctgcatgctcatgtattgggtgcatatataattagggtagttagctcttggtgttgcattgatccctttaccattatgtaatgcccttctttgactttttgatctttgttggtttcaagtcttttttatcagagactaggattacaaccctgcttttttttgctttccatttgcttggtaaatcttcctccatccctttattttgagcctatgtgtgtctatgcacatgagatgggtctcctgaatacagtacaccgatgggtcttgactctttatccaatttgccattctctgtcttttaattggggcatttagcccatttacatttaaggttaatattgttatgtgtgaatttgatcctgttattatgatgctagctggttattttgcccattagttgatgcagtttcttcatcacgttgatggtcttttacgttttgttgtgtttttgcagtggctggtagcggtttttcccttccatatttagtgcttccttcaggagcccttgtaaggcaggcctggtggagccaaaatccctaagcatttgcttttctgtaaaggattttatttttcctttacttataaagcttagtttggctggatatgaaattctgggttgaaaattctttaagaatattgcatattggcccccattctcttctggcttgtagggtttctgcagagagatccgctgttagtctgatgggcttccctttgtggttaacctgacctttctctctggctgcccttaacgttttttccttcatttcaatgttgctgaatctgacgattatgtatcttggggttgttcttctagaagagtgtctttgtatttcgtgaatttgaatgttggcctatcttgctaggttggggaagttctcctggctaatatcctgaagagagttttccaacttgattccattctcccgatcactttcaggtacaccaatcaaatataggtttggtcttttcacatagtcccatatttcttggaggctttgttcattccattttattcttgtttctctaatcttgtcttcacgctttattttagtaagttagtgttcaatctctgatatcctttcttccgactgatcaatttggctatattgatacttgtgtatgcttcatgaagttctcgtgttgtgttttttggctgcatcaggtcatttatgttcttctcgaaattggtttttccagtttgcaattcctctaaccttttatcaatgttcttagcttccttgcattaggttagaatatgctcctttagcttggcggagtttattactcaccttctgaagcctacttctgtccatttgtcgaactcattgtctgtccagttttgttcccttgctgccaaggagttgtgatcctttgaaagacgaggcatcctggtttttggaatttttagcctttttgcctggtttttcctcatcttcctggatttatttaccattggtctttgctgttgatgaccttcggatggagtttttgcttggtccttcacggcacagtccctcatggcttctcttggctaggggaggaaatttcctgaacgcttgtgcttcccaggtgaggtgacgcccaccctgcttctgcttgcagtccgtggactgcacccgctctctaaccagtcccagtgagatgaaccaggtacctcagttggaaatgaagacatcacccgccttctgctttggcctcactgggagctgaagaccggagctgttcctatttcgacgtcttgcctgggaatcaacaatttcttgtgatctatcttcaggtttactgactctttccttgtcatctccattctgttattaagcttatctagtaaaagttttattttagatatatttttcaggtctaaaattaccatttggttcctttttataatttgatttatctgctgagttttttatctttttattcattataagcattttttttaaaccattgagtatattagttttataataactgctttaaagtcattgtatggtaattctaacatcagggtcatcttgaggttggcctctagtgatgatattttcccttaaggatgggtcacattctctttcttgatgagtttgtattggatactagacattgtggcaattctggattctattctattcctctaagagtgttactggtcttgctgtagaagaccattaacttggatgggctcagactgcagccttttcccttctgtggtggggaacagctcaaatattagttcagttatttttgccttagctgaaaactgcttaaatttgccatacacatgtgttgctctggagtcagccatagacttgggcagagattgtacccagaatattgggctctacctttgcggctttctcctttctaggatatcccaatcccattgcctcaggcttgggctctgtgtacttgttcttcaggcaagaaagttttatcgagttttgactgctgtgtgctgcaactcactgtggtcttctatcaggctaaaacataaaaatggaaaactcaccccatacccggttgttactcctttcttcttccaagctctctcttcttttctaagtcctcctgcttttgttgatgcttaagcgcttcaggcagttatttttttgcatattgtctggagtttatacttatgtgtaggagagtcagtctgaatttactctaccatactagaaatggaacctggtctccgtacttttcaatcatttgtgagcttctaaattgata

SEQ ID NO: 375 - DNA, 8036 bp, Homo sapiens
atctcaccaaaataaatatatttaccagaagagtcacagcagaatatcttgaaataagataataactgccattcaacagctgcatcatctacattaggtgtttctcctaatgctatcctcccctggccccccacccccagagaggccccggtgtgtgatgttcccctccctgtgcccatatgttctcattattcaactcccacttatgagtgagaacatgcggtgtttggttttctgttcctgtgttagtttgctgagaatgatggtttccagcttcatccatgtaccttgcaaaggacatgaactcattcttttttatggctgcctagtattccatggtgtgtatgtgccacattttctttatgcagtctgacattgatgggcatttgggttggttccaagtctttactatcatgaacagtgccgcaataaatatacatgtgcatgtgtctttatagtagaatgatttataatcctttgggtatatacccagtaatgggatggctgggtcaaatggtatttctagttctagatgcttgaggaatcgccacactgtcttccacaatggttgaactaacttacactcccactaacagtgtaaagcgttcctatttcttcacatcctctgcagcatctgtagtttcctgactttttaatgatcaccattctgactggcgtgagatggtatctcattgtggttttgatttgcatttctctaatgaccagtgatggtgagctttttttcatatgtttgttggctgcataaatgtcttcttttgagaagtgtctgttcatatccttcgcccactttttgttggggttgtttgcttttttcttgtaaatttaagttgcttgtagattgtggatattagccctttgtcagatggatagattgcaaaaattttctcccattctgtaggttgcctgttcactctgatggtagtttcttttgctgtgcagaagctcttcagtttaattatatctcatgtgtcaattttggcttttgttgccattgcttttgttgttttagtcatgaagtctttgcctatgcctgtgtcctgaatggtattgcctaggttttcttgtagggtttttatggttttagttcttatatttaaatccttaatccatcttgagttgatttttgtataaggtgcagggaaggggtccagtttcagttctctgcataaggctagccatttttccgaacgcaatttattaaatagggaatcctttccccattggttgtttttgtcaggtttgtcaaagatcagttggttgtagatgtgttgtgttatttctgaggcctctgttttgttccattgttctatatgtctgtttttgtaccagtaccatgctgttttggctactgtagccttgtagtatagcttgaagtcaggtggtgtgatgtctccagctttgtattttttgcttaggattgtcttggatatatgggcttttttttgcttctatatgaaatttaaagtagttttttctaattctttgaagaaagtcagtggtagcttgatgggaatagcattgaatctataaattactttgggtagtatggccattttcacgatattgattcttcatatccatgagcatggaatgtttcttcttttgtttgtgtcctctcttatttccttgagcagtggtttgtagttctccttgaagaggtccttcacatcccttgtaagttgtattcctagatattttattctctttgtagtaattgcgaatgggagtttggtcatgatttggctctctgttattggtatataggaatgcttgtgatttttgcacattgattttgtatcctgagactttgctgaagttgcttattagcttaaggagtgtttgggctgagatgatggggttttctaaatatacaatcatgtcatctgcaaacagagacaacttgacttcctctcttcctatatgaataccctttatttatttctcttgcctgattgccctggccagaacttccaatactatgttgaataggggtggtgagagagggcatccttgtcttgtgctggttttcaaagggaattcttccagcttttgcccattcagtatgatattgcctgtgagtttgtcataaatagctcttattattttgagatatgttccatcactacctagtttattgagtttttttttttttttttagcatgaaggggtgttggattttatcaaaggccttttctgcatctattgagataatcatgtggtttttgtcattggttctgtttatgtgatgaattacgtttactaatttgcatatgttgaaccagccttgcatcccagggatgaagccaacttgatcgtggtgggtaagctttttaatgtgctgcttgatttggtttgccagtattttattgaggatttttgcatcaatgttcatcagagatattggcctgaaattttctttttttgttgtgtctctgccaggttttggtatcaggatgatgctgacctcataaaatgagctagggaggattccctctttttctgttgattggaatagtttcagaaggaatggtaccagctcctccttgtacctctggtagaatttggctgtgaatccatctggtcctggacttttttggttggtaggctattaattactacgtcaatttcagaacttgttactgatctattcaggaatttgacttcttcctggtttagtcttgtgagggtgtgtgtgtccaggaatttatccatttcttctagattttctagtttgttcacatggagttctttatagtattctctgatggtagtttgtatttctgtgggatcagtggtgatatcccctttatcatttttccttgcatctatttgattcttctctcttttcttccttattagtctggctagtggtctatttattttgttaatcttttcagaacaccagctcatggattttttgaagggttttttgtgtctttatctccttcagttctgccctcatcttagttatttcttgtcttctgctagatttttactttgtttgctcttacttctgtagttcttttaattgtgatgtttgggtgttgattttagatttttcccgcttgatctcctgtgggtattttagtgctgtaaatttccctctaaacactgctttagctgtgtcccagagattctggtatgttgtgtctttgttctcattggtttcaaataacttatttatttctgccttaattttgttatttacctagtagtcattcaggagcaggttgttcagtttccatgtagctgtgcggttttgagtgaatttcttaatcctgagttctaatttgattgcactgtggtgtgagggactgttatgatttccatccttttgcatttgctgaggagtgatttacttccaattatgtggttgattttagaataagtgctatgtggcactgagaaaaatgtatattttgttgatttggggtggagagttctgtagttgtctgttaggtccgcttggtccagagctgaattcaagtcctgaatattgttaattttctgtctcgttgatctgtctaatattgacagtggggtgtcaaagtctcccactattattgtgtgggagtctaagtctctttgtaggtctctaagaacttgctttatgaatctgcatgctcatgtattgggtgcatatataattagggtagttagctcttggtgttgcattgatccctttaccattatgtaatgcccttctttgactttttgatctttgttggtttcaagtcttttttatcagagactaggattacaaccctgcttttttttgctttccatttgcttggtaaatcttcctccatccctttattttgagcctatgtgtgtctatgcacatgagatgggtctcctgaatacagtacaccgatgggtcttgactctttatccaatttgccattctctgtcttttaattggggcatttagcccatttacatttaaggttaatattgttatgtgtgaatttgatcctgttattatgatgctagctggttattttgcccattagttgatgcagtttcttcatcacgttgatggtcttttacgttttgttgtgtttttgcagtggctggtagcggtttttcccttccatatttagtgcttccttcaggagcccttgtaaggcaggcctggtggagccaaaatccctaagcatttgcttttctgtaaaggattttatttttcctttacttataaagcttagtttggctggatatgaaattctgggttgaaaattctttaagaatattgcatattggcccccattctcttctggcttgtagggtttctgcagagagatccgctgttagtctgatgggcttccctttgtggttaacctgacctttctctctggctgcccttaacgttttttccttcatttcaatgttgctgaatctgacgattatgtatcttggggttgttcttctagaagagtgtctttgtatttcgtgaatttgaatgttggcctatcttgctaggttggggaagttctcctggctaatatcctgaagagagttttccaacttgattccattctcccgatcactttcaggtacaccaatcaaatataggtttggtcttttcacatagtcccatatttcttggaggctttgttcattccattttattcttgtttctctaatcttgtcttcacgctttattttagtaagttagtgttcaatctctgatatcctttcttccgactgatcaatttggctatattgatacttgtgtatgcttcatgaagttctcgtgttgtgttttttggctgcatcaggtcatttatgttcttctcgaaattggtttttccagtttgcaattcctctaaccttttatcaatgttcttagcttccttgcattaggttagaatatgctcctttagcttggcggagtttattactcaccttctgaagcctacttctgtccatttgtcgaactcattgtctgtccagttttgttcccttgctgccaaggagttgtgatcctttgaaagacgaggcatcctggtttttggaatttttagcctttttgcctggtttttcctcatcttcctggatttatttaccattggtctttgctgttgatgaccttcggatggagtttttgcttggtccttcacggcacagtccctcatggcttctcttggctaggggaggaaatttcctgaacgcttgtgcttcccaggtgaggtgacgcccaccctgcttctgcttgcagtccgtggactgcacccgctctctaaccagtcccagtgagatgaaccaggtacctcagttggaaatgaagacatcacccgccttctgctttggcctcactgggagctgaagaccggagctgttcctatttcgacgtcttgcctgggaatcaacaatttcttgtgatctatcttcaggtttactgactctttccttgtcatctccattctgttattaagcttatctagtaaaagttttattttagatatatttttcaggtctaaaattaccatttggttcctttttataatttgatttatctgctgagttttttatctttttattcattataagcattttttttaaaccattgagtatattagttttataataactgctttaaagtcattgtatggtaattctaacatcagggtcatcttgaggttggcctctagtgatgatattttcccttaaggatgggtcacattctctttcttgatgagtttgtattggatactagacattgtggcaattctggattctattctattcctctaagagtgttactggtcttgctgtagaagaccattaacttggatgggctcagactgcagccttttcccttctgtggtggggaacagctcaaatattagttcagttatttttgccttagctgaaaactgcttaaatttgccatacacatgtgttgctctggagtcagccatagacttgggcagagattgtacccagaatattgggctctacctttgcggctttctcctttctaggatatcccaatcccattgcctcaggcttgggctctgtgtacttgttcttcaggcaagaaagttttatcgagttttgactgctgtgtgctgcaactcactgtggtcttctatcaggctaaaacataaaaatggaaaactcaccccatacccggttgttactcctttcttcttccaagctctctcttcttttctaagtcctcctgcttttgttgatgcttaagcgcttcaggcagttatttttttgcatattgtctggagtttatacttatgtgtaggagagtcagtctgaatttactctaccatactagaaatggaacctggtctccgtacttttcaatcatttgtgagcttctaaattgataccttcatagaagagatatggtccattctacagagtatctccaaataatgaacctgatccctgtggtttgacagagggccaacctgtgtcaactataatctcaatgtcatagacaagggtaattctacagacacagtaaaggaattttcagtattgttccaaaatttatgatgagtgagaagggctaaatgactcctgaggctctagcatgaattagagtaatgctgataaatgtatttctcagttagcttcattcctacctaaagttaaaaaatattctatgtttgctcttggtatattggtacatgccatttaaatagtcactgaacaggccgggtgtggtggctcatgcctgtgatcccagcactttgggaggccaaggcaggtggatcacctgaggccaggagttcaagaccagcctggctaacatggcaaaaccctgttcctacaaaaaatacaaaaattagctgggtgtggtggcaggcgcctgtaatctcagctactcgggaggctgaggcaggagaattgcttgaacctgggagacagaggttgcagtgagccgagattgcgccactgcactctagtctggcaacagagagagactctctcaaaaaaaaaataaaaaaatggtcactgaacagatttcagggttcttttcttttatgttgtgtttcagttaacgaaatgataatgaatgaggggacttaggctttttttttttgaagtggagtttcacctttgtcatccaggctggggtgcaatggtgccatctcagctcactgcaacctctgcctcccgggttcaagcgattctcctgcctcatcctcccgagtacccgggattacagggcatgtgccaccatgcccagctaatatttgtatttttagtagagacggggtttcaccatgttggccaggcttgtctcgaactcctgacctcaggtgatccacctgccttggcctcccaaagtgctgtgattacaggtgtgagccaccacacctggcctaggctttttaaaccttatcattgctattacttttttgtgtaaccttgagcaataaattttacctgtcatggttttctctctttcaaaatatggtcttctggctgggtgcagtggctcatgcctgtaatcctagcactttgggaggatgaggtaggaggattgcttgaggccaggagttctggagcaagctggccaaaatagtgagattctgtctccacaaaaaaacaaacaaaatagtgacttctgtaaaacagagatggtgatattctaaagtaatctgcctctcttttatgtaaggttgacttattgggactcatgaagagtccttctcactaataattgtctttaagatttttcttaaattttaaaatattttagtttaaaatacttatgttaaaaaaatatgacaactaaaataactaagtttctgaagaatatggattctgcatttgagattatctgtcatttagtctgttaggcataatttataaaatgtatatattttcttaacatgtttctacttggaagaagtgttttagatttccattgacttaagatgagttagcagaaatgattttaaatagttccatatttacaaggaatcatttatttttgcaccgttaaatactttgaaaaaggagaaaactttacttagcttata

SEQ ID NO: 376 - DNA, 1366 bp, Homo sapiens
acggttataacttgttgatgtctatattggcttaattcaaatgaaaagttcactccaggagcagctctttgtaatccacaccaccccccagactcttctgaataaacccagaacaactcatacaccagcctaagcatggtctatttttctgggatgggacagaacataattgtattaaaatataaaatcagttttaaaaggtctggaaggacatatcttaaggccatgatagtagttacagctggggtgctggggaggggacctcaactggggttggtggcaaaaatggactttagctttgtctttaacatcctggtcctaaaaagaagactagatttacctattatatatgcaatctaaaattaattcaaaaagtcatcagcgaggacccccctaagattctgggtggtaagtccaccaaaggccaagagctaaaacaaaagccttttccacatgttctgagaagttggcccaaaactgctgaatctataggtcttagcatgctctatctatgtactgggaagcctaaaataaccttttagagatgagacctagagttctgggaggagccaattaacacgaaaacagggctgagttcaggtactgaactcaagaactcattagacatgcaagaagaaaaagcaagtctggccagccatggtggtttatgcctgtaatcccaacactttgggaggctgaggcaggggaatcacctgaggtcaggagtttgagaccagcctggccaatgtggtgaaacccggtatctactaaaaatacaggaaaactagccaggcatggtggtgtgcacctgtaatcccagctactagggaggctgaggcaagagaatcacttgaacccaggagtggaagttgcagtgagccgatattgcatcactgtaccccagcctgggcgacagagtgggactctgactcaaaaaaaagaggaaatcaggcaaggccacagcagcatccaatgccagaagacaatgaagtggcgcatacagagtacactggggtacaaagtgcgactccagtgcgtggggccggtccagacaccagccaggcaccaaggcaacaagcagcttcctcccagacacacaagcccttctcaagaaatgaaacccagctcataaagaaacccaggactcaggaacgaaggacatgtaggcaaaggcctgagtgtttcttacagaatactaaatgcccacaagaattagagccacagaacaaatatgaatgtcagaaagcaatacgttgcaaaaacaatcatatatccgaaattgggaggagcttcggagtgtcatgcctttatctttcaaaacactgtaccatgtgctcttaaaaaaaaaaatcaatctaatctttta

SEQ ID NO: 377 - DNA, 6644 bp, Homo sapiens
gccctcaggaattctgattccattagcaaagttttttttttttttttgcatacagggaacaaaagagggatgtaatcctttactattattatttattttgatgttcatattttctctgatttctcaagaagggtcctgtggtcttttgatgtgtcctcattctttaagtacttccttcctttctggcccaacaagatgttccaggctcatcttatacttttgcagtcctagctctggaatcagccatttctccaaggagttctaatgacttttagtggagaatgctgtttagaaactaagatttgagtgcaaggtgtgcttatcctttttgagttatcattgtttctgggccatctcagtggatagaattaggaaatatgcatgtgtatatgtatgtgtgtatgtgtgtatttagataacttaaattggtatcatatacatgattctttgcaggccagttggtctctgtttcaagtacttaactttccctttgtaacacaaaagcagccataaataatatgtaaatgaatgggcagagctgtgtttcaataaaacttatttatggaccctgaaatttgtatttcatatcattttcacatatgacatattcttcttttgacattttttctaaccattttaaaacatagaggccattattaacttgtgggccatacaaaaacaggtgatagagcatatttggcctgtgggctgtagtttgccaagtcctggtctttccgaaacactttcagtttacatacaacacacatacctatatagtcatacactgagtaacaacattttggtcaacgatggaccacatttacaatggtggttacctagactataaaggagctgaaaagctcctgttgtctagtgatatcatagccattataacatcataccgcaacttattacatatatatttttgctgatgctgatgtaaacaaacctactgagctgccagtcatatcaaagcgtagcacatacagttatctatggcacacaatacttgttaattataataagtgaccctgtttttggtttatgatgtactatatagttttccctccatatctttatgggattccttctaggaacccactcgacccctcccgtggataccaaaatccaccaatgctccccaatataaaatggcataatatttgtgtataacctatgcacatgcttctgtatactttaaatcatctctagatttcttacaatacctatcacaatacctacacatcacttcatttgtgtgaatacagtgtagtacttggcacacagtaaattcaagttttactttttggaactttgtgaaattttatattttatattttgtttttatttatttttaaaattttaagttcggggctacatatgcgggtttgttacatgggtaaattgtgggtcgctgaggcttggtatatgaatgatcccattaccaaggtagtgagcacagtaccagataggcggacttccaagatatgccttcccctcaccctcccccatcaagtggtccccagtgtctttgttcccttctttgtattcatgtgtattcatcgtctggctcccacttataagtgagaacatgcaatatttggttttctgttcttatgttagtttgcttaggataatgtcctccatctgtatccatgttgctgcaaaagatatttcattattttttatgtctgtgtagtattctatggtgtatatgtaccacattttctttattcagtccatcgatgatggacatcttggttgattccgtgtctgctgttgtaaatagtgctgtgattaacatgtgtctttttggtagaatgatttattttcatttggatatatacccaatagtggtattgctgggtcaaatggtaattctgttttaagttctttgaggaatctccacactgctttccacaatggatgaactaatttacactcccaccagcagtgtataagtgttcccttttctccaatgtataagtattctcccttttcaccagcgtatcattgtggttttgatttgcatttatctaatgattagtgatgatatgagcattttttcatatatttgttggccacatgtatgtcttcttttaagaaatgtctgttcatgttctttgaccattttataatggggttatttgttttttgcttactgattcaagttttttataaattctggatattagacctttgtcagatgcatagtttgcaaatattttctcccattctgtaggttgtctgtttactctgttggtagtttcttttgctgtgcagaagctgtttagtttaattaggtcctacttgtcaattttttgttttgttgcattgtttttgaagacttagtcataaattctttgccaaggccaacgtccagaatggtatttacttggttttctcctagggtttttattggtttaggtcttagatttaagtctttaatccatgttgagttaatttttgtatatggtgagaggaaggggtctggtttcaatcttctgcatgtggctagcaagttatctcaacaccatttattgaataggaaatactttccccattgtttgttattgctgactttgtcaatgatcaggtagttgtaggtgtgtggctttatttctgggttctctatcctgttccattggtccatgtttctgttttcataccagtaccatgctgtttcagttactgtagctttgtaatatagtttgaggttaggtaatgttatgcctctggattcattctttttattaggattgctgtggctattctagctctcttttggttcctccatatagatttttataattttttttctaattctgtgaaaaatgacattggtagtatgataggaatggcactgaatctgtaaattgctttgggtagtatggtcattttatcaatgttgattcttcttatccttgagcatggaatgtgtttccatttgtttatgttgcctctgatttctttcagcaatgcattgtattgctcattgtagacatctttcccctccttagtaagctgtatccttaggtattttattctttttctggctactataaatgggattgtgttcttgattttgctgagcctagacattattggtgtatagaaatgctactgattttcttacattgattttgtatcctgaaactttactaaggttgtttatcagttctagaagccttatgatggagtctgtgggttttcctaggtatagaattatattgtccatgcagatagacagtttagctttctgtctccctaatttagatgccttttatttctttttcttgcctgatagctctggttaggacttctagtactatgttgaataggagcagtgaaaatgggcatccttgtctttttccagttctcaaggggaatgcttccagcttttgcccattcagtaagatgacattgtctataggtttatgttatatgggtcttattattttgaagtgttttcctttgatgcctaatttgttgatggtttttaacatgaagggatgatgaatttttttgaaggccttttctgtgtctattcagatggtcatatggtttttattatgaattcagtttatgtggtgaatcacatttattgatttgtgtatgttgaaccaactttgcatcccaggaataaagtctacttgatcatgatgaatgagctttttgatgtgcttctgaatttgcttgtattttgttgaggatttttacatctgtgttcatcagggacgttggcatgaagcttttttttttttttctgtgtctctgctgggctttggtatcagaatgatgctggctttgtagtctgaattagagagtagtccctccttctcaattttttgaaataaatttagtaggattggcactagctcttctttgtatatctggtagaattcaactgtgaatccatctggtctagggctttttttggttggtagactttttattattgatttaatttctgaactcattattggactgttcaatattgattgctatttttattgtgctgttgtccaagtgtgtggttgattttattttgatttttgaatttgctgagacttgccttataactgagcatgtagtcagtcagagtatgtgccatgtgcagatgagaagaatgtatactttcttgttgatggttggagtgttctgtagatgtctattaggtccagttagtcaagtgtcaagtttaagtccggaatatctttgctggtttactgccttgatgatctgtctaatgctattagtgggggttgaagtcctgagtattattgtttggttgtctgaatctcttcacagatcgctaagaacttttttttaaaatctgggtgctccactgttgggttgggtgtgtatatatttaaaataattaagtgttcttgttggattgagccctttatcattatgtaatgccctttctttgtcctttttgatcattgttggtttaaagcctgttttatctgatgtatgaatagctacccgttttttgtttcctattagcctgatagatctttctccatttctttactttgagcctatatatgttgttacttgtgagatgtgtctcttgaagaccatagtcagttggtttgtgcttctttatctaactgggcacactatcccttttaagtgggggcatttagtccatttaaattcagggtcggtattggactgtgaggatttgatcctgtcatcatgctattagctggctattatgtagacttgatcatatagttgctttataatatcaatgaagtatgtgcttaagtatgtctttatggtggcaggtatcattcattaatttccatgtttagcacttcctttagaagctcttgtaaggcaggtctaggggtaatgaatactcttagctttgcttgtttgaaaaggatttcatttctcctttgctgatgaggtttagtttggaatgatatggaattcttggttggaatttcttttcttcaaggatattgaaaacagaccccaaatctcttctggcttataaggtttctactaaaaggtccattgttaacctgatagggttccctttgtaagtttttctctagatgcttttaagattttttcttttgcattgaccttggagaatctgatgactgtgctttggggatgatcatcttgcatagtatctcacaggtgttctctgagtttcttgaatttgtatatcaccctctcaagcaagattgggaaaattttcatggactatatcctcaaatacgttttccaggttgcttgttgtttctcctctttctggaatgcaaatgagttacaggtttggtctctatgtaatcccctatttctcagctattctgttatttttttaaattattttttctttatttttgtcttcctttgttgcttcaaaggagtgaccttcaagctgtgaggtttttatttttcatttttatttatttatttattgagacagagtcttgctctgtctcctagactgtagtgcagtggcgtgatcttggctcactgcaacctccacctcctgggttcaagcgattctccagcctcagtctcccgagtacttgactctacaagcatgtgccaccatgcccagctaatttttgtatttttaatagagatggggttttgccatgttggacaggctggtctcaaactcctgacctcagatgatccacctgccttggcttcccaaagtgctgggattacaggtgtgagccaccatgcctggccaagctgccagattcttttctcaacttggtctattctgcttttaatgcatccaattgtattttgaaattcctggaatttttcatttccagaagttcagtttggtctttttttaaatggttatgtcatctttcaactgttgggttgttttactgttttgcctgggttgggtttcaacctcttcttgtgtctcagtgtgcttccttatcatcccgattctgaattctctgcctggcatttcagccatttcattctggttaggatccactactggggagctagtgtgatcatctggaggtaagaagacatgctggtttttagagttgccagagttcttgtgctgggtctttcttctgtgacagctgatgattctttattatttgaagttattgtcctttgggtgaggctttttgtttttatgatctttattgcccttagggttttttgactgtggtgtaagctggatatagttgaatcacttcatttctggatgcttttagggggcaagactcagctccatactgctgggatgcatgctctaaccctgtgggactgggactgggtcagcagctttgtcctctggtctctcactgttgagctttggctgggatagagaggctggggtgttcccagaccattgacagggcatgggtgtaggtgctccagcaggggcagcaggggcactgtgggcaggatatgctccagtgggcagggctgtgggcgaaaggcactctggcaggggcactgagggtgggaggtgctctggtagggggcaccgtgggcttgggaggtgtgctccagcagaagtggtggaggcgttgtggccgggaggcactccagcttggggtgctgtgggtagggtcgcttctgcagggggaaaccatgggtgggtgggttgctctggctggaaatgccgc
